United States Patent 7,868,149 (PLANT GENOME SEQUENCE AND USES THEREOF) - sequence listing, part 77

SEQ ID NO: 41653 - DNA, 33415 bp, Oryza sativa
  unsure (1)..(33415): unsure at all n locations
actatcaccctgaaacggcaaattaacatgctaaatcgcaagaatacaaaatggtcgtcgtttctgttatctggatgcacataactctgttatcaccctgcaaccgtaaattaatttgttagtgaacaagacatactagtatcatatatataggagtatcacctatcacccctgcaactgtaaattaatttgttgctgaacaagggagatattcacacgcatacaaaaattagcaagaaagcagggttgtttatgggagataattaattgcaattggtgggcaataagtttattattaccaggggtgaccatgtgagcgaaagagcggatccaggttgggctgagcccaaagtccttggcacacctcatgtgcgattaggggggccaatcattgcgtggatcattgtctagtctttcttggtttctagatccaattttattagtaccccaacttgctcctccgtataattatgctatattttgaccaaaagccaagggcgtatatgcatcttataattaattaattggacaagaacacacttcgatcgtagaaagcactaaagcgagatggtacattttggtacgtatatgtgctgatggtttactttgtccatcgtccgtgtgcaaataaatattagattggaaaatgtgcaactaaattggaacaaataaataagctaaaaacccttttgattggagatactatcaaattaattctattaaaaatcttgtcacgaaagaaattatatgaaaaatcatccgagatgattctaagttagccagaggtgatggcacgcgtgctgctgttttttgtttatgattatgtagaagatgcacattatattacatttatttgatatctgttacagtgcacaagaggaatacacaaataggccataacatttcacatccagatactaaattcaaattacatttataattttgtcaacttaattattatagtctcatgagccttaccgagaaattttttattattttacctttttaattttaaaaatagattctcacaaaatttattttcagttttgaatcctttggcacacagtctcggtgatgtggccaaacaaaattgccacgtcattgtttcgcagccaccgacacttgtatgaccaaaaagttcagaattagaaaacaaatttcaggagagtctacttgtaaaattaaaaaggttcaactttttgaaaaatccatttactgatgcatgctacatgtgtggatgcatgttgttcgagctaagagagatggctttggatcaaaagaatcccatcaaataattctggatgttcacataaatttcaactatgtatggaatacctgaatagaaaatcaaatcattttactttcataaacattaattataactctctgcagttttttaaatacacgtagaacaaaaaaatattggtctaattaaggattttgaagatattgttaaaatagcatattctcatgatccagataccaatgactacttattaatttataacgtaatatgtttttatgcaaatagtactacatccgttttaaaatatagtgacctaataaactagatatttctagtactagaatatgtaatatatcttatcccgtattagatggttatattttgatatagatgaagtagaacactaaacgctcgtcagattaaaaaaaaaaactctggcagccaaattagaaacttaattatttctcaacctggactggagatcgatatacgtgatgccagtacgcacaaaaggaactgttggagttattttgcatttaaaacggtcgcgactgtacttcttgattgcaatgaaatactcctgccagcccaaaaaagaccattgaaaaaggaacctaaaagaggaagagaaatcaaaggggcgatgccctgtagcagccacgtgaacggtcacatgcattgctgctgctgcacggcgatcgctgaagaagctagctaggcccccaaaatgcactgaagctgcatacagatacagatacatatacagagggttgtgggcacaatctgatcgaactctgtagtctgtaccatgccgatatcaagtacctcctggcctaaaatctctagaaaattaacgtcatcgagcttcgtgtatatgttcttggaaaactgtacaacggataacgtattcgggaccatttagtactactgattaatttttagaaaatataataacggagtatagtatatattgttgaataataaaatttaagtgatctcgatgatggtgtagtctaccagtagtagttggtgatggctcatgtgacacgctttgtgattttcaatttgtgccgacgatttgtttgtgattttctaaagttggtagttatgttaaaattaatagaaactatatgcggataacttaaggtagtatttggttggttggtgggatgggatgggatgggatgggacgaacccacttttagaggtgtttggttgaggggcgagtgggatgggttggtccctagagaggaatattcctcccagatccgggacaaacccatccggcaaaatcggccggacgagctcgtcccacttggacggagcacacggcgtctccttggcgaccgccggcgctcgtccgcgcccgcgcacgctgcctcctccgtgaccgccggcgctccgccacgaccgcctgccaccacctctgcgaccgccggcgctcctccacgaccccctgcctcaacatcggtcgccgccgcgagcgagatgctcggcgccatcccgccgctcatcgtgatgctcgacgagagcggttgcagcagctgcggtgatgtcgacgcggcgggctcgagtggcggcgaagcttggaggtagggagggcggcggcggcggatccagagacgggggactcggcggcggcgaaacttggaggtagggagagcggcggcggcggatccggagcaagggatctcccgatccagccgcggcgacgacggtgggccagcgggttgggtgctccggcggtggtggccgtcctgctgctgccgctgtgcttgatccggttgttccacgcgtggatgcaggtggcgcagtcaatggtcgttgacggtgatggcaaacggcgtccatctcatctctccctcatccctttaaccaaacaaaaaattgggattgtcccatcctacaaaccaaacatgtgagtggaatcattccaacctcaaaatcagggatggtttcatcccatcccacctagtcccgaaaccaaacacatgctaagagataagcactatcgataaaaagagataccacctctatctttaaagagttggtacttattcaagaatttgtcacagattactgtttattttcaagctttgatcgttccttttccagcaatgaactttataaatccaatactcttttagaggctttaatttttggtgatagcagtgaatctgctactccatctactcatattttagtttgagcatattacctcttgaattgcttaatattatatagcaattaaatgtaaatagatagtggtatataaaattaaattaaggtgagtatcttacataaaagatggggcaacatatttcatgaagaaaatacttttacttatgatagtcaacaatattgtgatcatttttcttttatctgtggcaatagcagagcacaggcacctagtacttttaaaaatatgctaccttactggtgtgttgtagggatgaaaatggtgcggatacagacggatactgcccataccatatttgtttctatttttttggatataaaaacgaatacgaatagctcagatttagaaacaaatacgaattatctcaaatacgaataaggatcgaatataattagacacgaatacataaatatttttttctcggaacacggaaaccacctcaacttctaatagaaacaaataccaccatatataattagcacattataaaatatagtataaattataaaaatattcaaaattttaaataatattaataatgtggactagtgttaagagatgagctattattaatctaaaaaggtagattgaaggttgtagagttataaaaaaatgatgtatttctcatgactttagcggatatccgaataacacggttcaccaaaaatttatattattatccatatccgtcggaaacaatgataacatatccgtattcatatccaggagaaaataggccatgcccaacgctcctacatgccgtgtggtttcatcctagtggctccataaggccatgccaaacgttcctacatggcgtgtggtttcagcctgccctagccaaatattcgtgccggcaaggacggagttgtgcccctacggggacatgcgtacccctgtgggaggtacgcgtgcctctagatgggagatgccttcggtggtccaggcctagagaggaggaagagagagggagaatggggaaaagtaaggacacctagagacatggagtatgtcgaacagacaaaggactccggtgaatagatcaggggatcaggaagctaatcaggccaccgctgacaaaatcgacacgatctcattggagaaatcgatgcaacctcgctggatcgagctcccaccacctcgatgcacccaatgttgttgtcgggccgtctcttgggaaggaggggaggaaggatgccccaccgtcttgatttggtcaatgaggtaggagggctcgtgagcatggcggtgggcggagaacgagagagaccgatggcgcacgtggggagaggagaggctgaggacgcaaatagggggagagatgtgaataagggagaacgcagcagcaatgcttgttcgatgggggagatgcgaatcaatgagaaagagagggttgggtggaaaaaaatatagaggaagtggacgacaaatgggaccataaaagattaagggtacatatttgccatattacctaaaacataaaaggttcaggtgatcttataataataaatctcaaagacctgacatacaaataattaagtactgaaaaaaaacatgtaagtgtgacctccattgtaggatatgtgacctactgacctatgtgtggtgtcagctcacatggcccacgtgaaaccactgctatatgtgacctccattggccatgccctaccgcggcgtgcacctattgattcatgcctggtttgtgcatttggtttccatcactttttttcatctccttcatgatctttaatttctttttagtagttgtggtggaggaagcatctaatcacttatccaagtctgaactgaatccataccataaaggatgttaaagtacattcaccaaaaagaatctagttcctattgtctggtgatctgcaaagttttttttttttgagaacttggtgatcaactgaaaagtgaactggtgagagcctatgcagactaaaaataactagtccctcgttggacttcgacatgacctcttctggtagtaatagtactcttaccttggacaatcatgaagtagtgcccagaaactggtggcttcattcaacaaacgctacaaaactaatacctgaaagttcagggttgtatccttgtaggcatcagttactacaaattaattgcctgttagtattgcaaatgtttctggacgactttttggcagttaaaagtgtgtggtgccctctctagtctctccttccttgcatatatgtactctacagtactatatggcctatcgattctgttgcctaagcactacaaatttctgaatgggacctaaccatttgtactatacggaaacatgcatagaaccagaacatcaacatcaactgcacggtaagtactctgtgtctaaacaagatttcggcaatactaaaagggaatggctatcaagctggaaaagtggatgggtttagagacaagaaattttatacaggttcaggccttcttaatcaaaaagtaataccctactcttgtccggggattgatccgccgagtatattattaatcgtatgatctgggtgaaaatcgtgcccctagaggcacccggaccgctccttatataggggaaggggtccgtattacaaagtacagtccatatccctaacggaataggtagttacagataaaatataatcgtaaccgactaggatcccgggtattttcttgacatacaagtttagaacttaacccgagtccctttaaagatattctatctatatatggcaccccatactcagtcagatatacatgccgtgtaggtatgaggtatccataatctccacagtagcccctgagacctttacagtcgacgaaatagccttctctcgtaatccaaaacgataacctgagtacctcgactccttctgccttgatctcccgaacaccaaaatcaaagacggtaaagggctgaaaacaaaaaatcgggtgcatcgactagatgcacctaattaggtgtagcccccgactatgtgattagttaaaaactaaacatatagtcaaggtgcaaataacatccaaccgagtggttttacaaccgaattatccaaaatatcatacagccaagcacatgcgacgtttaataaaacaaaacatccagccgactgctttagctttaatataccaaaaatggagatataaagaggcctgagtaaaaaatactctaaaggtccataaatcaacacatatgacaagaatccgagtaaaaactctcaaaagatccatcaaatgtggtataaatatgatatcatgataattgatgagtctaaatagcctaggctatgactcacgccataatcaaaataagcatataacatgccgagaaaatgattgttcaaaaaccagtcatctcaacaaaacccaaacagcctttgcagcctaaaaaggctcacaaaagtagtataacacctttctatcgggcacctttttatttgcatcataataattccgaggaattatctaactgcgtcaaaaaggattttaacagcattgggccatactgttgtaagcaaaaattgccgaagcaaaaatgcctaagtccctaaggatcacaacttaaccacgccgataacaaaattgggctgaagtactgttttaggcccaggcccattagtattcccgatacccaaataacaccaaaagccaaacgtcgcttcgtcttccccgccgaaactctcgccactttccccattctctgctacagtgcaaaagccgcgccggcgaaactagggttcaccgattcgctccaacccatcctccaaaattccacaaaaacctcccatgcaaccaccgcatcaatctcccatccattcccagccacatctcggatcaaatcacaccatctagttcgtatccatggcggaagagagagaaagctttgaaggtcagtgggcgccctccgatgtaacggaggagaacttgaaggagatggtggcgcacggcgtccttccggcaaaagagatcatcgggtggcgtccagcatatggtgaaatgttcccgacccccgacacacacgaggtggtggtattctcccatttcttttatggcggattttctcttccaacctcaagattcttccgggggattttggagttttacgggatcaatttgcatcatctaaaccccaactccatagtccacattgccaattttatccatgcttgcgaagcttttctggggattaggccgcatttcgctctattccgccgtatcttcttcctcaaaccccagccaaacaaaagcaaaccatgcgtagttggggcagccatatttcaactgaggggaaccttgagccaaaaatatttctccatgccttttaaaacttcaaataagggttggcatgcaaattggttttatgtgcaaaatcccgaaccaactcttcccgagtactcctgccttcctccagtgtatcaagatacttggaactcacttccaatgggagatgaagctgctcaagcgcttgccctgatggatcgtatactgaagctgaaggagtagggtctgcaagaggaacagatcacccgacattttatcaagagctggctggccccaatcaaggaaagatctcacacggcttttgaattcgacggcaagcatgaccctaaccgcgaagatctagaatctcttgaattcaaaattatgaaggagagaatgtataaaatcttctcaaatgcaatcgtagtcagctattcgcacttgctgccagtggtgccatacaatgctttcaacccccctccaccggtatatatttaacatctcagcctttctcaaaagcatgcttttatcatctacaaagttgattgaaaacttggatcatcatgcccaggaattcgccctgatgaagtcagatcctccaatcgctcaacgccgctcaccccgtcggcaaactggtcaagctggcggaggaccaaaaatccggtctgatactcaacctaacacctctcaatcggctaaccagtcagacttccgcaagaggaaattggttctgagtgacgatgaaaatgacgatgctgaaaaggctggcagcaaaggggtgactggaaaacagccaaggcaagctaacccgaagaagaaaacatccagtcgtcccatgccgaaaatcaggaagtcctccaggtacaaatcatttggccatttcccttgtattgttgctcactcactattgaaatagcactgatagcataactcaaatttataggaagccatctgacatagatccttctggaaaaggcctgagccgactgacacggagacgggtccttcaaaagaaaccggagcaactgccgaagatcgcctgagtgataatcaaccagcaaccgacaatgtagagaccagtaacgagcccccgactggaaatcagtcggccgaagctggagtcggtgctaatcaggagcccccgactagaaaccagtcaggtacagaacaaaataatgacatcccggaagtagaagcccaggctgatagccctcccaagacgagtgctggcgtcgactctggaactaactctcctgttagggtgcaaggacctgctcgtccccgaccggaaatcataacagataagcaaatcctccaaatctgttttgatccgacaaactttctccaattgtttcaccattattcatgaatgcataaggccccgatgatcggtgacgaagaagaggtcctccggatacaatcggctgaagattctcgcccacccatattagtcaagtggtgggatgacgaaatgcaaccacaggggatcgtaataaataaacaaaaagaggacgaggaagtatgtctgctgaaaaagacactcggccaagctactcgccttgtaaatgtaagtctccctatacacggcttcaatcatcctgtcagctactttgcttagatacagataaatttgtggtgcagagaatccatctcaggaatgaggcgaagaccgcaactcttgaaaaattagttccctagcttggaacccttgaagcaaccaaagaccagctgcgtgaagccaaagagcttgctaggaaaactgaacatgaccttagagatcggattgccgagcttcaagactctaactttgagctgagcggttcatcaaaagataaacatcgtctctgtttgatttgtttcatgttgctatccatgtgcaactgaccaatgaaaagcaacacagtgcaagcttctaggatatccgcgctggagaagcgaatccaagctctggagaaagacaaggccgagttggcaaaacagagggactcggctctgaaagatgtcgaaggtactggtagctgaaacttcaaaaaccactctcatcttcatgcctagtcattgatgtaaacctatttgtgtagaccgcaagatcaaatcctaggcccaattcgacgtcttagttaataaaattaagaagcttgaaggagccagagatgaagtcgccaatgccgctacgccacttgtccaggccatgtttttcaataacaacggtccaagttcacttgatgttgtcgaaatcttcgacaagctgagagctactccggatacatactttaagaacatcaaagaagctgggagtatgggagcaggcctagcgctggcgatgaccaagtccttgtacccgaaaattgatattgatgctgttgacggctttgaagatgggacaagtgaagaagccgcccttgacctcatcagtgatgcgtaaaaatctgccgacaagatagccgctgatgtagtggagagattccaggacaacaatcttaagccgactgggtctgatgattctgatgatgagaaaactgaatctaattaattgtgtattctgatgataatgatgatgacaatggagacacaatttgtactatactgatgaacttatgctgtgctcgatgatttaaactcagctctagatttcttaaaagtttttgtcaaaccttattgagcctagaacccgcaaaagttgttaaaaactttcagtcctttttgattgagccaaaaaatcgaacaaggcaatgataaatcaagtaagcaaattgaattgataaaaatcacactccattattattatagtagcccccaactgacaactcaaggaaaaacttgatgttagcagtcaaagaggaagatacaaaagtaatgcctaagcataaaacgacgaagatgttcaatatttcaagagttgtcgatatgagtaccgtcttcacgcttgagttggtaagaacctggccgagtgacttcagaaattatgaacgatccttcccacaagggagataacttgtgccgatcccgtgtagtttgaatttttcttagaatcaggtcgccgactagaaaagttcgtgatcgaacattgcgattgtgataacggcgcatcccttgtaagtaccgagccgactgaattagggctgcttcacgggcttcttccagtcggttgagatcatctactcggtcttctccgtagcgctcctctctgtagttacgaaattgtagagattcaaattccacctcacttggcaacatcgcttccactccgtagactaggaaaaacggcgactggcccatagcccgactaggagtggtgcgcagggaccaaagtacagatggcagctgttctacccacttgccggcatagggatgcagtcggtcaaaaactcgtgcttttattccttggagtaccataccattggcgcgttcgacttgtccattgctcatagggtgccttacagaggcataacaaatcttgatgccgaagtcctcacagaaatctttaaatactcctccagtgaattgagtgccgttatcagtgatgatctgattgggtatcccaaaccggtgcacaatgttgacgaagaaatctctagccttgtttgccgtgattgtaatgaccggtttagcttcaatccacttggaaaatttgtcaacggctacaaagagatgagtataactaccgacagcctttttaaatggaccaaccatgtcgagcccccaaaccgcgaacgaccaagacaacgggatggtttgcaactcttgagccggtagatgagtttgtcgggcgaaaaattgacaaccctcacatgttcgcacaattttgtcggcgtcggacacagctgtgggccagaaaaaaccctgtcgataagccttgccaacgatggttcgtgcggccgcgtgattgccacagatgcctgaatgtatatcctttagcaattgtcttccctcctccaaagacacagcgttgcaggattcctgacagacttttcttgtacagctcggtctcatgtaagacataaagtctgctgtgcttggagatctgctcggcttcatctttatcttgagggagttcttgtttggtcaaaaatcttatgaggggctctctccagtcggcttcaatcatgcttacgccttgagtgtttgtggcctcgattatttctttccttggtacggttggctcataaagatgctcaataaacacgtcagaaggagctgcttctcgctttgaaccaaaattagccagtctgtcggctgcctcattattatgtcgaagaacgtgggttagctcaagtccatcgaatctatcttctaacttgcgtacctcctgccgataggcggtcatgttatcatcaaggcaggaccactctttcatgacttgattaacaaccaactgagaatctccacggactattagacgccgaattcccaaggagatcgcaatccttagtccgtgaagaagcgcctcatattccgccacgttatgtgacgcagaaaaatgtatccacaatacgtagctcaacctctctctagtcggggagattagaacaacccccgctccggtgcctgaaagcctctttgacctttcaaaatgcatagtccaatactccatcttctctgcaggcgtgtcttcttggcactcggtccactcggcgatgaagtcggctaaagcttgggacttgatcgaagttcgcggcttgaaggatatatccaaagacataaactctaaggcccactttgcgatccgcccatttgctttgcgattatgacgtatatccccgagtggaaacgatgtgaccaccgtgaccgagtgaccttaaaaatagtgggataatttcctaatggtgattagaacaccgtataacagcttctgaacttgaggatatcttgtcttggagtcagccaaaacctcgctaacgaagtagattggtcgttggactttttgaacatgaccttcttcttcgcgctcaacaaccaggactgtgcttacaacctgggaagttgctgacacgtataacaacaacggctcttgtggatgtggtgaagctaagactggtggagtagtgagaagttttttgaagtcttcaaaggctttttgtgcttcgggtccccactggaaattatcggttttctttagcagcttgaaaaaaggcatcccccgctcgccgagtcgtgagacgaaccggctaagcgccaccatgcagccagttaacttttgaacatctttctaggagctcgatggtttcatgttgaggatggcattgattttctccgggttggcttgtatgcctctatgggacatcataaatccaagcagcttccctgacggtactctgaagatgcacttttcagggtttaatttcatcctgaaagcgtggatgcttgcaaatgtctcttctagatccataatcaaatcatccttctgcttggtcttgacgactacatcatccacataagcttcaacgttgcggccgatctgagttgaaaaacatctctggatcatgcgttgataagttgctcctgcgttctttaatccaaaaggcatggtgatgtagcagtaggccccgaagggcgtgatgaatgaagtctttaagcagtcggattcctttagtcagatctgatgatatcctgagtagcaatccaaaatactgagtagctcgtagccagccgttgagtcaactacctggtcaatgcgaggtaacccaatggggtctttgggacaagacttgttgaggtcggtgtaatcaacacacatgcgccattgccccgtcttcttctgaaccaggactgggttggccagccagtcgggatgaaggacttccttgatgaagcctgctgctaacagcttagtcaattcatccttgatcacatcttcctatcctgtgcaaaacggcgcagtcgttgcttgattggtttagcgtcttccttaacatgtaaagagtgctcaatcacctctcaaggaataccaggcatatcagatggtttccacgcaaagatatctttattattttgaagaaaggtgatgagcgtgctttcctatttacaacctaactcagcgcttattacagcagtcttagtaggatcagagggatatagaggaatcttcttggtcttggcgtcgctttctccgctctttggcatcttggtcgcaggcacttctccttcgcttgctgtggacgcagccagtcggatttcttctcgggcgagcgtgatctcgcgggtctaggccatctcgcagctttccttgtcacacgtgacggcttgcttgatgtcactccgcagggatatgactcctcgaggaccaggcatcttcatcatcatataggtatagtgcgggacagccatgaacttggctatcgccgggcgtccgagtatggcatgatacgctgtatcgaaatcagcgacctcaaaacaaatgttctctgtacggaagttctcctgagtgccgaaagtaactggaagagtgatctggccgagtggcgtagcagatagccccgggatgactccgtgaaagggcgcattactcggctttaattccatgcgagggatctgtatgtcgtccagagtcttggtgaaaaggatgttgagtgcactgccaccatcgatgagggaccctgcgaagcttgacgttgtgaaccactgggtctagtaccagggggtaccgccccgggtggaccactcggttaggatgatccgagcggtcaaacttaattgttgtctctgaccatcgaagatattggggcgtgttgggctgaacaacattgatctctcgttcggtcagcttttgctttctcttggattcataagctaggggtccgccaaagatgtggttgagttccttgtgatggtcttgaaaactagtcggggcatcatcttcatcatccttcttctttgacgtgctttgatctccgtcagaggtcttgcgtgcgttcttggcgtattgttctgcaaactgtttgtagacgaagcaatctttggctgcgtgattggaattgttggatgatgcgaacattgggagttcatgatcttgtcaaaagtgttgacgcgtgaacgttgtcgggaggatggtgtagtagttgccacaagttcctcgggcttacgcttgcgatccttgtgattggtacttccactccccctatagtcggcgtatctttcttcggctttcaagtggtgcccgactgcttggacgcggtaatggcatcttcggctttggcgtactcattggctttttcgaacatttgcttgaccgtcctgggaggcttgcgcccgaacttgccgactagttcatcgtggcgaatgcccttagtgaaggcggcgatgatgacgtcgtcggtgatgtcggagatcttgttgcgttgctcggaaaagcatcggatgtaatctcgaagggattctccagacttctgaatacattgtagagatcaaactgtgtaccagggcgttcaaaggtaccctggaagttggcgatgaagtggtcgcgaagttccgcccaagatccgattgtgccacggggtaacccgtgaagccaggaccgggcagaatccgctagggccacatgcaaatagtttgccatggctttgctgtctcctcctgctgcgcgaattgtgagaccgtagacggtgagccgagactccgggttagtggtgccgtcatacttctcgattccagtcggcttgaagccagctggccaatccactcgacgcaggtcgcttgtgaaggcagcaactccatccacgtcgtcgtcgtagcgatctggtgaatggtggggaacgtagcctcttgccgcgcgccgctggttgatagtgtcgcgaagatcgacggggcgcctgtgatgtggggagcgatgtcgttaaactcgatgctccctgtgtcgttcgggaggtgagtggacagatcgctcgtcgtgacccctgctcctgcgactggatcccgcgctgatgacactgaggcttggttggtgacagtcttgagatcgaagagggggaactcggctgctagtcgacgtgcggacgcttgcagagttaaccaggaccgaggcggcgatcatggtcttggtctggttcaagatgttgacgatgtgattggcttgattgagtgcgtcttccttaaggagggtgtcgaggagggtgatcgctgcaactgcgttctattgaggggtgcgaaaaaccgccgttccctcgacgtcttgctgcccgataagttctcgtgctcttcgcccggcatccaaggcgcgctatcgccggtcctcagcctcttttgcagcccgttcgcgctcctgttgctcacgctgcagccgttctcgctcttgtgcttggcgctcctcttccagtcggcgtcgttcggcttcctgttgcacgcgttgttcttctgcttcttgggctttacgctgttcttccgtctcgttgtcagccatgaagatgccaaagtagagaggcgtgtagttatcttcaaagtcttcatcgaagtcgtcgaggttgcggcagtcgtagcggtagccgaagtcgtcatactcaatgatctccgttggccgtgagtcgatgtcgggggagctgaggtagccatccagttgttccgtcgaaaccgtgccgagaggctggagtatgacgccgacttccctggagctaggctggatcggggctgaggccggatcccgcctagacctacggggagaagacgcccttgtggtgaagacagcagccaaatcatcggggagtttcatcaggattggcggataggccccatcgtcttgatcggatcgtgttggagtagattggatctcgcccgagtggtttgaagccaactcggtggagatgatcttggggtagatctcggccgagttcgggataccgaacggggtggagatttggcctcttcccgactggttcgaatccgagtcgaggagagaaatcttgccgaagtcgttggtgatgaagtcgaagctgccgaaccggaacgccttctcgggagggaagacgaagttgtcaatgccagaaatgaaacccatcgcactagtcgacgaagaacttgacgcttcccttacctggtgcgccaactgtcgaaacaagatttcggcaatactaaaaggggatgactatcaagctggaaaagtggatgggtttagagacaaggaattttatacaggttcaggccttcttaatcaagaagtaataccctactcctgtccggggattgatccgccgagtatattattgatcgtatgatctgggtgaaaatcgtgcccctagaagcacccggaccgctccttatataggggaaggggtccgtattacaaagtacagtccatatccctaacggaataggtagttacagataaaatataatcgtaaccgactaggatcccaggtatttacttgacatacatgtttagaacttaacccgaatccctttaaagatattctatctatacatggcaccccgtactcagtcagatatacatgtcgtgtaggtacgaggtatccataacctacacactatgacgaattgtcatgcaaccccctgaaaaataaaatactaagcctacaaaaaaagattcttgtggcgcatatgcaaactaaaatacaaagtaatatgcaaactaaaatacaaagtaatcgccacatgcgtgttggctttgcaccagacccaccaaacgggagatggtaagctaatggagacagatacaagtacgtgtggttttaatttaattctaatgcgattattatacacctgttttatgtatcattactaaattatgggctattatgcacttagacccctaggtgccaactataaattttactattattttggtgttgcatctagaaattaattttgaggctagatttaaattccaccatcgaaaaaaaaaatccagaaattagttttggtgagctcatcagtatatgtccttttttgtgcggacaatctgttcgcatgatattatacgacacgattggactgcaacgaaagaggggccccactcgtatacagacgtcacctttcaactaactaattcccgcttgttccgagacaaaagcctctcttgcacaagtcacgtggtgagaggccccaagaaagcttacctaacagttcatcatccactagctagccactttgatcatcgatgaagctggacctttcgttaattgttcctcaattttctttcaggaattaatcatacatatatatatgcagccgttggatttgaagttgttgccacattcggaaggacgcaaaacgggatcagaatcctctgcagttgaagtcatgggactttatcattgacatgtggacccgatgattcctggacccaaatatcagtgacaaaagcaatgtgtatttgactgcagaggatctcaatccagcaaaatggaaggcgatggcatgagcaacacgccaacaagttcgaaaccttcttacaaaaagttaggagtagcctgtttcagcttaactacgggcctgtttagttcacaaacaaaagtttttacactgtcacatcgaatgtttagatatatgcatggagtattaaatgtagaaaaaaacaattacatagttcgccggaaaattacgagataaatcttttaaacctaattgcgccataatttaacaatgtgatgctacaataaacatttgctgatgacggattaattaggcttaataaattcgtctcgcaattttctggcagaatttatagtttattttgttattagactatgtttaatactttaaatgtatataaatgtatataagtatatctgatgtgatataaatggtcaaaatttttttttgcaactaaacaggtcctacgacaacaagcttgacaccaaagcatctgcacttctgcaggcaggcgtgtgtcacatgcatttctggctcacaggcacatgtatgtgtagttttaatttagccggtcagacaactgccatcgtcctctcttgatttcgcctaaaatgcacgctgcaagatagatctaactttgaggggaaaaattggagataataattttgctaagaaatagaattaatgctctttttttttgtttgacttgcaagcatgcatgtgccattttaaagaaagatcaatttagcgggataattggaactcacatgtctatatgcaggtcacgaatgactggattttgcggacgtacgtggcacaagggaatggctggtgggatctgcatttcccacgttcatattgatgttaatgaattttcccacatttatattgatgttatttatttagattcattaacatcaatataaatgtgggaaatgctagaatgacttacattgtgaaatcctccgtttcacaatgtaagtcattctagcatttccaatcctccgtttcacaatgtaagtcattctagcatttctcacatttatattgatgttaatgtctatctagattcattaacatcaatatgtatgtgagaaatgttagaatgacttatattgtgaaacggaggaagtaacacccttgatctgatattttcttttggaaaaagtacgaaaattacccctccaannactatcgcggtcgaccgaattatcctcctgaaccacaaaaccagatattctttacccccaactatgcaaaccggacgaattaccccctcggtccaatccgcggtggttttggtctacgtggcgtacgcatgacagtccaatcagcattctatttaaaaaaaattgtgggacccacatgtcatactctttcactcttcctctctcctctctctcactctctgtctcactctctcacgggtcggcggtggcgggtggtgggcggcggcactggggccgtacgaattacctcatcatctcctacggcgtcttcagcagagtaacgccgactccgaggtggccgccatggctgctaccaagaccgtcgacgacgagtcggtggagtcctacgtcacccagatgatgcacggccctctggtctttgagtagaatgatggtggcggtgaagctgatgccgtcaacaaggagggtgtccaggcgatcccctcgtcgtcgtcgccgatgtcgtcccccacgcctccccgcgtccgccgccagccacctgcgcaacctccgcgtccgccgccgccgtctgctgccatcctcagtggtgccgtggcatgtgctgatgaggggagggaggagagagagatagaggtggggaactgacaggtggggcccactgatttttttattaaaagaatttctgactgtattgccacgtaggaccaaaaccagcacagattgaggcggggggttagttgtccggtttgtatagttgggggtgaaaaatatctggttttatggttgggggtaattcggtcgaccgtgatagttcggggggagggtaattcgtacttttctcttttcttttccatttatacgtttgaatattactgatagatcttcatttgttggactttatcgacgatatatgtaattcaattccccttgattgttcatggattctaattaatatctttaactttttctcttttttttacggatgaccatgtctatttcatcaaacagagtaaaaaaaaaacagtgttcagaacaaaacagaagatgccccccagggtaacagtctaccattacaacatatttaatacgatcaggaggttcaagatgcatagccaacaggcatgaaaccatagtagtacatgagttcatatcccctacaactggaagttttaatagaagagatacagttataccaactcattgaattaatcattgttatcaaactattagaaaagaagtaattaatgatatgcactatcagtttctcttagtactgttacacaaattgatactgatgaatgttacgaaatgttgatatatgaaagtacttacactataattggtgtgttaatttcaattccatataataaatccaaattttgtgtcaatattgcaaagatcccaatagggtttaccaattcagcttatttatttcatttaccatgtttcatttatatagagaatagtttcatttgcatttaggtgtggatggaacttttttatttgttggatcattttatttaaattttaaaaacataacgtgaatagctagtgggtgtgaaagtatttgtagttcgtagcaccattattcatggccacgccacgtcttcttaacgacaaaatttgctacagggcatcaaaaaaacatgtaattagccggtgggcaccgtaagatcgtgaatttgctgcagggcaccatcaaaaaatggtaattagctggtaaatactcggcgtattattttattatttcggaggaaaagaggtgtgagaatttttgaattggcgagaatgcccccggtggcgcacccagttatcccgattgggtccggtcgaaccagacccattcggtctcgtcgccgcaccacatatcccaacctaaccctagcctgcgagtgaggaggtggcggcgacctagatcggcgaccatatttggtgagggtggcagcgacccagaccggcaagcagcttcgttcacctgcaccagtggcaattgactggaattccttgcacacatgccattttcacctgcaccagcgagctgctgccagcaccaggttgatgttcgccacggcgaagccgagccgcgtcgtgccgagcgcagacacctaatagcacatcttgaacggtttcacgggcggcacgcgggatgggataggcaccgccttgaggttaacggcgatgctggtgacgcggaggtaataggcgccattcctggggttcttgaggaggggcacggggttgcagcggagaccttcggcgatctccacgggcagcgctgcaaggagctggaatggtccgcagatggccacgccatcgccgccgccgctagccggtggggtctagtcgggataacgtggtgcgctatcgggagcattctcggcaattcgaaaattctctcacctcttttcctctggaaataataaaataataccctgagtatttaccagctaattaccactttttggtggtgccctacagcaaatttgcgatcttacggtgcgcaccaactaattgcacgttttttatgctctgtagcaaattttgcccttcttaacatgcatgatagagttcaagatagagatcttttcaatgagaatggcttgcctaaaaggttgagatttagaaagtatgttcaagatagagttcttttatagggctccatatttacctcttaagatatgacaaactccctagccattcaattcttgatagtttattttgcaaaagaaaatgttgtctctagccaaaaataaattatccaacaacaaatggaaataccaacacacataattacactcgtttaagttaattgtgaatattgtctactaaatttgtgcatacaatcaattaaataaccggaatcagaattttaaacaaaagattgaaatgtactcatattctcctgtccacaaattaatatgaacatctgaagcatttgaaatttgtccacaattataagcattccaaaataccacttgtcacattaatcacttctcattcaaacttcttcccatcttacccctaaccacacaactactcccatccatcactcatttaatgaagataccaacagtggcggatccagaaagaaatagcagtagggtctgagcaaactagatagagttacagtccccctcccatctacatatggtaaaaaattttagtggggtctttgtggggtctctcatagtcttcacgtcagtagtgggggctcgagaccccgccgccccatgctggatccgcccctggataccaaagtcttttgtttttaaccttaatctatgataaataatctcgaaatgtttatatatttatagaatgggggaatatcatagtaaataatgtgtgtaaaagtatgttgaggtacttgaaacagagaataagtatttttgaagtcacatgttgctatgtaaaaagaattaaatgcaattaaggagtatttttcttctaaatgagttaatttctactgaaaatagtttaatttgtattcttttagtatatgagataagtccatttgacccccttctcgaattcttcgctttatctagaatacaccctcgaactccaaaaccgaatatttgacacccctaaactttcaatctcgcttactttacacccttgagtggtatttttcccacttttgttacactacacgacacgtcagatgccacatcagtagggtgagagaagggtcccacttgtcaatgtcactgtcttcttcttccactccctctctccacttcccagctctgcaagctcgatgcggccacaacaagatgatcgaagcggcccatgaacttcctgccacaccacctagcctccgccagtgctcttcccctcctgccttcttattcttcgtcccttcctccctccgctctccggcaatgatggggatatggagctcacctcctcaccaagcgaggcggtcggtggctagtttggcagggagcccactgcccaccctttgtcctagctcgagagaagatggggtcggcgaggttgacagggagctctcttggccaaggtcaagagaaaacgagtaggggtgagtgttcggttttatggttaaatcagttcagttttttcggttctctagaattttggtttcatatgaatggcaaccgaagtgtttgataaaaaaaataaaaccgcacaaaataaactgaagcacatcggttcggttcctcggtttaccgagaaaaccgacctacttaccttgcacgcattccagagagtgtcaggatggctagatgcgatcttccttgcggccttcacggagcgaacatatccagcatgctagttagggcacccacaatggttatctataagctctctacaagagatccatgtcagcatattttcctatttgaaagatattaaataaagagagagagcaaagctatctactaacttagagatagtctatagagaaaaacgaggcaatgcatgagatagctatagatacccatgtagacatactattgaggtggtttactattaatctagtctattgctgagatgtacatgttttatagtgagcaccttactttaccattgtgggtgctcttagcagcctagttgtgttaacgggctttggcttattgagttaagtggacttttcagagtttcacgtcgccaacacaccagggaatgactttgggctagcagtgcacgtatctagatcggttgttcggcttcatcggttgttgcgaacagaaaacagcacaaaaaaccagagaccgaacaaaagaagaaataaaaagaagagaaaaccaaagaccaaacaaaccgctacttcggctcggttcagtccgatctttggttgtcggtatttttatgcccacccctaaagacgagggcagcggcgagcttggagaagtagatgaggaactcgggatggagcggagttttagcgacgaccacctactcaagctccaccctctttggcatctggatctagcggtgtctagttgagttttcggagtgtcacctccctaatgtccatgatacctctgccgtcacctcctacccaaactctataaacactactactctcctcggcaagcttcccgattttctcggggaactcgacgacagcctcctacccaaactgcccgcaaaagggtgggagcgacggcagtaggaagacgtcgaccggagggaggggtcttggtaatgggttcttcatttgtcgcgacagcgtactataaagtggttgaggagacagaactcaagctcaagctcgcagtcacatgcgctaatttactagaggaggaggcactgcaggatgtgacgctcaaggtcactcgagcaatagggaggaagctcaacgatgacatccatcgagaaggagccgagcgacggcccacagggaagaacccaccggcaacagctggtgggtgcgtccatagaaagagaggaaagatcaggaaaacgaggagagagaggggaaagagtggaagaagtgggtcactaataggtgggtctcgctatttttttccttgattgaactgtaacatggacaaaaagcactccgatttggtttaggactgtaaattacccaattttaaagtttaggatgtattttagataaacataatattttggggtgtaaaatgattgtaatataaagagataggtgtactttgttcgctcttcggctcttgtatgggtacgcgtgttgactcgtgagatgaaacgaggatttcaatgttaacacacatactcgcggtacaaattaattgaaccggtttgggaatttggtaacacctttgtattgtttgctcagtacatcgtctcccaggggaatttctcattgaacttctccagtgcagctagcgctgacaagattgtactagtatatacatatatatttaaaatcctgtactagcaccagtatgatacattctctattatctacgtcatccatcttttaaaataagatgaaagcataacatatcccattggcaggaacgataacactgtcggcaaaactcctagagatccaccacgtacccaccaaagataacaagttaattagccaaaaaccagtcatccctgatcagtttggcagcttcaataaccgtttgcctcaccgtccaacacccaaaaacaaaaaaaataagaatccagaaaaaaaacatacaaaaactgtgatgagatctcgtccgcgacagattcctatctgatggagcacgtaaaaagttttatgccccccgatgacctgtaagttttaaacatggccgggctcggctcggctcacgcacgcacggtagctgcatcttgcagtgcagtgctgcctgcctgcctgcctgcctgccgatgccgatgcgtggggaggcgagtcgtacgtcgctgtcggcacatgcatactatgcccgatgtagggtatgtttggaaaggttaagcttctggtgatgtttggattagagactttaactttagtctttatatttatttttagatactaatttagagtattaaatataaactacttacaaaactaataacataaataaaagctaattcgcgagataaattttttaaacctaattaatccataattagagaatatttactataggatcacataggctaatcatggattaattagactcagtagattcgtctcgtgaattagtctaagattatggatgagttttattaataatctacgtttaatatttataattagtgtctaaacatctgatgtggtagggactaaaaagtttttagtcgcatctaaatagagtcttaagaagcagctgtttagttttcagcttgtgacttctagtttatttctagattttataattatagctttcttaaaatctagataaaaactaaagtgttaggagaagtttttgattcttttaaaaaaactgcagcagttataaactccgtccgtaggcagtttgatcgagttgagtgggctgatcgatatcacttcacttggcgtctgcttacgcctctggcagcagtggcacccagtactactctttttttttctttttggctcagatcaatgcgcccttgtgatttttcgcttgcgtacgtcctcccggagattggcgcgctctcgtgccgtcgtgcaggccaaaacgctggctctccaccccaacctgtcattaggttagttttttttttcttatagagtatttaatttggggtgcattgttttgtttttgtccttgtttctctctgtttataaaaaaaatgtttcttttttctaagactttctatgtggaatctcaatgacgtagtacgcttaatttttttgttaattaatttatacataaataatgattgtagatctgtcgctgtggtaagatccgtggcacaaatgtacagtggttcaaacaatattatagttcacaagttcaatttgatgcttaaatcaatcatattaaactttcataatgctaaattttggtattgctaatatttaagtaaggttaagatatgtatgtcgtatttagtttgttacatttgcgacttttttgtgagataaaagattctattattatcaaactttggtagtaaaggtaatttttgtttggattgttttcttgcaaattttatcgatgttgtcttttttccttcgttgggacctttattttgatgaaaatataagctatgttgattttataacattgaactgctatcataaccatatcgtgcgatctaaacatgtacactaaacagtaaaacatgaacagatccgttgacgagaaatccacgctcagccgatggtgctggaactgtgttggcgtgaactaagtcgacgaacacaacgacctgggagatctgcttagctctagtacaggtccaaaacttgataagatgcgagcgtaccagtcagtttgatcctgcaactgataagatagataaatatgttgatcaccaaagagccgatcggctgacaagccaatagagagattccagccaatgtcgatagggatttgagcaatcggttatatgttcaatgtagataatgatataaagataatcggctgatgacaatgtaataaaacaacaatataatccagtagaaaccaatcgactaataatgatatgatagaataaacattgatccgaaggttaaagcatacatcgactggaggtccgatgtcaataaatccaaacaattagataaacagtaaaacctttgttgcaatcggctaaatccaacttgtatgtaatccttataagccgatgcaacgttcatataactcatcggctgaaaccccgatgaaacccttattataatcaaagacatgttagtttttatgattctaagcacgactagggatgatgcatctcaaagtatgcaaagaagcataaagtctatacaatcaagcctttgactaatttttagggtggtggataccttagctaatctaatctagtaaagtgatttagccgataccgacataaaccctaaagcgagaatcagccgatatgactaaatcgatatattgaaactagataggcaaatatatcaaccgaactagagcgatcgaagaggtcgaagcgatgcagccttcaacaacaccaatgtaaccgatacaattgccagggccggcggaacgtaggacttaccccttcgccaaagatcgaaagccgatatagccccacgtcaagtgtcaagttccgccagtgataagtaaaaacctcggtaaagagggtggcgatgagccgatagtagttgtattgatcgagatatagtttacaatgaccccgagtgtacatatttgtacccataggtagatactagtccttcttggataagaaagaaacttttctaaacataaaaggaaaatataaagtccttattttatataaacactaaacacactttcctaaagataaaaggaaactaacaaactcttcctaattgatagataaaccgccatactgcattctccttgaactcagtctcttctggataaacttcctttaattaattaatttcctcaaccgaatctaccaagaatctgactgttggcgacttgacaactcccatcggctgattccagaactctgaaactggtactaacttattgatgaaaaatctgcgcttggtggtgctggtctgtgttggcgcgaactaagtcgacgaacagaacagcctggaagatctgcttagctccaatgcaggtccaaaggttgatgagatgccggcgtgccagtcagtttgatcctgcaactgacaagatatacaaatagcatatcaatgagtcgatcggttgacaagccgatgtcgataccagagtctgacaatgatagggttttgagctatcggctatatgtttgatgcagagtctgacacttgatgcaaataatgatgtaaagacaatcggctgatgacgatgtaataaaataacaatataatctagtgaaccaatcggctaataatgatttgatagaacaagtgtcgatccgaaggttaaagcatacatcggctgaaagtccaatgttataaaatccacaagattagataaacaatgaaacctttgttgcaatcgactaaatccaacttgtatgcaatccttgtaagccgatgcaacgtccagataactcatcggctgaaaccctgatgaaacccttattggcaatcaagaagaaggctagagattatggtactaagcacgacttagtagatcaaacttaactgatgcaacattaagtatgaaaagaaacataatatctagacaatcaatcccttgactgattttcagggtggtggataatgttgacggtcgttatcaatcagtttcgaccatcaatattaccaaaataggagagaactagtgatgcttgcatgcataaatatgttagaacaataatattccactagtattaggtttactaaccttttgcagagaatgaccataaagtggaggagaatcgacatcaacacaaatgataaatcaatcggacgatgttgagaaatagacttatgtatgaatgggccaagaactcagaattgacacgacacaataggccaaaattcacaagtctacggaggagaataacagaggaggccacctgccgattttgggctaggttgggccggcccctggttcggccgaactaggaggttcggccgaacctccctctccaccgttggatgtggggtttggcagggacgctccagatcctctcctgatggcggttgcggtgtacttcagacatttcgcagtagttacaaccatcatacctgcctataaaaggacttcaccttctcacttcactcacacacctcaagcaagagctctttcatctctctcaagtttagtttagtagtatctagctggtggaatagaattagaataggaatcaggagttcggaagtcttcggaagagttcgggtatggttctagcagctttccattcctcttttgtaagctttgtacttttattagaatactcttctatatacatttatggtattgaaatactttccgagtatatgagtacctactttatattatgttcttattatactgaatatacggctagcttatctgggaaatgctttggtgcgggtatagtgtttgcttatgcaattactctatgtcatgacgatgatattactctcgaagttcttcccgatgggcaaaaccgacgccctttgtggacgaatttccagtttccagcagacaagggacgagtccattccggaagcatgggaactactgcaggagtacgtggccgcctgtcctcatcatggaatggacgactggctgatcttgcagaacttttacaataggctcaccccaatgtcccgcgatcacctagacgccggagctggaggagcctttttcttttaaacggttcaaggaaccgttgaactcatagagaagatggtctccaatatgggttggagcaaggaacgactccagacccgtcagcgaggcatgcacaccgtcaaggagacggagttacttgctgccaagctagacctcctcatgaaacgcttggacaaccatgagaaacggccacaaggcaccgtcaaggccttggactcacacgtcacgtgtgaagtctgcggaggcacggatcattctgggaacgactgcccggaaacccgtgaggaggcgatgtacatgggcaacaacaacaacggttatcgtccacaaggagttcaggggtggaaccaaccacgctcatattatcaaggaggaaataataacggtaacttctctaaccaaccctccttgaaagatcttgtttttgcgcaagctaaagccactgatgcgctaagcaaaaagcttgctgccaatgataagatcttagagaacataaatgtctagctagatggctttgcttccgcatttcaaaaccagctgagctttaataagatgtagaaacccagttagctcagttggcatatttagtccctgcaaatgaaactgggaggattccggggcaaccctactcctccattgaaaatgttaaggcgatcacgacaaggggaggtaagtccactcgtgatccaccgtatcctaaccctgccggaactaatgggatgtcaaaagaaacgccatctaatgactcggctgacaaggagattcagccagaaaagacagtgccacaggagtactgcgacacacggttgctgccatttcctcaatggagtaggaaaacgtcagtggacgagctgttcgctcgttttgttgaagtgatccagaggattcacatcaacgtgctgttgttggatgcaatgcaagtgccaatatacgcccgttatctcaaggacatactcaacaacaagagaccgctcccaacaacggaggtggtcaagctgacggaacactgcagcaacgtcatactccacaagctcccggagaagaagaaatattcggagtgtcccacgatcacctgctcgatcggggcacaacaattcgaccaggccttgtgcgaccttggagccagcgtcagcgtcatgccaaaggacgtctttgacagactcaacttcacggtgttggcaccaacgccgatgcgcctccaaatggctgactcatcagtccgttaccaagcagggatagcggaggatgtgccaattaagatatgggatttcttcatcccggttgactttgtggtgctagacatggacacgaggaaggagacgccgctcatcctagggcgtccgttccttagcaccgcaggagccaacattgacgtggaaactagtagtatctgtttccatatcaacgaaaaggaggaaaagtttgagtttcaaccgaggacggaacaatgctccatggtcagaatcaagtacgggccaaacccgcagaacattcaagaggtcgaagtggagccacccaagacggatagcctggtaaggtttatacagaacttcctagagaaggaaacaacaatgcccaggaaccgttattggaggaagccggtaaaatcacctgtaccggccaagaagtttgagcagtcggctcagaagaagccgtcttctgcaccgaaatcaaagaaggtgtggaaagagaagctgaagacgcccgctccatcacatccggagacgggttgaaaatccatgaactgaatcgaaaggaggtgcggtcttgcacatcggactttaaatgatgcgaccttcgccaaaaggtaaagtggtatgtatctgcatatttgttttcaacatttgaatttttgcatcaccacatgtttgaatttcaaaattgcatttagggtttttgaattttgaggaagttcttcaaatgaaaatttttagagcaaactaaaataaatttttcaacgaaaattcactgtgccacgaccgcactaaccgttggattccaacggccgaaagaggggccggttgggcccaccaggtgttcggccgaaccaaccggccaggcaacggttacctgctatttttggtagggtaacggctagtgggtccgacatgtcatttctgaccgttgtgggtaccctataaaagccagccggccgagagagggaattccaccccatttcaacacattttcattccctctccaaagtttgctctcaagttcattcaagctttgatatttttcctcaagttcaaatcatttagttacatatatacaagttgctttggtgaaactaaccggcgggtgaaactcttatcatttctaacccccgccgagttagcccgttcttgctccattgtgcattatgaggaggcgactgtgtcgtctgttcaaggggtcgggctctccatcaagtcgtcatgacgagtctagcactcgctcatcagctgatgtctcgatggaagactctaacgctccgcgacaactcctgagcgacgctgacctcgaccttgccagtgatcgggagagacaggcctactacatgctgagcaaccgggagtatgctcatacgcgaaaacactcaccggagttgctaaaatagataggtatggatgttgaatttcgttctatttggaaagctgttggttggcagagatttgctgtggtagatgagcccggttctcgtttgcttactttgcaatttctgtgcaccttgaaagaaatggaagatggtatttcttttcgctttttccgtaaggagttcatgctcacgattactgtaaaatcgatctccagaaggaatttatgggttcgagaaaaataggttttgggaagatatttctggtgctccaatttgcaagaaacctagaacaaatgatatccataatcctacacttaggctcatgcacaaatggattgctatgactttgtttcctataagtgatctgagacccattaggagagatgaattaattatcatgtttaccatggttagaaagatcaaaatttctcctgtcaaatgtatgataagacaatggttagaaagtataaagttctctgctcctgttgaatgcacttctctgattactcggatagcaaaagggctaggggtcgttagtgaccaaattgcttttatctcagccgctcgtccgcgtattgatgaggcttatctagtgcaagggcatattttgaaacatggagtagatggatctttgatatactttttccccggttgtacaaatgaaatcccgttgccaaatgcggggtatcatttgtacaactgccatgaactaaccattcccctgcagaccatagaagaatctcgtgcaggtggaacatacaaggagacgtacaacatgacaaggaacgaacaaggaagttcatcatcctc

SEQ ID NO: 41654 - DNA, 5720 bp, Oryza sativa
cctcccagatcaagtggtgtgcctccatctccaagtgaatggcgctcaagttcctctcgttgggaccttgggtgaaattacttggagaatggacacccttaatgtgcagacgggggagatccagtacaatctcacggaacacatatctcaaacgcaagaaatggcaacaatctgctgatgctcacatcaataacatgatgcagcaacaacatgatgaccttcaggcgtactttcgatttcaggggttcaagccttatcaaggaccctgagcgaaagccaaacttggggggagatacctctcccctcactgaggtaacttgtatcacattgcatatttccctttccaattgcatatttgctttccaattgcatcttataaaacttgaaaacaacataaaaatttgcaaaatagaaaataccaaaaagataggataggtttgtgtcatgctaggtaagacaagctagttctctttgttgaaatgatgaatagttgctctgttttatatctctgatgtatgggttcttggtaaatactctctcaaggattaaatataagtagccactaattatccggaaacctgaggtaaatgggctgcacttgctgatctaagtctagattgttgcgagatatgagatagtaaatatgagtagttatgatcctgatactagtttgacttgaattccggatgttttttttttcaaaatgataaattgaaagttcctcatttgatataaattcctaccagagcccaaaaaaaatgtgctatcatgattaaagcatatacattttggttgcttgccattccactgaactttgtcaaactcttgtgacttgtgtagatacttctcaagctctatgatcaagatcatacacccacatatatgcacatgctaaactcctacactgggagcgaagcaatattccattccatttccatatttccactaaaataaattatccatgctttcatgtgatttcttctcctaaaaagaaaaaaaatccttttgaaaaaaaaagagaggagggaaaggcatggttatgaaaaaaaaataaagttatgctccatcaagcatgagcatgatgttgaaaaataaagttgcggggtacttcagacatttcgcagcagttacaaccgtcatacctgcctataaaaggacttcaccttctcacttcactcacacacctcaagcaagagctctctcatctctctcaagtttagtttagtagtatctagctggtggaatagaattagaataggaatcaggagtccggaagtcttcggaagagttcgggtatggctctagcagctttccattcctcttttgtaagctttgtacttttattaaaatactcttctatatacatttatgatattgaaatactttccgagtatatgagtacctactttacattatgttcttgttaaactgaatgtacggctagcttatctgggagatgctttggtgcgggtatagtgtttgcttatgcaattactctatgtcatgacgatgatattagagtagtatctggtagtttagacgtggtgtctagattacgggatatcattatttggggttatatattgcggatgagaggtgagccgctgatggtgacagctcagtacgggtattcctccgcgtctatatataatcctaagttaatttcctgggaagggtattcctccgtatttagccctggttggatggtcatgatgggttgtcgtaaggaactcggtagtcaggggtggcttctcgaagtactaggagggcatcggatagagggtattagctagtatatcagttaactagaatgtatgtatactatgtatattagaagtataggaatagatttcctttctcttttcttttcacctagcttagataaattattatgaggatgagtagaaatgcttgtgtgtcactctacccttggattatcttaaccccttcttagaatatgattatcacaagtatatataaattattagttaagttctctctacgtgatcttcccatgggataaaataaatacgatacccttggaatactctcgggtgaaatgctacaatggtatatccgtgcgcttgtggatgaactctgtaaccataatataccagaagtatttctgcgccattgctgggcattatgtttctagtaatgtcattaagaaataccaacagataacttagccaatctaatctagtaaagcgttttagccgatactggcataaaccctaaagcgaaacttagtcgatacatgtaaatagaactaccaaacaactagattaactaagatatatatgatagataggtgcttacattgacaagatcagagtgtcgaagccctagccctaccgatgcaaacaaccatgacaagtataaacttgttgaaaaagtagaaaagtaaaaggggtggcgatgcgccgaagtttattgatctgtggagatagtttacaatgacccaggtgtatatatttatacccatgggtagatactagtccttcttggacaagaaagaaacttacctaaagataaaaaaggaaaacataaagtccttatggggcactaaacacattttcctaaagataaaaggaaacaaacagactcttcctaattaatagataaattgacatgccgcatcctcctttaactcggtcacttctagataagctttttttaattgattaatttccttaaccgaatatagaaagaatgcgactattggcgacttgataattctcatcggccgattccaaaactctgaagctgatactgactctaggccaataatgacttcggggcttaccaaatttcactgctaacatgactaggccgatgatgtcttcggggcttaccaaatttcactgttaacaagatcaaacaaacgaaacatggtgaatgtgtatcgggggttcagattttactatggatcaggttgacgaggagcagcggacatcccaggaacaacgctcagtaccggacgttatcgtcagcacgcagccctcaagcatagaggaagacaagccgttgtagtagaccaatcagcgatcacgtgaagcgcttaccaagaaccttattggtaccttcttccggggcaggacgtcaagggcgatgggtcgggagatctcctctcctgatcacaggtacacatcggcaagaggaacggagtagactacgagtggtgacataatacagagaaggaggcaaaccctagattggttttcgcgtatattgcgaggaggcggtggctcggtttatgtacaacatataacaggacgcgtgatcaggatgtctacatgatctccaaaacatgtaaccgaaccgaataattcgcgtgtaacttatctggactccacgccgctccatgcatcatattatttggtgcatttccaaaaacaaacaccgaattttacagcaaaaggaagccacgtccacgcaaggatgaggaaccaatttggtggaccattcacacgcagccctgtcatgtgaggcgagcaagggcgcacgtatttctctagttctctccaccacacatacctcaagtggttacgagagcactctcccttttaaggagatatctcttctagaatgaacgtacgtcctcgtgcatgcctttccatgatatgggcttctatgattgaattaaactacaaatgagctaagaccaatctattaattccaacatattctgatcacattcgatttgaccacattaggatattatataattttgttcattccaagtttcaaacttcacagtgaaacgaaattatgatatctatgctttaatttatttcattttaatgtcataaatactactttctgttttaaaatataatatgatgatttctagaatacaaataatgtaccacaatataaacattactgcactgatatccatgactcttatcatttcaatgattctacaaccaatcagatgcttgcaaaggcaattgatcgaagcaattcaaaatttaaaaattgacaactgaatgactttttgacctaacattagtatttgctaaataatgtagaaatttttatattttggaatggagaaagtagttaatttgcccatgtgttactacgaaatcttaaaaaagaaaaacctttggtattcattttaatgcctaaaactaagtactactaaatgaatgggtgaatccctatgatgggcgaagtgaatccatgcaatggtagccagctgaggtcacaaggtggtcatgggaactgcaacggatccgccggtctctcgcagctgcaattgcatatgctttagacacagatcatcacgagcgtgggcgtgccaacgatcagccacgcgctcgtccgccgtctttggcatatgcaaaggcccatttgggatgttaggcttcttagtccaactattcacaagatgccgaagagggctgaatttactcatttgggctaggagggcgcaattgcatgtgcatctatcatcggcagaaacaagaagtcaatatttactccctcaactattggcagaatatgctttgccatcactcaaccataaaaccagatatatcgcctaccccaactatcaaactggttcatttcacctctctatgtggtttgtgttacatgatgcttgcgttgtattacaatatatggttctgatgtggcgttacagtatatggtactgatgtggcattgcaacacgacccaccgatcagcaggtccaaagagataagggaggcaaaatatattttgtttcagccatataagacacagcgcaaagagaggaggtaaatatacatattccaaccatgcaaggcacggcctgaagagatgagggatgcaatgtaaacttattcaaggatgagcacgacgggctgtttgtgccttcgggtcggcatgacatggtatggcccgagtcttattggatcgtacctgggccgtaggcgcaacctgtgggcgagcacggcataacacaacgagttggtcagggcgtgccttggttggcagcccatttggccattttatgggtgcatggatgatggattcttttgtgttggtgcattaataggctatgagaaggcatgcgatagggcaggagctcgatgagagcatcgccagtgcaggacctcgatgaggcttaaggaggtggataaggaataaaggacggagattgacatcatgctcactatctccccccccccccccccaccctcacggataggtcgatacgagggagctcctccacacaccagcaggatgggggcgaaaaggaagaggatgccagcctctgaccttggaggtcgcttgacggcttgccgcgaatgccaggctttgaccttcgagccttcgaggttacttgggggggcctgccacctacagtggcgaagctatatagtgtttgggggaggagtggggggggggggtgcacatgaacccccaaactcctaatttctcacttaaaaagactagaatatatagtattgtacttaaattttctagattctcaatggtagcgtacccaagggagagatgtggataaagaagatgaagacatagccagttatatgtatctcatatcttatttatttatttaataactaggcaaccacgtagacgtcatgtcagctaaaaccacctctaaattagccgatgtaattattttatattggttttaatacttaatgaagatgatatatacaattttatgactaaagattacaaattatattttgccaatagtt

SEQ ID NO: 41655 - DNA, 8272 bp, Oryza sativa
ttatgatcgtcagctaaaaccacctgtaaaacaggcgaggtaattactttacactgattttaatacttaatgaagatgaagatgaagatgatatatacaattttacaattaaagggtaaaatcatattcgggtaatggttgtgggagttaaaatgcaccttttccatcggcgctcataaaatatcctgagtgctgctatacatacgaacttctgtctacgatgtttgtacgatgaaacacccttctctctctctgcatcagaacgagacaagaagactgacatgctccataagtccacgttagccgtccgtttgatcgtaggaagatcgtactcaaacgtatagcaatttccataaaatatcttgtctagcccaaattgtctttgacgtactaccagtcttacctctgctccggataaccagccaaaagctcttcaaacgcagtggcaaaagactaaaaacacttggacaatccaacaatgcatccggtagtactactagaatgggaatgtcgcgtcatttaattggttttcaacatcaccgcaaatcagaaatcaggagacaacaaaataaagggagcgctaatagcagaaaacaaaccccaactttacaacacttatggcacataaacgcatagcgagaacacacattaagggtagacttatgttgcatatcattgaaaaaaacacgctgcctaagaaaactgataagacgtccaacacttgcattacgagaatattaggggtgaaggttaaacaaatcaaccagttctgtattgaaaacatatgtgaagttgtaaaggtacggaagaaaatgccaaatagaaaaagtctatccgttgcaatttgtttacagcttcaacacttcctgtaaaagagagtataaaagaagttacaggagtgttgaaaatgggcatcaatggtccatcatttgatcagtgccagtacttaaaaaattacagacgtaaaaggagaacttagaaacctgaacagcagacatacttcaattgaagctaatttaagagagcactcaccttaagcttgctgttgcttcttctcaagaatcttcttccagcgcttttgatcgagcatcattgtcatgtcttgccagctgatataaataagtcaatgggcaggaaatatgtcaaccaacttgaattgcacaatgaatcaactgagtgatatgagcacatatggatgcacaatggccaggtttccatagattaacatatgactggcatgatcacatgggaaaaaacaaaaacaactgttccaaaaagtatgctaaaataatcaactggtgaatatatatgatactaaattaagatgctcaacaatgtaaaacatgaaaaataatagcattctagttcataatccatggccacacgtgcattttcagcctaaaatgtgtgaggtttcatagaatacttatgccttataacccaaacctgaacagactcaagtaatgctttatactccatccgttccaaaatataaggcacaaccacccttaacccaaagatcaagaaataattattatcatctcatagtttggatcaccctaataaatataatgcatgcatccaatagaattagagatcttgagggtggaggacttaaaaaagcaataatttaatggagaagaggtcctaattaattgtatgcatgcatgcatgccttatattatggaacataaaaaaaagtagttgtgccttatattatggaacggaggaagtacatgagaaacaaatggtaggagtttgtttgaaatcatgtgaccaataagtatataaataaccatgttagagtcacgtagagattacagaagtcatttaacttattgacatatttttaactttttagtgtaaaatggtcaagtaatgccaagttaattgaccaccttaacagtggagtacccacgaacatatgtacctccttaaaaaaggtgaatctacattctagatatcccctcatgcatccttggccaagacatcattgacgtgaactgatttgatctgtcaagtcagccaggccaggtcaacaagtttcggctaagatgcgaatcacgtctcacagccctgaattcccagctaggtgcaactagtcaattgaccaattccgacttcccaaacattggttggaccggcacactagctaaggtagatggccaggctccaaccacaacatgggagtaagagaccacaggaagaaaaaagttattcacacattgtgaacatctgaatataaattaccctcgtgacctctgtggacgcatcaaaaaatagtggatatttcaccgacttgtagactaatagaaggaaaatgttattccttagctatacagaaatttaataggaaatatgctatctgaattattcacttaatagttgttttaagtggcattatgacaatgcacttgggcccacaaatttgaaacatgacatgctaatcttaactatgaagttatcataattgcctgctatggctaacgtctgctagctactgttaaaatgctacacaccgcaatgcttgactgatgcactcttctctatgttacccgaagccaatccacctcacattgttataccagcaaagaaaagccaaccctggtaatgtcactacttctcaattggatttacagaagtgttatgcccatgttaccctgctgtcaagtcataaagttgagtcaaggtacccctggactgacttggcaacttggtcgactagtccacgacgacgactcggtcgtgtgaaaacaggggattcacttatcacctttactactattatactgtactaagcactatgtgttgtataaactatggactattgagtagccagcaagacaattgagttaacaagaaataaaactaaagtactaaacaaaatgtgccaattagcatggtaaattgatgatttgctatgactaatcacgactaatcgcacaacttgctatttggtcgagtcgtagccctctagtcgtgtggcttgaccaactttacaactaatctatgactaaccaggcaacttgattatgcacgtcacaaacatgtgtaataattcaagtgttactcagatcacaacagtgaaggttgttgatgggggtggtggaggaacgcgactaatgccctccagttctgatgtaattggttggccagttaggtcacactgtgacataaatcactaaaagtgtgggaggaccaaacagtaccatctacaagagtttataaaaacaatgttcaaaccggaagaaatcataaatttgatcccaaagatggaccctttaatcagtagattgaactgaatttcagctagtgaagatcatatttactcgtaaaaatatcacatataacacaccaccaacacaaacaccttatgttgatatatgcacgggatcaaataagcacagggcatttaataatggctgaggctctatctgttcgcaacagcttactcaatactaaagagttttgcagaagcttcataatttatatattgtgggtataaaaacaaactttttgtcaaagaaaacactgctgagcagaacccaataaacatttggtaattattaagaggttccaatacatatactcttaatacttaaatttattcaaatgcactgtgttccttgattcacattaacttaattgctttcctttcctgtgcatcttcaattcagaatgaatttattttttccttgaatacacaaaagaattgcacgccatctcattaagagaagttacaaaggaagaggaacacatccaaaaacaatcacgccacgcttaaaaactaaaaaaaggatcaaaccaacaccacaaggttggactaggtgcctattgctagtgaccgaacaaggaactcacgaagcgcagaggcaacaagcccagcaccacaggctgctctcttccacagtagaacctgaacattggggcttgccccctcgaatacacattcattacagtgattccatattttccagcttactagaatgatcatggagttgagccccttattttggtcttcaggaacacgtctagtagcaccaccagttagagagaagcgcggtagacttagggccttttgggggagattaagattccgagaagctgctgctgagaagctagctggtgagaatctagagaagctgggaaagcttctagttcattttgtagattctacaattacagatctcagaatctgggtaaaaagttggactgtttggggggagcttctggcaactgaagattctaggagaagctgcagctgctagaagctcccccaaacaggcccttaggcttcgttcggcagtgagcttttccagcttataccccacgttttccacgcgcactgctaaatggtattgttttttgcaaaaaaaaacatctatatgaaagttacttaaaaaaatcatactaatccatttttttagtttttttaaagctaatacttaattaatcatgcgctataagttgctctgttttgcgtgcataggggattagttcccaacaagctttgccgaacacagccttaggcatggaaaccaacaaattcagaatgaatttatattagggcaatctactgtagtatatctctttccatacaaaaaatgaggtcgaacagaacaaaaacacatggcacatttataccgaccaaacaataattatggagccccatcctggaaactagaacaagaaagcataagcatttgatttcatatgttggagctccaaaatttaagtgccagattttatattattgagttgtgaacacaagagttgaacaattttcttagtagtttttaacagaggaaaaaaaacaataaggctcaactatgtagtatattccattattccttaccatatttcataatcatctattgctgttatcttggggtaattttactacatgcattttgattttagcactgtttggttcctgaaacttttccctgtgttgtgtttacattaagaaatataatgggggtaaacaggaagcagggaaaaacattgtttgtcacctcattcatgtgattgccatatttatacccatgatccaattttacgctttgcacgcatctgtaataacggttatctgctagcaactagcatgccaagcaagttacgtaatctgggttaatcatttattaagaaaagaataatgtatgattatatatctaaataaactttcattcttcatttgctagctatatcagcatgatttatgcatcacatgtacagcagtagttgtttttcacctccaaaaccttttttaaaaaagataattcacttaaaaaacatattagctcctaatgcatatgcttttgcaattaaaagaagtccataatttctattatttgatcaattgcttagattgatgttgagcatcttgaaatttggattaaaattccttttggttgaagtcaactaaatagttgcatatgtgctgccacaatgtttcatctagtaatgacagatttcctaggtccattgcactacattaggtagcacaaaattaggtcacatagcaagaacatgcatgggaacaactttcaccaaattaaactatatacttgtccatgtaacctttaaagaaagttcactttaagacacaattgcatcaatcacaaccaaccttttgcaaacgtgatattgcatccaataaagattgaaatacacagttgacatccacaatagggcaggaaaacgatttagtggcaatggctaggcaaagcaaaccataatgtatgccacttatagtgaccttcccatagcacacgatagtacacacacgttgccagaatagaaggtagtttacaagataaagattgaatggatttatttattactcatgcattggatgagaagaagaaatttcagggaaatttttgtcttggatggaaggttttgctatggatgaggaataccaccaaaaaaaataaaaaatctactattccctgtacaaatatacctaactggacaaacacctagatccaatacgatgcatccacgaggggtatcaagcacgcaaagggaaattatctatctacacacacacagtagcacccatctagggagtacatggcaatcaatcgaaagaagacgataaaattcagatgaatcaagacgtcggagggggaggagcgggggatggaggagttggaagagcttactagtgggggagggacttgatgttggaggcgagggcggaggcgtggtggtggacgcaggcggcggcgccgagggcgaaggcgccggtccaggtggtgaccagccgctgcgggtcggagtgcggcaccccggagtcgcccctgtacgcccgcgcccagtagtcgtcgaactcgcccatcctcctcaccggaaaacctcggcctctctctctctcttctcctcctccggccggcggcgctaactccgggaagggattgggttaccacgcttcaggagaggatgtcctctcctatagacctgtggacttggtctatggaagatcgccttgggcccacgagaacgtccccgagcccgggcctcatgctcatgggcccattgggcccatgtggatatggctgaatagtgaatatatctatttgatttttgaaaagactagctaaatacacatgctttgctatggataaaatgcattttttgcgaaatgttctacccattgttctgctatggaaaatattcaccttgatttgattatatagatcgctatccatttagattgattattagttttataatgggagtagttggggtggtagatttaccgtcaccaccaccagagccttttaaagtagtacagattttgaatagggtttacaagtcgagtaggaattcatactagagagattttcttcaagcaaaagttttaaatacagataattttcctagagaagggtttcaattttcacatgagagttttgaatatataatggtttattagtttaaattgatttttctatttgtatttttttccaaaatattttcattcccagtttatagtgaaattcatctgtagatgttttactttagaacctcctatttaaaaaaagcgggaaactcatcttcaaaattcatgctaaaaggaaagttagtaatatgaattcaaaccctaatcaagaaaataatattaattcttgaacttgaatttaatcactgacatgttaccaacatactcccttcatatgatattataaggtgttttgatttttttctaagtcaaacttacttaagtccatctatgtttatagaaaaacgtagcaatatctacaatatcaaattagtctatttaaatatatcattgaatatattttttatactatctttgttatgtgttgaaaatgttgtggcattttctctataaacatggtcaaaacttaaaaaaagtttaataataaaaaagggtagaacattttataatataaaacaaagggagagggagtactttgattcctcgtcttacctttgtaaaccatgagccaccattcttctgtcatccagtcatcctctttagctatcatccagtcatcctctttagcgacattgactatgctagaattgtatttgggcttttggcccatacggagagtagttaaaataaaattctcaaaggtccaccttgtgggaggtatgcatgtgaacttcggtattacctttctagttcaaagatagtggtacaattttaaaagaggtggtgtctcctcgccacttgattaatgtgtgtggttgagaactagataacatgcactgcttgctaacctcacctcattgcgatgggggcgctcggcacttgcatggatggtgcgctaaattttgactcctagtaatggtcacaatctatctaggagtagttcggttatgagttgtggagatcatgtatgtcttgatcagatgctctgatatctttatcattttgagcttgagccaagcttcaagcaagttaacaaacctgagctaaaatttcagccatgtcaatcatgtatgccacctcgctctgctcactgcttgtgcttcgctccaccctacgcttcatttatgataggagaggaaaggtcctattgtgtggcaactgtacccaattcttttgttcgcctgctagtgacgtcatccctcttaatgagcaaacaaatcgatgttttatccctcttaatagtatgtcattcctatactcaaatgcaaatagaagggaattatgccaataggaaaaccgtcatgtcatcttctatatatgtcttgagcaaggttttaaatagcgggctaaggctcttagcggttg

SEQ ID NO: 41656 - DNA, 17359 bp, Oryza sativa
tgcagcccagacagggcaatgaaacgtgtaggcgatggaaggggaactgtggaagtccaacaaacacgggggccacatcttaatgaattggagcagatgcagatcgagatagtagagccctagagattaatttgtggcagagggggggggggggggagttcgatcgtatcctggggaatcaatgatggccatcaatacctaccgtgccaggcccggccaggccaacaccacaccccctgtggcaggcgagacacacgcatgctttccccctgcaccccggccggccggagctccgccgggccaccatccaccacaaagtacctagttattgcaaccccccaccgacgccattataatggccgcagctgcagcagaccgcgctacctttggctttgcacatatatcacggtatgatcgtcgatcgatatctgcgtgcatatgcatatggatggaggagagagatggacggaccggggctggagtccctggacccaaccaccggccggcatggcaccatgcaggtatgcatgcagcaattaagccaaccacctctcctttatcatcttcatcatggatgcacggccggcacccaattcaattcggtcgtagctagcatagcagctcaccccctctcttgcattaccattctactcgaatacccaataaaggtggtgtttgaatcttttaaagataagcattaaatgtttcacgcaaaaaaaattaaattgagtttaaatttttcgcacgaaacatgccatttagcagcttaaaaagcgtgtcatttattaagggtttcacccattgttcccaagatatactgggcgcacggaaaacagaacggtccattagcgcatgattaattaattatttactaattttgttataaaaatggatcattatgatttttttaaagcaactttcgtatagaaacttttttaaaaaatacaccgtttagcagtttgaaaagcgtactcgtgaaaaagcgagaagtggtagttgggaacacaaggtttcgaacgcagcctcagatgcataaatactataaatatatccatcctcatttgaaaaaaagaagtagaaaatgaaatatgctcaagacttttggattgagcgagtactaatttgtctagcaacctctagaaataaactctctagagcaggtacaatagcaggctataagctagctataaccacataacaagaagaaaagagaagagagagaaaaaagagggctactaatttatagccagctgtaacacggaccccaagacgttatgtgtgtatgagaggtgggatcggatattaatggtgtagtatatttttatagttaactcttgtatgaataggctacttcctccgttttataatgtaagactttctagcatcactactagaaaaagtatttttccaagcggccaaaagtgatttttgcaggtggggggttggaccgcctgtagcccaacgactacgaaaatctaacagcccgcctgcgaaaatccattcagaaaaacaaacaaaaaatcacgaggccgccgccgctgccctcctccggcgtccccgcgccgggcgtcgtcatcgctgccgccccgcgccgttgtcgtcactgccgccgccaccgccccgcgccgtagttgccgccgccggcctcccccctccctcctctggccagatctgggagggagggggtgaagggaggccgccgccgcggccctgcacgtcgtcgtcgccgccaccccacgccgtcgtcgccgccgctgccccgcgccgtagccgccaccgctgcccccgccggcctcccccctccctcctccggccagatctgggagggagggggaaggggagcggaacgccgccgccgcctcgcgccgtactcgtcgccgctgtccacgccggcctccccctccctcctccggccagatctcgaagggaggggggaggggagccgccgccgccgccgccggccttccccctccctcctccggccagatcagggaggggagggagggaagggagccacgccgccccgccaccttccacgccgccccgtgccgtagccgccgtgggagaggccggccttggagaggtgaggtgaggagagggccggccgtgggtgagggaaggggtgaggttttgagacttagaaaaaatctagggctcctatccaagtctatttatattcaagtctattttcacaggcggaccactgaagtggcgcctgtgaaaatcacaggcgccgctaggaggtccgcctgtgaaaatagatttttggactggcacattcaccccgatttatatttttgtaggcggtcatttggctctaaggtatgtccgcctgtgaaaataagacccccacgtcgagaaaaatgctttttctagtagtgcatcgcccttattcatatagatgctaataaatctagacacatattagcatctatatgaatgtgggcaatgctagaaagtcttacattataaaacggatggagtattaaatcagctatagatgatttggagccaatatttggctatactgtaaacttgctcttattattagagagatttttttttgtttggggggtatataaaattatactccacttgtgtatcgtgtattcattcattcatgtagttgttttaatttacacatttatatatatgtgcttcccagcaacaaaagaggacactattaaatatgctaattcattgcttgacctggccggcggatgacatggaggtagttgacaacataatggcatatagtaaaagatttcaataaagaaattaataaaccatgcatggcatgcaataggttgcatgatatataattctaatatatatataaactgtatagaatagtatgttggggaactctacttggcaagaatttagaaactaattttgtgacaaactgcatatagcataatataatttgctctaaaaagagcagcacttactttaatatgtttatagtagaaccatgacaatagtagtagtagctttatccgtcacacattgaggtcttaaactagtagtagtagcttttatttatttggcacttgtcttaatttgatctgtttccatctgaaacttctcctgctcccagctgaaccagaattatataggacgactagcatatactctttgccggcccgttccggaacttggagagaaaaatgttttggaaacaaaatgagatcatgatgaataatctccggcagcaggcatcaacggcaccaaccgaggttgctgtagcacttccaaacaacatctccctcgattgcatcctgcccttccttttctgcccccttttgggggccaagtgaaaaaaaaggtcgcatcatggtgtggcatagaataatacttccttcgtcctaaaatgaagccatttttgatgttagcatgggtattaagaaagtaggtgagaatgattggagaaagtgtgtgattggttgaaaagagaaagtaggtgaagaagaatggttgtgattgattgagaggaggaggtaggtgaagaaatagcttcattttaggacaagacactgtgctaaaaatagctatattttaggacggagagagtagataagctagtcccgacccccctcctctcctctcttgccccgcctatataatccccaaacatcgctttctcttggagtaggagaagggtagtagtttaagctatagctctaaagacatcaccatgcaacattacttgcgttattactatacctatccaccacctacacattttgtcatctccctctctctttctctctgatctgtctcagatgtttatgcacatatacaagttaatagttctgtggatctagcaatcccggcttgtttgtttttgctgctttggtttgatgatagctagatatatcgagagggagatgaccagtaagcttggaagaggaagaaagagagctgctaggcttgttgcggtctttttgcttgggtaaaaagaggtattggcgtgcctcaatccgaaggcatggctgattacaggcacctcgaccgatctagcgcatgcagccatgtttcttggattgagccgcgtcaatatctctccttgcttccttacttcatgtactgtgtcatgctcaagcatatgtcccctctccgatcttcctacctcgtcgagttcgtcggatcagttcccaaattaaaggtgttatatatatatatatatatatatatatatatatatatatatatatatatatatatatatatatatatatagtaaatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatgtattgtgaaataaagttaaatttgagttgttttgttgataagtataggtatgaatcaaattattataactaggtatatactcacaatttgaaaattttaaaaaatttgagtgattttgtgcattagataccatggtgcccgggcaccatggtgccccatatgagtgtcctatatatatatatatatatatatatatatatatatatatatatatatgcttcatcttttctggggttcacgagtcacacagactagctgctttagaagtagtactatgtattgtgcatgatgttcacagttaaatctgcaattttttccatgctggagtgtttttataggtttgcggaaggaattaagttgaatatatatagctatataattatatatatatttatcttgcgatcctgagtcttctgacattttccatccaagttgtaggtctgatgcatggcttatttcaagatgtagtttctggtttgcttactaataacatctcttcaggtattcattaattaggaactactatactttacctactggaaggaggatttgtttaaatctataaatttgtgctggttgcatcctcaacaataagttacactgatctctctgaaccaagtacttcctctagcagataatatatgaagttagattttttttttcaaggtccaatgcatggcttaaatcataattttatattagataaatattataagatctaataagtttatgagattacaacagtacttattggtgacggtcaaaatttgaaaaaaatcttattacaaatgttaaattaatatttgtgaccggtgggagcatgtatctatcttaattatgtgttttgggatgcttttattatatttttctgcataataaaatattttttgagctcttttcattctaatccccccctccccccccccaacctgtgtgtgctcctaaaaagattgttccctcttatgataagtaatactccattatttcaaaattaaactaacgtatgccatgtaaaggaaaatagagggattatatatacggttatgcttctaacttcacacaagtttataactatactagttaggcacttcgtagtagctcacacataattagacgggaagatcttggatgaattgtattgttatggctgtagatttgcatttaacatcgttctgcatattaaaaacccaactgttctgaatgttgggtaatttagagctcatctattataagctatgggcttaattatgacaagttggcatatattaactatgaactattaaaacataaaaaaaaatctgtaactgatagtctatactgaagtagaacaaaataattacaattttcaattttataaaattattaaaacaagaaaaatgatgtaattgggaccccaaaaccgcgtacaactacgtattattaacaatttttttattaaataatgccaactctataattgagtctccaaacacgaaacaattcaatttttattaatttcaaattttagactcctcgaagcccttgtagagcaaaagagctgcacgttaactcctcacactacttaaaaaaccatttttccaaacggtcggttcctatttttgcgtgtggttgagccgctcatctgccctaaaatgtctgcaaaaatcgctattttttcatgcaggtggcgcaaccgcatgcggtaatttgattttcgcgtgtgggtgcttatgtcgtcctcacgcaaaaacaaaaaaccaaaaaaaaacaaaaatctcaaaaatcaaaacatcttgccgtcgacgctcgttgtcgtcggtgctgccgcccgccgtcactgtcgccgagtatgtgtggggttaggctcctctcgtcgtcactgccagatccgtgcggagccaggtgagggacagcccccgccgagcccgtcgcctgctgtcgagccgatcgtcgtccactgccgcaagctatcgccatcaccgagttcgcgtggggccccgctccttccaccgccgctggatccgtgcgaggctaggtgggggacagccaccgtcgccaaatccgagtgggcgatgacaccaccgagcccgggcgtcgcccgctaccgagccaccagccgctacccactaccgagtcgtcgccgccgctttggaatgagagaggggaggaatgagaaatgagagagagagagagaggaggtgtgaatgagggagaggaggttggagaggaggggagataataagggacttggaaaaaattgtagtgttgagagggaaaagaaggcaagttagaattctagcggatccccttaagaggcctgcccaccaaaatatattttctcatgcggtcctttaaaagatccacatgtgaaaatatgctcatttttttatgtgagtaagttaagaggtccgcttgcgaaaattgatttttgcatacatgcattttaaggagccgtacatgacacggttaattatggtccacttgcaatttaaaggggtctcattcacaaaaatcatttgtatagtagtgtcactagctgtcgtcgttgataattcatgttttatttgtggtttctctcttttctatatatttaatatgctctatggagaactctttaattatgggaaaataagatcgatacttgaataaagatatatatagatagagagagtgagttttccattcttttaggttgacggaaggattgctatggtttttctagaactagcagaaagaccaaaatcgaaacgaatggacattagtatatacaatttggcttggtagtggtacgagttatctcttggtgtagcaagaaggaatttttttttatatttatatttatttttaaaaatatttaaaaaataaattaccattttaaagtttggcaaaaatatactcctcccgcccaccctaatagagggagagaagggcctaaatgtaaaattttctacaacacataagacgtagttttgtactaattgtaaaattctcatatgatgtcggatgaagttaaaagtttatataaaaattgtagagctcgacgatatttataactttgtagttgacaactttttcattaaaataatttatgggtcataatatttatatttatatttgtatttagccccctctcgtgggttttcactaatctgaaaattaatattgattatttcatgctttaatagttttaaatgaatgaatggctaagtacaaaattatagatctcgtcgagctctacatctttgctatagagcttgtctccatcggaggttgtttaaaatgtagatatgagaatttgtaaaaataaatctaagacattataaggaatatttggacccataagttattttaatgaaaaattaatcaactacaaagttgtagatcttgtcgagctatataattttcatgtaaactttaacttcatccgacatcatacgagaattttacaatcatacaaatacttcatgctatgtgttgcagaaaattttacatttagagggtgagaaggatttaaatgcaaatatttttgaaccccgtgctgctacatcacataaatcgctctctattagagggcgggaggaggatatttttgcaaatatttgaaacggtaatttatttttgtaaatcttttaaaaataaatataaatataaaaaagttctagcaagaagcagctgtatgggtggtgtgggtcaattgggttgggctgcaaggaggaggggttgggttggaaggggtctataatagttgaattggatacatctgatttacgcatttttacatatatcttattgaattgaattcctttttgatgaaaaaataaagagcaaccatgcttctacagtagttgtgactaggggtgaaaatggtacggaaatggacggaaaccatcttttatcggtttcgttttcatattttttttcggaatcggaatcagaaaccccggatacgaaaacggaattgaatattatcgaaaccgaaaacgaaccggcgcgaatacggtaacgaaaatttatcggaaaaaacccctcaaactgataaatccaattgtcaagtctcaacggtcaacaattcatcataaaacacaatcatataagtccaattgttaagtatcaacggtacatcacaaaacacaatctatggaataaattatctatctttaaaagagtaatgctgttgataaatcctaaatgcaggaaaaaaatattcttatgtaattttagatttgcataacaaatattttttaaaaaaataacagccaaacaccatggtattcaatattcaatgcttaagaaaaaagaatccagggtatttcagttacaaaaattccagtaattccgagaaaatttccgaaaagtttctgaccaattctggagttccgatggaaactgcccatctcattttttagtccgttaccgagaaaatattgctgaattcatttccgtttccgaaaaattctgactgatagattccgttttcaaaaataggttcggaatctagaaagttttcgtacagttttcactcctagttgtgaccatatggtgcgatcagatccggcctgcattcatcttggcgattaaggcctcgcaagaccaagcaaagtagcatgcatcccaataaaagtaaacaccaaggtgatcttgacatccggtgatttccggcgaagcggcgtactatattccggcccccatcatttgtcttttagatggaacaagccaaatggcatatttataaaaaaaaataatttgtgaataaaacttttatataggtgttctaagcgatctaaaagcaaaatctgaaaaataaacttcgatgaaaaaacgttaaaatcaatttcaaatttatggttgaaaatttaaattttggctgataagcataagcgaaaagatgaggctgtcgatacgacggcgggtttcagattgatgagtgttgataccaactgtaggaccaagcaacgtagttgagaagagttattgttccacatagtatgtggtattgaaaccttggaaactgaagcatataagtagatgatagtataaacaaactgaatataaatgttgttagaatgcattttgttggaccaaaatgctgcagtttggtgggaaggaaattggaggaaatgactgattcatgtacatcaatacaaattgatggggtagagccgtagagggatcatcagactgcaggagaatttttgggaggaggatacatggggcaagagaaataaatctactcatttattggttcaaaacataactggaaatgtaaaccgaatttattcaagaagggtacaatctatttgtgcaagtaccctatatatactacttagatagcttttcagactgaaaatgtaatagacaaccttatcagagtgcttaaattcagagcacaaatggtaaaagagaataggcaaataggcattccttccctactccttcagaaacatttttctctaaaagagaaatagcaaattgaaaattgtagtatccggaagaaagtttaccatcactaccatgcaggaacaatgtgccaatatgtatgcatactaaaatgcgccattctgctatttttcttaaattcttcatgcttcccaatttttacttgaattttcgaagcaaacttaatagttttaaagcaacaaaaaccaatttccgagtttataaaaatgataaacctaaatataatcctctccttctctttgggccgaatctgacccaaagctcttactctttcagcccgtgcaaaagcgtccacttcttatacccctccactcttctcctgaaaaaaaatgcatactaggtcccttatttttacatcggattacaaagtcatccctcaactagggtgtgtttagttcacgctaaaattggaagtttggttgaaattggagcgatgtaacagaaaagttggaagtttttatgtgcgtagaaaagttttgatgtgatggaaaagttggaatttttttttaaaaaaattacaactaaacacggtgttacaaaaccaagtcactctagatagttttgaccggttttatccgatatggcagctgagtcagcgtgagaccgatatggccagctaagtcagcgtgagacatgtaaaccccacgtgtgagagtaccctctctctcccttcctccttccccatctctctctctctcccacttttctcgtttcaagaaaatttcatctgggcaggccagccgacggggcgatcgaggcgggagaggaggaggtccggcggcgcggcaatgcgggagaaggggcaacgcggtggtggcggcagcgacgcgggagaaggggtaacgtggcggcggtggcggtggccgcgacggggcgcggaggaggaggcggggccgcctgctggagcgtgcggatgcggctccgtcgtcaccgccggctgtagagcgtcggcgcggctccgtcggccaggcgctgcaagaactagcgggagtgcgcaggaggaggagccagacgatgaggtggcggcgacgatgatgtccggacaggttggttcaaacatgaacctagacggcgagctccggaagatcaaggaccaattcgcgacatggaagaaagactacaagtctcggttgaaggagaccaaggtaaatattcagaaggttggtgaggagaaatgccggaaaagatggcgggggaagaagagctcaaagtgaatgcatttaatctaaatccgagtgcatttcgcttcattccctgctactgcatcaaagacgagacaatggaaaagactggggagtgaaaagattgcagcctcgatgttgaggttcttgtcttcctcatcacaaggctgacaagatgacgacgacgatgagctccatcgtcaatggcggtgctggtactcgtccggagttcagcttatcgaagaaaggattatatatgtgaaagcaagaagtctgtacatgcatattagttcttcgttgtcagtgcatgtatgccatcttgtatgtagagagatgaacctgagatatggaagggtaattaaatacagattatccgccatgagcgaatagagataatgtaacatcagtcctgtaatatgtgtacagtaaaaaatcatcgaatttgcaaggtgtttttactccattcctgccttgtctgcaaatatcttgtctctgtcgcaactgaagtctgcaaaaagattgttccttcagaaatctgaatgatgaactctggtgtactatattccctcttctcccatccctcgtgggtctccttctccccgttgggccgcagccgcccctagcctcctcggcccgcagccacagtggcccagctccccttcccccctcctctcccgcacgtggtctgcgtccaccctgtcggcccacgccgctcgcccctgcgcggaccagccggcccaagaaggcgacgcgtcatcgtcttcctccagccgcgcctgttcctctctcccccggccgaacccgagtgccgccaccacgcccatccacctcctcgctcgtttccacttccgattgattgcaaaaattgtttcctggcattgtggtcgtgggcattattacccccataaaatccctttcagcggagctttcaatcgtcggtttcaagtgcaacaactccaccacggccggccggccggcaagcttctccctgccgttcccgtcctcctcggcctataaggccttggtaggcacgtggggaggattttcccgggaaacgtcaccagggagggattggatggatcctctcccatcaccataatcccctctacccttccgtccagaaatttaactatttgccacttttagatttaccaattatttaaatatccttcaaaaggtttgtacttaaatttttttttgccctgcttaatttttttcccctctaagatggtggcatcttaattatttgccacttttgtctatctggcatgccaactaggggtgaaaacggtacggaaatttccgagaattccggctaccgtttccggtttgcaccgaccgtttcaatcggtatcggtaattgtcggtatcggaaatggaaacggtaatctttttcggaaatggtagcggaaatgatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctagggcaccgccgcgccatgttgggcgccgccaccaggtcgccgacgccggccgcaacctccttcgccccgacggccttcgtcgcagccggccaccttccctcccccatgctccatcgccggcttccgtgccaccgagccaagcaccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctaatgccaacaccgtgtaaaaatcgacgtgggacccacttatcaaccgcacaactctccccttcctctctctctccggtctgcttgtcggcgtgctcctctctttcccggcggcggtagtggagcgccggctcgcggttgcggaggaagagggggagtcaagcgctgctcctttctttcccggcgaagaaccatctcggcggcagcgacggcatgctggctcgcggcggcggaggtgggggagccatgggagggagagctgagtgccgccacagtcgaggatgggtgtacgcgctgtaccagacgtgcgagatcgtgctcacgtcgtttgcgccgacgatggttgccgtcctcgccgaacgcttgcctgcctccctcgccagcaagccatggaaggaggagggggagccgagtgctgccgcgagtctgacctccgcctcgccgtgctcagccgcaatcacggcctccaatcggccgatgtggcctccctccctcgccggccatccaccgacgacgctgacggctccgcatatctggtcgacccgtccccgccgccaacgactccatcccccgcggttctgagcttgccgcgctcttggcgaatcgcgcggcgaagcgaaggtcggactcccggcagggcttggctcccccctcctcctccgcaatcgtgagccagcacgccgccgccgtcgccgggaaagagaggagcagcgccggcaaccgatgggcagaccggagagcgagaggaatgggagagttgtgtggctgacaaatgggtcccacgttgatttttgaactgtgttgccatataggcataccacataggcaaaagtggcaaatagttaagatgccactaccttagagggacaaaaaaaaaagagcaaatctaataagagtatttggataattgacaaatctaaaagtgacaaatagttaaatttcccgattacaaatggcagggaaagctaatgtttgcttcagacttcaaacttaggccaaacaacattcaacactgctacttaatcttcatatcatagaaagtgccatgataactagaaaacatatagtcttgaaatttaaaaatagctttaccgaaaatttgaaatatcgtaaataaaaaagtaaaacttccggagaaaaataagaaaaatctgaagactgcctcaaaagattctaaaaattctcaataccacataaaaagatctaaaaattgcttgatataagggagagtgtcgaaaaaaatcaatgtactgaactggaaaactaaaacattataagggttactttgcatctttgttacttgcatacattgccaacctgacgcgctcacgtggcattcacgttggcataaataatatgtgacatgtttttttaccagatttgcaccctcaaacaaattaaatgattaatttgagcaatttataaaatgagtgactaaactacacccatcttacaagttgtcgtaaatgtgggtgtattttcctaaaaataattataattccaaggtgagctgctaacaaaatgtcaatcaaaatgtcaatggagaccaatcattcacccattcgcaacacctgatttactcatttttaacatcatatccatcagcacgatcaactaggataagtacactgaagactaattacattgcatacaaacagaaactaagagttccaaaaatccaaattctccataagtgcaagaacaaaagcacattactgcaaggctattagtagctccattacctgcgagagggagaaatgcattattggcagtgctctgcattgggcactaatccacgctatgaatagttagccttcaagcaaggaaaataaggctgcaagagttacagaaccaattttggcatgcaaatccactatcacgcacatgtccagactgaaattaccggagctaatggttaaagattaatcagtaactttctgaagttattagatgtatgtcgtacctcattgtgcacatgtatgatctaggactaaatatcacaagaagttgaagtcagtactgcagaagtgcatatcattagcacaacaaatcaacaatatgagtacaaaggactatctaaatgtagaccgcacctttctacgctaacatatagagagcaattgatttatgccctagtataaattccgaacagggcatgtcagtcctcactcaagtctgtttcctcttttgaatgtgaggtgagtaaaatgcatagctctcaaaaatgaaatagcttacaaaaatcaagcaaattttagaactttctatgtggtattcagaattttcagaatctttttaggcagtctacagaatttcttattttctccagaatttttttattagctcataatgattaattcatttactgaaaacagggcatggcagtagcaattgattgaggccatgtcctgtttggacttttctctatatgtttgtaaaattatgaactcttttcagtaaatgaattaatcaagaacacacagaaacgtttttttgagcttccatttttatgaaaacaacattatctacaatttttttttatgaaaacaaagacaatcagttttcatttggatgtttagcagcaaacataatagagaaaattctatttatgcacttataaaaattccaaacagaacatggcctcattcaaacctgcttcctcttttgaaggtaagtgagtaaaatatagctataaaacatgaaatttcttttaaaagattcaagttctttaatatttttttctgactttactaactcaattggacctttgaaaggtaaggtgtaatctgttatatgaacgcaaacaaacttgattgcattttgcgccctagtgcaattcaactacaagcaatcaccaaaaattataaccttaactcacccataatacacacatactgcttggtgaatggaataaaaaatagaagcagtagctgattcacgaggaacaaattaagcagccaccttaccaatagaaacgagcttggcagctaagtgagctaggttggcgaacaagcccttcggcctctggatcccccgaactgcttcaactagacagaagagaagatcatgtgagaagacgagagcggcagggacaaaccaccaactgcttcaacaagcaatgatgtaacagcagtaaatcttttttaaaaataatgaatttaaacatatttccaacttattttcaaacttgaaatgcaatgcttggataataaaatttgtgcatggtttgtttatttatacacttctaaaaattctaggcatgattacgattaaatcttcatttataatatctcatcacttttctttctataaagctaatgtccactaaacacctaaagctcaacatgcaagcatatagtaattatatctacaatttatttcattttaaaactaaacatatacatgctaaatcatcattttcaaacaattttcataatatttcaatccaaatattttcatcatttctctattatctaaaatatatcccgcaacaaagcatagggcatcatctagtttatattaactcttctgtccacacgaacagcaacgaggagagga

SEQ ID NO: 41657 - DNA, 6553 bp, Oryza sativa
tgggctctcgtgccccacaagcacacctcctcgctctctctctctatttctatctctctctatctctttctctctctctctccaccatgaccacgagctccggcaacccctccccttcgaccggaggaaacgcagcaccccggcgctgccacccttggtgttgcagccacctcctgttccccaggctccccttcgtcgagcccaaaacaagctagaaaaccgttctcgccagtgaccagtggtgatgccatcgccttcctcctccggcaacctttcccgactcaccgaagcattgtcccgctgcatcgtcgtcgccgtcaattacgcctcgtcgatctcttccttgagcatgcctccatatcaagttattgtgtgtattcaattcctatgagcaattcagattacctttttttttatcttgttcttacttgtttatttgatttgcttgcagtcataaggttgatttgcaccagcaagatcaacaacccacggagtggtgtatcgatcgctaaggcacaacacaatagcgtctcgtacggttgtagtaagttctcccaaattagagttatcatcaactccccgaaagatcaggccaatcatagccgtgagtgtattgagtgcagctcagggtttatcaagacctcaggaacaccatcccctcctttgagcacgtcgttcgatgaagttgcgtcgccctcaccgactcgaagaatgttcttatctctgcttttaccatggaccatctcggggaacccagtccttggtgaactacctgttttacccatgggtctcgacaatcagttgctcggtcctttctctcctcgagcgctgatgtattacacataatttaatagtacaataatgattaaataatttggaagtctccatttaaattatagctaaattttggatggtcgtatcttggccatacgaggtccaaattgacccgtttaaattgcttaattttttataacttaaagggcccaaaaatgttatttttatgtaatgtgatcatttctttcttagagttttagtcttgttttgttattggtgtagttgctatcattttagaggttcccatctcgcaatttaggtccatcgtttgtggcagcagaaaactgttcgttgactaaggtcagtcacgctctccttgagcatattgaaacataatttgcgaaatgtattttgacttaaattattacattcgctttattaaatttgttgtgttataactattttgttgtcgagagatcgtagccgatgccccaacttgaaataagaactcgtcgaaaagtaaaagaaaagggtggcgatacgctgaaagttgtattgattggattgtctcccctattacaatggtctggggtttatatttttaccccgagtacaaaacttgtccattatggacacgactcaagctttcctaaagataaaatacaaacaagtccataccatggactcttaccatatctctaactcaaaccgatataaatatcctaattaatagatacaattgccttaaatgagctctatctctaaacgacaatgacggtcatctcaatcgaggcccaaaccgagcccaagtcaggctagtcggctacttgtcaaatcggtaaatcagactccaactctatttccaaccgatgcaatgcccaaccgatgcgtaatccatatttggaaagatccaatcttctttgattccccttcaattccaactcgaaatccgagtctatcttgccaaatttcgctgttaacacctgttggtatttcttaacaatattcctagaaatatgaatgtgtagcaatgacgttagaaatggtcttggtatatatatggtttacagaaaggatccacaagcgcacggatataccattgtagcatttcgcccgaaagtattatataggtatcgtatttatttaatcccaaaggaagagtgtagtatatatatatatatatatatatatatatatatatatatatatatatacatgccacttacataatcaaagtctaagtaggggttaagatatttatttgggtagagtgacacgaagcaaagcactcatatatctcatttaatcatttctaaactaagcataagaagaaatagaaaaacaatcatttcctataattctaatatacactcaattttagtctacatctgttagtatacaaccatatagccaatacccctaatagtgcactcctggtgcttcgagagaccaccccggattgccgagtttcttacgacaacctgtcatggccgtccatccgggggctaaatacggaggaataccctccccaggaaagttttttaggatcgtactgagctgtcaccatcagcggcccacctcgactgactcgtagcatataaacacagataatgatacctaataatctagacaccatgtgtacattataaatactacactatatccctcaagatgacatagagcaactgaataatcagacattaaacccacacaactgcacctctctggtaggctaactatacgactgtaccgatacagacataaagtaaagacaatacttagataaactaaagtatcgagagcatatgaagaagaatatttcattaattccaaaagtcttacaaaagaaaggaagaatgctattacaaccttaccgaaattcctccgaagactccgagaactccgagatgctattctattctactccacttagcactagaatactaaactaaagtgtagaagagatatttgagcttgcttgagtgtgttgagagagtgaatgagctcctccttttatagggttgttatgacggttgtagcctatgcgaaatgaccaatatgcctgcaaccatcattggggagcgatcaagagcgtccaggtgtaaggccagccagagccagcgtcaccagggttcgcagcaggcctccaaacttccctatgtggttgacaggtgggtccctatggcggttgtgacagttatgacggtttccgggacggttacacacgacaaagtgggcccatcttatccataggcttgcttaggagtgaggttttctcattttctctttattttatttgctcaattcctacactcaaataaagtccaagtacaagtggaaatagattattctaaaacaaaatatgcattgcaagcatagctagttctcctttattttagaaaattgatggtcaaaattggtttataatgaccgtcaacaacaccgaccttcaagcctctgctgcaaagcgcattccgtacaaccacctatctaatgggtaaggcttaatgcatcgattagtataataataaacaaaaaagatacgtatagaggcggatgaggtcctagtatgggaagaagatttacatacttccaagagttccctaggggatgtgatccaaattacattggtctaaaacaaaagaaagaaacgacaagacaacaatcttcctctttggtctccagctccgacacctactcccccgctcgaaggaggcaactttaacggttgcctccacaacagctacgcgcacaatggcttcactcggggacctcatcctgcacaacttccaagaaaaaggttcatgtcgcgggcgtgctacgatgccaggatatactcgaccaccttgaggacgccacctcatgtacatgagcaggcagcccgacaagccgttcttatggcggtcagctccatgatgcggtggctgattgagccaatgtccatggtagaacaacgcatgtgccctaggtaggcttagtgaagtgccaaagcatgacgcgtcgttttgcatcaagtactgaatcgacatgtttttcacaaaccacccaataatcaaagaccacgtctaatcatggcaaaccttctggaagccataagcggtttgaaggagggagaaattaaagcagagccctgtcacgtcacctgggggccgcaggtggcccacaccatgctgtgttcccttgcttccgaaggaagccccatggcagacctcggctcggtgacgaggccagggggctactgtcgaagaatactcggggcacattaggacccatcatggctactatgtgccctccatggagtgccacatgactaccccgaactccaaaggtatgacgcccgtgtgtgttagcctggaggtagccctgaggtaggaaggatgccctaaagatagtgtcagctccgacgttctttgaccggtagttaatgggctaggaccccgaggtcatcctcggggctagaggcctatatcagctacgccacaacaattaaggaggtatgacctgaccatacacgctcccttactgtgtcattctgcattaatgacaaatggtgtggctgctgtggagaattgtgggccgtcgtggacgatagggcgtacctccctccacttgccaatgccacccctggataagtggtgacagtgtggcttcgtactatgctacatgtctcgcccgccggttaatgaccccctagccagcctcaaaggctaacaaatgggcccaacgatgtccaggacacctaccttgatcatcctacaccatgcgtcagaaggaggagaaggtgttcgcatcaacggggcccctcaagatgggccaatgcaagatcaagattaccagttgctgatgtagaatcacgccgcaaaccttgagcacgttatatgcagcccacggtggcactcagagacacgccactgtagggagtgatagatgccactgaacgaacaactgggagggaccccgttagggtgaacatacatcggtttgtcctaggcttggcaggccagctaggacgtcctctaacaccatagatacgagagatgactagcaattggggacttgaggagaatagacttgggataggtagcaaggagggagatgtagaatatagagggtttggatactaaattgaatttgacgatgaatggttgtttcttcagtcgatcttagcccccttatatttataggaggggtggactcttcttaagggctttcacatgtctaattaggcttaaaaatcaactaggtctcgataaatcctagtctaaaaaaggaaacacgagaaatatctaaattagactcgaaccttgtgctgaagatctgaccgctcagacatacggtctgaccgaccacattaagcggtcagacaaaccttcaccggaaagctccgatatttttcaaatttggttatcaacgtcaactcctatacattgggtcgtgcttgtttgtccaggcattggggtatccccttactattataaaataaggactaatgccaccaaaaagatgggttcgggacctaggacaagaggagaccacctctgttagccactgggaaaaagaccttgaagaacacccttaaaccaagtgatctaagcaagaacacaagagtagagtattacactcccaagtagcttaaacctatctaaaatgctattccactacacctgagctcaacacctgcaccattgctgaatctcaaagggagcgtatcgtgccttcccgctagaagggctcatgctccgacaccgaccatctattggggaaaaaaattggtgtagcatggatgcaaagcattacctttgcaaccctaccacagatggttgacacatggacattataacgatccaacgactttatctgctcggtaccaagcggtgggacgaggatgcgcggttccttggctcggctcccaggcccatcgactctctccacaatccccttcctcacgtgttctcctatgccttcctcatcttccattggacctactgcagcggcatggcctccccttgtggtgtcaactcgaacaagaatcccacccgcaagaaggaagcctaggccatgttcatgtacaccaccggagcctacaacgttctccaatttcttgtcacggtttattttgatcatatcatgcgatgggaatgatcttgatccatggatcatcagtacttagtgacattgagaacatgatggtgtataactagtacaagcaggaaagaagggctcaaaggggacgcactgctagtggtggcaatcacaatacgggtgccgacaccacagcgcgcaccaagaagtacgccgtttgggacatgggcagtggccacttcagcatgttctcccatgaccaaggtggtcgcactcctacgatggtggtgccactggcgtcgcagatggatctttgtttttttctaccacagatcctcgttttctgctatgtccatcttccttgtgacgccgggtgcttcttctgctgcgttgtccacaaaggtttctcttttcatggtggttgtagtcaccagcgatgtagtcgctagcgatttggtcatgcctgaaggcgagtcgtcccgttccacatctgcacaatccccttttgggagccgggccaagcatgccatgtgcagccttgttggatagtgccaaacaaggcaagctgttggattggtatattatccacgcgtcggacatccgaagtggggctgcaggcaatgtggtttgcacccggactgcaccaattttttttccgatccattgcactctctttgtctctatagactcctcccct

SEQ ID NO: 41658 - DNA, 10492 bp, Oryza sativa
ctgcccttggccttaacccccaccaccacagcccctcactgcctttcacctgcaaaaaccacttgcaaccctcacaaaaccaaaaaacgccagcagccagcttccctcccccctccaattttagcaacttctcccttaaaatctccccccccccccccccttgcattgcacctctccttctctacccacaccacccccgccgtctccgccgccgccaccaccaccgattctttctccggtgccacctatggaagagatgatcaagccggcaccggcaccggcgtcgtcggaggaggagaaggaggtggtggctactgctgctactggagaaaggaggcatgaggaggcgacggccgggagagaggagcaggaagaggaggaggaggaggaggaggcgccggtggtgctgaagaaggggccgtggaccacggcggaggacgccgtgctggtgcagcacgtccggcagcacggcgaggggaactggaacgcggtgcagcggatgaccgggctgctccgctgcggcaagagctgccgcctccggtggaccaaccacctccgccccaacctcaagaagggttccttctcccccgacgaggagctcctcatcgcgcagctccacgcccagctcggcaacaagtgggcgcgcatggcctcccatgtaagtaaagccccaaatctccggttgatcgatcgatcgagctgtctgttgttttccatctcaaagttgttgatgtgatgtgatgcgttgtgttctttgttttgtccccagctgccggggaggacggacaacgagatcaagaactactggaacacgaggaccaagcggcgccagcgcgccggcctgccggtgtacccgccggatgtgcagctccacctcgccttcgccaagcgctgccgctacgacgacttctcctcgccgctgtcgtcgccgcagcaatccgcggggagcaatgtcctctctatggacgcagccgatgccgccggcgccgcctcgtccgggtacaccagcgcgcgcccgccgccgctcgacctcgccggccagcttgccatggggagccggccggttcagctcctcgccgcgacgccgttctccgcgccttcgtccccgtggggtaagccgttcgctcggaacgcgcagttcttccagttcccgcactcgtcgcccgtgtcgccgacgacgccgaccgggccggtgcaggtgcacccggtcacgccggagctctcgttgggctacggccttcacgccggcgaccgggccagactcccgcctgtctcgccgtccccgggtgccagagccgagctcccttcaagccaattgcgcccgtcgatggcgcctaccacagccgccgccgccgccaccggcggcttggtcggcggagcgctgcaggatcacccaaacgcggcgagcctcgaggccatgctgcaggagctgcacgacgccatcaagatcgaaccgccggcgccgccggaaaacagaggaacggaagaagaaggcggcggcggcggcggcaatctgcgcggcgtaagtggtgagtagtgcatgtcgcgcgtgaagcattttcctcacattttccactcattggatgcatctcaagttctctctctctctctctctctctctctctctctctctctctctctctctttttaagtgtgttgctttattgtagaagagaacaaattggcatgattatgatgtgaacacatacatagatcagaggatgaacctttttgtttgtgcttccaaaatctccatttgttttcttgctgaattctacctacttcctgaaaagcaaattaaacaacaccaatttcatttacctcgactcacagatcactctagagttaacctgcttagtgagaaaccaagaatgggaaaaaaatatatttcttaccagcaaaaacaatagtacatattagttttaggagttagcaaaatcagaaacaggacagctctgcttggaaccttcttttgcttttctttttgatagttttaaggtaattagcactgcatctgcatgtactgatgtacagaggcttcagaggatttctttttgtccttgcaagacagtgacagcctacagtgactgcctttgatcttgttccatgattacttttccttatcttaccaagtagtactttaatgcctttatttccctttcgactttttttttctctctttctcactctgcatctgccgctttcctatactactacctaatctaatctgcagccaattcatgcttcctttttgttcttccatgattgccttgctcatcacctccaataacagtacgtcacattggtgtcatatgattcataggttaattgattatcataatcaagcaaatataaataggatcatatctaggataagagtactttttgggagattatctataggcacctatccaactagtgctgagcagaatcgatcaaaaattaattctgcgtaagttaatgaatcaactagttgagttggtaccaagaatcgaaatcgtgcaaaacaaaaaaactttcttgaaataatttcagttccttcatgagcaaatttttgacaaattgatgcccatcaagtctgaagatttttgcatcgtggggttgcattctgtactaatttcacttcaatttccaggtgacggcaaaccggaggtagagctcaaggacgacatcgagacactcttcgaccttatcataccggcgacgttcccggcggcggcgccggagcccgccgccgccgcgacggccgcctccgccgcgcccaaccactccagctccgtctcgcagcacagcagcgacgaccaggaccactccaacggcgccgacgtcctcgacctgcccatcctcaccggcggcggaggcggctcgtcggagcaggacgactggagcctcgacggcgccgcctgccagtgggacaacatctccggcggcatctgctgacatgaatttcgatgatcaacgctgcgtctgaaacattctgtgatcccaagaaccgctcaagaagagctcttttttttttcctttttgcgaacatttttcttggccttctttttttttttcatgtacctggggttaattaggttgtatcgatcgtgactgagcaaagtgcaaatcttcgatgcccccagtgaggcttttaacttcgtttttttttaattacaaatgactcggtctgagctgatcatatcaaagtttttatcggcatatatatctagtatctctgttaagacattaactgcctgattatcttgttagaatgttattgtagtgatatgttcttccaagcatgcaagaggcaaagattatagcgatcgatttctgtgatgttttgataacggtcttgtttcaagctggcagttggcagtaggtacacgctgtgactgactagtacttgtcccaaaaacgggagactgcaggagcacggagaacatccgtgtgttaggttgtgatcaatgtgttgctgccttgttggagaccaaggctcagattggctggcacctgatcgaatcatccagcaaccgagtctgtgactagatgccctgctagagcattcaggtgttgtgcctagctagttcgtgtacttttggggatattgcgaatgcacgaataaaatttggggaaatgagatcaaagtgccctccgctgctttagttgtagttttgtttttgataatgatttttttttgggcgaaacacactatacgcacgcttatatgcaagcacgaacagtcaccttatgaatacatacatgcgtaccctacctcaatttgatccccatttaaacgatatgatgtatttggccataatttaacttaagttacagttacactaccaattgcaatagaatcaggtccattttatttagtggcggtttttaaaaaatgttgtagaatgaaagtcatgctaacaatctccagtgtccagaaatatggttatctgcatcttagtcggtgcacaggctggaagttacacttggctataggagctccttaggagcatatactcttaattctctctgaaacaaattgagaaaacgagcttgcttatctgtgtagcatcagctttggatgggtaccccaaaaaagaaaaaaaggatggcattatgggaaacatatcttagtgaaatgtgatacaccaatctcatattttacaataacaaaatgtcaaattcaagcagtagcaggtggtcataaatccgtcgtgagattatagtggcgaaccatgcaaaaggtggcctctgctgccttccggtgtctcgtacgcagcagcggcaccgctggtcgaagaaaaaggagcagttggattgcatgatcagcaagtaccctccccatgctaaatacgtgttgcccattctttgctccttgcttcctgccataagttcctcccaaagagaggcttctctcttgttgtgactccttactgctctctgtcacggacagagtcctttcatttcttttcactctgtttttttttccttccttggggacaaaagaagcttctaatgattcttatgggactagaccacataatgcaacataggccaaggacatagcactcaaataggtattttccactatattttttttgacaccatattttccactgtatattagtatagctttaagcctttaaaggtggtttcaatcttctttgatactttctattttagccctcatagtttttcaatttatgtgaaagtccaaagtgttacactaaacacccagaacctagaaactaggccatgtttgggggagcttctagctgctgcagcttctcccaaaatcaaaagctcccccaaacagctcagcttttggtccagattctgagtagctgtagttgtagaatccaaaaaatgaactagaaaccagaagctaggaaacccagtttttccagattttcaaaagttggctaccaaccaattgtttctcagaatcttaagcttcccaaacagaccataaatctctcctctacccctccactctcccctctcttggaccctgcctcctatctcctctgccctctcccaccacctgacactagcagaatattttggttccatgatttcggtttaatatatagttaaaatattggattttggttttctgattaattttaccaccactagagtatatggttcaatgcagaaccatcgacaagctcgtgctggctgagtgaccgaataggacccaaaaaaaattaggggccccattttttctaattttaatctatcttaatgtgttccaacatgtttaaagctctttggttctatttttaaaaggcaaattttgctataggacataacgacttactgttttagctgtaggacaccgcacgaagtgagtattgggtaaagacaaatataaaaagaggaacttatggacttgaatcagacattgggttgacatccaaaatagagaggaaaagaggaagcaaacatagctagatcacgaaagaaagctcttgcaaatgtagctagctacgccttctcctccatttttccggtggcttttaccacccgatctgccaccaccgtccagtgcaaactatctagtaggccaagattcccccgacctaccctcctccttagtctctagcggttctcggtccatcggcgccatccttcgcctcttaaccaccccactcaactttgccccctactgtcggacctgcccaccacccattgccaaccctaccgctccagcgccgccacttagctctcctcccacccccactctcaccctgacccaaacccccaaaccctatctggttaggtcaccaccatctcgctgcatggaatcgctgcgacttgtcagagctaaggaagaaggatgctaagcacgaatcacccaaaatctataagattcattccccaaatttccattgaatgctacttagcaatccaaacaaaaaagagaaaatctctcgtatacctctgaaattttacctaatcccttctatacccctgaattttgcttactttcttgtatacccccaaaatttgattttgattccttccatacccctcccgtcagctaaccgttagttggccatctaatttctataaaaataaccattttaccctttggatgaacatagaaatttatgaattacattattaaaaatgtaaaagtttgtcgcatgagactattgtagttatgagtttttttgtgcgatacattatttatcacaaaatttagttttagataataaaataaaaaaatatgtatttatttttaaaaatcataaaaatgaggagcattcatacaaagataggaccaccaatgctcacaatattttttttatgaatgctcccgataaaaaaaaatcaattgtcctattaaaatttcaaataaatattttaatctattacatttgttttattttcaaaatttatgtaaaaatttcctgcactaattatttagtctcattagtttcataaaatgcacatactgtgcattcaaacaaaattttcaatcatttttcaagtttatattcaaatctaaagtatcaagggaaaaaatgatatttgcaaccaaacgtaatactgaaatgaaggaaaatgtaatagtagggacacggaagggatcaagttgaaattttaggggtatagaagggatcggataaatttcaagggtatgaaagggattgagtaagttttcatgggtgcacagggaattcacttaaaaaaaagatggacaatattgcgactaaacagtacatgtacaccaattagtttaacctgctaccattcttatatatctgaaaataaatgatatgcatgcatcatctctctcccacgtgggagtatgcaagaatgcaacagctcctaatagataagtttcaaataaaatcttcttttaaattatttatccgattatactattatattagttctaattaaacatttataataagaatttacatgcttatattctaattaaaaaaatatatgttgtaaattactttattatgtatgtagtattaattttatcgtatatgtacattatttttagatttaattaaattacttcttagatattcataatggtgtgagttatttacatttattgttatttttaagttagttctataatttgtgctgactaaattaaatttctcgatagactcatatttttaccctcgtagcggaattagttttattacaatgataacttactttcattttgtattaacctacttttatgatttatgtaaattactttatgctttattgaatttataaatatctaaaaattaatctaatcaaatttaaaattaatttaaatatatgacaaaagtagtttacaacacatatatatctcttattagaatataggcaaattttgctagatgaaattgtgacttcatggttttatctataggacaccgtacaaagtgagttttaggggaaagacattcagtaaatatataaattggctcatgggtactatgcccattagaatatttatttctagctgaatatgaaaccatatgaaagttataaaatacccatgggcacacatgtcaggtcaaccatctctcaatctctctctcgcacatgaacaatgaaatgggaaaagcatcatggtggtgtcgccgtgccatactcttcgaggtgtatggcgaggtggaagacatcgcggcgcacaccttcgtctccatgtagcaggagtgggcgtcgtctaccacgatggccatggtgctgatgacggtgagggggttgaaggagccgaagccctgagtagcttgggtggggcaatgtggaggagagatgcccgagtctggcacgaagccttgccttgatagcctcgttgctccgtgcgagcccactccatgccttgctcttggtctccgcctgtcggagccgctcctaaagctcagtccagcggcctccacctctacctccttctcctgccactatcgtgccgcggtagctaatgtcgcgttccgtatccactcgaagtccatccacactattgtgttgatctctacgctttgctcttgctcctgctcaacaccatcggctgcagtatgcttggcactatcatgctctagcgcattctcgcgcccctcactccttcttgtatgactttgagagagagatagagataggagacctgatatgtgggtctagaggtattttagaattttcacgctatttctctcccctactctactagaaatgattattctaatgggcacgatgttcattagaaaatttccacgtttacaaagtaccttctcccaaaagtcattttatgtggtacctcaaagttacgatgaactctaacaaaatttgcctagaatataattatgtgagattgtattataaatattttattgcaatgaatgtaacggtgtgaattagatggtaaattagataagtattttaaagaaaaaatataagaaggaaaaacctacatacatgacctaacaaaaacactcaatcaaacattatcccatagcgcacatggctaccaatcaagcctcgtcttacaagactaaatattgtgtgtgtactactatttagattttgtgttaattgtagcatatgtatcaacttgcctgcagcccatttgtcgaatggttggttggcacgacacaacttttagacgggttacaccgcgacaaacgagggtgatgcgattgctcgcgtttgatcagttacgaagtgggatgcaaatgcaagcgataacgaaaagggagcatcgcttacgaaaatcgatcccaaccaatctgctgcgcgcgcgcgcgccgccaaggccactcgcaagtcgcaaaatcatataccttcatcggcgtacgtgagtgagctcgagcaacttagcaagcacaccgcacgccgcgtcgctccagacccggccgccggcaacggtgacatcggccgcaggggcaattactgctcgatcgttgctccactcctcgccatggcccagggatgccgatgccaatgccatcataggcagcgctggcgctgctactacacttgttaataaatggcccgcctgctggctaaggaggaagccaaattccactacgatgcggcgaattcttgaaacttccttgtggcgatcgaggcccgcttgttaatgttcaatagcggcatatataagtccaatagaatggatggtacacccctactgtgtttcccttaacatcataggaggggtggtaatgggttaccctccaagcgataactaggggaaatttgtgcttcttctcattgattcaagtgttttacttgatttgtgtgttcctgccaaaaattcacttgatttgcgcgagcttagttggactgctgtgtcaccagtgctgggttgtacatcgtcgctgtcgggtgagatcctctatcataatgttactatcattatagtcattgttatatgggttccatccttctattgtcccacacgtcagtgcctgtaatgtgagtgtcattatggtagaggatgtgaacccgtcgccgtcgccatgtgagggggagactgactactaagttccatatagtttctaccttggactaccatgttgacatgttacatgggcaaatgtgacaaatagttgaaaaaaacaaccaccttagagggaaaaaaataaaagcaattttaagatgagcattggataattgccaaatctaataatggcaatagttaaattccccaataactagggtgcgtttaggagagaaggttgggaattttctctggcgcatgtaaaacatgataattcatgagcacgtgattaattaagtattagctattttttaaaaaaaataatatgattttttaaagcaactttcctatacaaatttttcaaaaaaaacatctttttacaatttagagaacgtgggtacaagaaacaagagagtagaagttgggaacatgtagttccaaatacaccgtaaacatgtggttcttaaccaaaaccaagaaaaaccagagaaattttaccgaaagttttttttatttaattgcttttaacttagcagatattcccttcgtctcaaatataaacattttgtccagatttatagttaaaagttattacatttttgggatgaaggtagtatatcagattgttttcattacacgaccacaagtccacgacgataaacccggttaccgcagtaaccgacggtaagaaaaacccagcgcggcactcaactgcacggtacattggtactacttcggcctttatttgccaaagatcaaattctattcatctcaaaagatatactccatcatcaaatgtgacgtcagttatcccaacatcaaattttgggaattttggcaggatagagtaataataacatggcccatcacagaggatgggccatggaatggtccgtgctaaacggtgtctggcactaatgcactgcagtctatgaaatctacgcaccacaaaaaagtgtataggaacggtgaagtcgaaattttgtttatactatggaagaagtgataattgcgtaagcaaatttttaaattcatttacta

SEQ ID NO: 41659 - DNA, 8337 bp, Oryza sativa
accctgtatgaagtaacaagcaatagaaagcacatgagcagcctatagcaatattagttcaatcatgacaaccaggccatattaacatgttaatcatgtacttataaacagataacaagaccaaggcataatcttccattaatacaatgcaactacattagttacgcatagttggcaaaaattttaatgtacattaggcagtagcatagcacatagcacattcataattcatagattgatttgacttaaaaagaaaaggggttgtatttgaagcacatattacagaagagcaattaaaatgaaacctactcaatttcgatatggtgatgcaagatttatatatacaaatctatgagatggtagaaactgactcacatataagggaaaattgcaaatattttttatcacaaagggatgctatacgattggcaatatattctataacgatgtttcctgaatcattgaagtatcgaaaagttacaaattcataattaaggaacagacttatattaaagatattagaagtcagcagtttatgacaggaaatggcatcactaaatcaccaatcagacaagaaacattgcatggagtccagttctcccgcttataaacaccattccacattcttccttatcgtagtattccatgtgcaatgtttaatgtgtaaatgtttcattgccacagagcaccgttatgttatcttgttgcatatatcaggtgtatagcaaaactgaacatttaataactaaatttacaaactgagattgttggtaaaaaatcgtgcaggataggagaccataccatagcaactaatacattttatagcaatcgactagttagtgtaatctgagttgattttaacagggttgtaaatggcaatccaaaaaagacgagtataaagcaactatttttttgcttcacaaggggggcaatttacatatcaacaattcagtgttcccattcatctagaaatgcgactaaatgcaacattagagcttcattcagataacaatacaaggacctatgatcagtataagaagctagaatgctagagcaatcccaacaaatggggcaaatgaatcccaattgcacaactactaaccttttcagaggccaaccaatgtctgaaacttttgacttcactaactgtgatccaagttttcatcacccaagtatcacaaaatgtccttgatgaagtcaagattgagcgtgtcgcggacaatcagaaacatgccaaccatgagtaccaccagtatacctgacgacatgatcctctgttcgatttcacgggggatcttctgcccaccacgggccgcctcgagaaggatcaacgccaacgtcccaccgtctaatgctggcaatggcaacaagtttattgcagcaaggttgaggtttatcacagccgcaaactgaaacaagccctcggcgcttgacctggccacctctgcgccaaccgcaatgattgcaactggaccagacaccttctccgccgtctgcgagaagttgaggaacgtctgcctgaggccgtcgagcaccgtggcgctcaatgcggtgaactcgcgcaaggcgaggacggtggcctcggccaggttgttggggtggacgcgagtgacacggaagtagggcgagagctgcacgccaatgcggccggtcccgtcgacgctggtgtccggcacgacggtgaggtcgatggacctccggtcgccgggtcctggccctgttcttgagacggtgacggagacatccttgttggggcttgccttgatgaggtcgacgaggacaggaacggaggggtccggtgcgaggccggggacggagaggatgacatcgccggggaggaggccggcgcgggcggcggcggagccggggatgacctcggggacgaggacgccggggagctgcgcctggacggggacgccgacggtgagcgcctgggcgtagacgatgaggaaggcgaagaggaggttggcggcgacgccggcggagacgacgaggaggcggtcggggacggggcggttgcggaggaggtcggggtcgtcgggcgggaagccggagtccgggtcgtcgtcggggaagccgacgtagcccccgagcgggatggcgcggagcgcgtactcgacggggccgaggcggaagcgcgcgagggcggggccgaagccgacggagaactgggagacgtggatgccgcgggaggtggcggcgaggaagtggcccgactcgtggacgaggacgatggcggcgaggacggaggcggcggaggcgacggactcgacgctggcgaggaggtcggacggggcggcggcggagacggagatgggcctggaggaggggtggcggtggcggcggaggagagggaggtgggggtggagggatagaggaggaggaggcttgagggtgggagagaggtgggtggtaatccgaatcatggtgggagggggagggggaggggaggaaggcggaggagtggataatctggcattctcttgttggggagtttgaggcgcgtggggactttggtggtgcgcctccgccgccggtgagagagtgaagtcgggaaatgtttgtgtggatgataagcgggtgacgctgcacagcagtaagccagaaaagtgagcatatgtttttctttttctctcgtttttaggcgcagaagcccgaaattcatttctcctgttgggctaaaagtcacacttatatgggcctgggaatctgggatgggcgtgggtcagcccgctggtaatgattaattggtccattcagattcaagtaatcaagattcgaaaaaggctatttatactccctccttaaagatcagatccgattgttattcctcaactataaaactgggtatatttactcctccaactattaaactatgcaaaactatactctctcagtggttttagaatggttttggccacatggagtccaatggatagcccaataattagagaaattaaaaactaaagtgaggctcacctgtcggtgattctcccatcttctcttatctatcctctctaatccccattcttctcggcctcctgaaggtcgacgctagtattgtcaagacagaataggtatcagtcggcttcgatatcgaaagtagtcttggccgtgtttggctttaattgggccaaaaacactagacgcaaaacttacaacccaattacacccaacacttcacataaagaaataagttcactttaggtccatcatcttaacgacgagtttaaattgcgtccttgaaaccataatacaaagtataacgcatctctcaacttgcaatataggtgtacacgagatccttaggccatagagttattggttttagctgacatgacgagttgactacggtcaacccatcttaattagcacaggacccacatgggccccagatgtcagtggccaactcttctttccctccctcaccccttctctctacaatctctctccctcacgatggccctacacgagaggtggcgcgtgcatttgccggtggataaaggtggcgagcgatgggaagaagcatggcaaccagtaggggtgggcgttcggtttattagctcggcttggtttcatcagtttaaaagatattcggttttctagttatggcaaccgagttgtttataaaagaatacaaaaccaagccaaataaaccgagttacttcagtttggttgttcggttttaccgaacaaaccgtaggaacacgttgccatgagttccaaagcacacaatacttttttttttgcggggaaagcacacaatacttaagaaatcgcttgacggcacatgcaatggcagatcaagagacaaggagttttcttacctcacataccaagactgcaagagagtcatgaaacttggagaaacctggcaaccagtagactttaatacagatactccctccgtcccaaaaaaagacaaaccctggtttccgtgtccaacgtttgaccgtccgtcttattaaaaaaactataaaaaaattaaaaagataagtcacacataaagtattaatcatgttttatcatctaacaacaatgagaatactaattataaaaaaatttcatataagacggatagtcaaacattgacacggaaacctagggtttgtctttttttgggacggagggagtatgtggtagttgtacgtgcacacgctcagatcagtcgtctggagggagttggaccggcgcaacggctgcgacggctgcggcgatggtggtaaggtagccatccagccacgacttcgcacgatgatgagacgacgccgaacaacgctgggttttctaggagatgtattagtgttagattagtaggccttgggcccaattaaagagctgttggccttaaagtttgtacgttgccaggtttgtgatatgtgtctaacgtgtggttcagtttctcccgttttctcatattgtttggttcgtgagaattgaaaaccgtagataacaccgaagaccgatcagatgcaaaacagaagccgaagaataaaccgatgcccgaaaaaaccgacacttcttcagttcggctcagttttattcggcttgcggtcttcggggattctaacacgttgtagggttcttaatcttgaagggctactcgagccgctgcgcggcgagtttgaggccttccagtcagccatagctgcggttgccacccgtccaatccgcctcgctcgccgcctctcttcccgtcggtgacagcctttctctccatcacccgacgcccgcttcctagcctggagagatgggtccacgggaaggagaggaagaggggaggaagaagagttggcaattgacatgtgccaagttgatttagccaagttggtcacagtcgtcgtcacgttagagcatctccaacagcttctccatcccactctccaagcaaaaaattagctattttgaacaaaaattgtactccaacagcctctctattagaatagccaagccaaatgacttgccaaactcctctcctcaatggccaaatttagccagcccaaactgccttgccattggtgggtcccacgcgatacgtcttctctcacctcactctacgcgtcgtgactgctgcaagcggagaaggatgtggcggtggggcagcacgatggcaagcgtcaccatggcctcccgctcgccggccgccggcgtcgagggcatgaagggagcagcagcaacgaggtattgtcatcgcccgagctctcgcccattcctgcgcctctcctctccaatctctccatcacattcacgcgccattgcatcatcgatcgagcattcgactctccaagtagggagctggagccaatggccaccgccaccctccacatcgacggcgacgacgtcatcctcgacgtgggccatctggccgggcaggcgagcggcgacaatggcgacgcggtggacaatgcgttgatgaggctcccgtgtgctctcaacgcggtcggcgtcctcaccggcacgatggccgctgcggctgccaggagtggtggaggtgtgggccgcgatgtggatggccggggattgccgacagccagaggggagctcgacggtgctcggctgccgggagtggtcggcggggagagggagagtacctcggcgagcgttggcgttaggggaccgccgtccgtcggcatgcgttggcaacatcggtcgacgcctcgacgagaattcgggaaggaaggaaaggggaaaagaatgaaagagaaagaaggggggagagagaggggaagaagaggggagggaggctgacatatggatccgattttattttggagaggattaatagagagtttgttggagtgagtatctaatttgactgtctaaatcagaaggagagttggccatatgtatgtttggagagttcgatttggagagactatcggaaagactcttagccagaactaggcactgcccctgtgaccttggacacattgattttacaagttaagaaacataatttaaacttgatgtcaagatgatgcatcatgataacccggtccacaggggtacacagggtgaccactcctcttcccctctctgcatatgcgtcagccgccaggcgacggcggacggccaccgacagccgccgcatgcagctagggtcgtgcccgtgcgtgccggctttggcggtggcgtgtggcgatcaccggcgtcctcggaacgagcaagccaacgacgcgaggatgggacgggaccaggggaggagggcagtgccgcggcctgcagcggttgcgtgcaatttgcaaagcagtctggagcttggttgcgctggagattggagcagccgggtgggaaggagacgatcgagggtggatcatcggatcctgtttccgacaccaccacagtaaaggaaggctcgttcccaaatcccatttttatctgttggtgtgtaaaatgagaaatcaatgtacttcagttggttaatttttttttactgtaaactgtggactttatcactgcagagaccaaaatgaaggaagtatgtggatttgaaatcacactcttcttgttgtaagaacaccgaaattaataagcatcatgttctggatccatcagaaatgcctctcaagtcccatgaatcttttcgtatgctatatatttgtcaacatagattatagtttgtcaattgttgtttcattcatggattgaattttttttctaaatatgaaccttacatttagcttttagatacttcctctatccaaaagtctaatacctatttcattctttggttttccaaaagtctaaggcctatttgtaatctctatatgctaaattaaattgttgaccggaaccaagacgtccttttagtacttactccctccgtcccaaaaaaagacaaaccccggtttccgtgcccaatttttgaccgtccgtcttatttgataaaattatgaaaaaaattaaaaacacaagtcacgcacaaagtattaatcatgttttatcatctaacaacaataaaaatacaaattataaaaaaaattcatataagacgaacagtcaaagttggacacgcaaacctagggtttgtcttttttttgggacggagggagtattgtcacatgcatgtgtgtagttcattagttttgtcactgggtggatgagttaattacttcttggtcatggtgataaaagaaatatgtttttagatttttggatgaagggagtatctcttaatttctgagatatacatgcatttaaggtgctcgataaacacgtagctaaattattttattgttaactaacctgtaatctctctatgttaatttgtggtgttttgatattgtgtatattgttttcttttccatttaagtatcccatagtaactctgaataccaatagaaatcttccatctgccacagttttgcagtgcattccattgtatgggcttaaacataggaatctcagtaaagaaaagaatgtgatagttacaaccttttcaatcaagattcattatcagcggtgtaatgagatatatgattattccaaattccaatgcaatgtgcttgcttgatattatgtgaaatcacatataggtgaatttagctttggatgtggatttgtactgcacagtatttaactgcaggcagcgcacgctatccttttttcccactccatacagttctactattcattattcaatgtatgggaaggtagcctatgctcatgtatcaacagagtattttcattgtctgtttcttgcagaataaaccatgcacatgctgatgaaaagtgacagccagcatgtatcatgcatcccgtgagagctactatgcactgaaaattggtagtgttattctgtgttacatattgctactgatgacttgatttttattttattttttcaattaaagctgaaattaaacctcccattctggctgttgttcaagacaaaaggtccatcttttgctattttgttccatagcaataatgtcagaaaaagcctatataacatgtacaatacaacatatctgtgttagttatttaatttcttgcttgatctgtgaagtgaaatcagatttatgcatgattcttctttgtggtttatcagctgggatcacatgatgcagaaatatccaactttggtcttgtgttatgctacaataaggtaagtcattctttgacaaggggaagaaattccagcattcatcaaaattagtaatatttagtaaggaaaagtattacattgtattgaaagggtttcctttgtgacctaaattacaggtgtaacatgtttgcaagtgtaaaaaattatactaagcttccaagcatgcccttacatagtacacgcaatgtaatgttaacaaaaaatttggccatgaacgggctgcaggaatt

SEQ ID NO: 41660 - DNA, 20439 bp, Oryza sativa
  unsure (1)..(20439): unsure at all n locations
accccctcctccgaacacagccttagatgagcacatgatagggtaattactaagaaggtaaaatggttatgaattaagactacgcaggtagttgggagactattgtaaaagactaatgacttttgttgccttctgatttttccttttcagaacagtttgcaaatggaagttagcattatagaacttggaagccatcttgattgtgtggacaaacataccaattccaaagccgtctttttaatctagtatatcatgatgccatggggttatttggcctagcttatttgcatatgtcagaaagaactagggaattgtgttggggggcacaaatagccattttattagttctcttcttttcattgtatagttggcctggcagattttagctgattggctgaaaatatgatcctattgcttcacgctcatgagaaataaagggaccaatttgttgatatgcactgcaaaagtcgatggtcgatgctattcctgacttggtgtagagaatcacggacctctatagtaaactaagtttttgttctaatcattgatcttagtgattctatacggtcaaataattcagtttatactaaccaagcctcattgaaatgcccaaagaattttgtcgccttcttactgacaactggaaggacttaattctgtcatcttgcggtaatattcaaattaaaatgatgaactaaacaaggaattataagaaatcatacatacatattaggagacagaaactttggcatgggaacactatgttcttaagaagtggtccagccttcagaagagctctgatatttcgagttttcaggtaatgcttctttcccactacacctgaacatcaacggtgtgttgtagctgcttcaatcttcagacttttgtatgaagtttcatggtaaacatgtatctagctttcgttccagctgtgcacctctaaagctgtactctgcaaaacatgcatctactcattatattactttgcattgattttcatcaagtgcatgtgctactttaaaatattttctgttaagtcaactgatacgtaaatatccgtgtgaaactataatactctagagtctagtgggaaatattttgtagttaatgtataggtatcagttccaaggggctattactaagttgtatgtattgtgatactctagtagcacctctaggtcctgggcccaactctctatagaagcgaatttcaggtctagttaaaaaaaatcacttgctagccctcgtaaaaaaatgtgttaagaatcgacctattaagggtgggccctcgtataggggacaagggctttaaagcaggattaaggaccgatccatacgacgtgagtccgcgtgttaggggccaggtttcgtggcttttcttagtcggtttggttgaggcttcttcttcttaatgtggggtggtcatgcctccactggtcgagtttttttaataccaagttatatatatgcttattagtaaccaaatctgtgggatgtttgactgtattacagtgaaatactggagaaatctgggagttagtattaatgaggacttgttgctgtggttttctgactatgagctaccacaagaaatgataaatagatatctattattgaatctggagatataatgtgatactaaagcataaatagtactgctgcactgcaccatgcaaggacaagtggtccagtataagaaaacaagattatggccaacagctgcatgaacctccatgtgcagcttcaaaataaccggctgcctttgaatattctactgcttcccctcaacagagtcaacattagccatattgttttggttgcaagttgcagcttgcaacactcatttctcctgagaaacccaaccttcttgcaggtagaggaacaaggagggagatggctggcctgatttcttcaggaatcatcaagtggacggcaagcaagctttcttcactggtttcggcatcacctggagcatcagcatccaatgagcagagttctgcactcagggatgtgaggacgctgcagaggacgatggcgaggatccagcgcacgcttgctaccaccgatgagcacagcatcagagatgcatctgagaggcttcacctgagggagcttcagcagtttgcctacgatgcccaagatgcaatcgatctgtacaagtttgagcttctgcggcgaaggatggatgatccaaacagtcatggagatggcggcagtagccgtaaacgcaagcacaagggggacaagaaggtaccaccagttcttcgatctcctgtgatttttcttttccttttccgtttgattcatcagaaaagttttgcagatttaccattttagtgaaatgcaagcatgtggatggttggtctaattactcatgttaccataggtagacaatattgattcttgaagtatattgacatattccattatctctaacataagaatcatcgataaaaccgttgctagtctgcagctgttgtcatgtcaactacagtgaaataaatgagctaggtaaaaacatgggattgaatgattgtaataatttaatgaagaaattatcaaataaaaaataaatttataaaaaatggttttataaatggttttataaataaaaggcactttctacaagcaacttactagaaaaatattattttctattttttttattcaagtattttatctccaggaacctgaaactgaaccggaggaagtttcaattcctgatgaattggctgttcgggtaagaaaaatcctagaaagatttaaggagatcacaaaggcatgggatgatctccgtctagatgatacagatacaacaatgcaagatgaggaacatagcatgctcccactgcctactaccccatatgttgacgagcccactatctttggtagagatgaagataaggaaaagataatcaaaatgctgctctctgtgggtggtgccaatgaaggagatgtgtcagttcttcccattattggaatgggtggagtaggaaagacagcacttgttcaactagtgtacaatgatcgaaggattctgaacagatttgacttgatgggctgggttcatgtctcagagaattttgatctcaaaagcataatgcgtaaaattatcatgtccttcacgaaaaaaccatgtcagatgacacaaatggatcagctccagtatatgctaatagaacaagttgttggcagaaagttcttgctggttcttgatgatgtgtggaatgagaggaaggatatttgggatgcattattatcagccatgtcacctgcacaatcaagcataatattggtaactacccgcaatacaagtgtgtcaacaatagtccagacaatgcacccctacaatgtgagttgcctaccttttgaggaatcctggcaactattcaagcagatggcctttttgcaccaagatgagagtatgaaaacagattttgaggttattggcagaaaaattgttcagaaatgtgctggcttgcctttagcagtgaaggcaattgccagtgcacttcgctttgaggaaaatgaggagaaatggaatgacatattggagagtgaacaatgggagttaccaacaacagaggatactgtgttaccggcgttaaaattaagctatgatcaaatgccaatccacttaaagcggtgctttgttttcttcgcattattccctaagaggcatgttttcttgaaggaaaatgtggtatatctgtggatatctttgggcttccttaaacggaccagccagacaaaccttgagactattgcaaggtgccttaatgacttgatgcagaggactatggttcagaaaatactatttgatggaggacatgattgcttcaccatgcatgaccttgtacatgatcttgccgcgtccatctcatatgaagatattttgagaatagacactcaacacatgaagtctatgaatgaagcatcaggaagccttaggtatttatctctggttgtgagttcttcagaccatgcgaatttggatttgcgtacattaccagtgtcaggaggtatcaggatatttcaagttgtaaattctatggatgacaatagaagatatttttcatccttcttcaaaaataacagaagatgcttctccaagttgttctcacatcacattaaccttacaattgataatgagctatggagcagttttcggcatttgagaactttagacttaagccgcagctcaatgacagcattgcctgattcaattagaggactgaagttgctcaggtatctaagtattttccaaacaagaatctccaagctcccagaatcaatttgtgacctccttaatttgaagatcttagatgcaagaacaaactttcttgaagagctaccacaaggcattcagaagctggtcaagctccagcatctcaatttagtcctttggtctcccctgtgcatgccaaaaggaattggaaatctgaccaaactacaaaccttgacaaggtatagtgttggaagtggcaattggcactgcaatattgctgaactacattacttagtgaatatccatggtgaattgaccattacaggattaggtagagtgaccaaagttgatgatgctcaaacagccaacctgattaataaagagcatgtgcaaactctaagattagattggtctgatggattctactctagtgaatgtgatcataattctagtcatatagatgtaaaagcaacaccagaattagcagaggaggtatttgagagcttaaagccaactagcaacttggaggagttagaggtagctgactattttgggtacaaatacccaagttggtttggaggttctgcctattcacaattggccaagataactttatggaagcaaggctgcaagttccttccaacacttggccagttacctcagttgcgtaaacttgtagttatacgcatggaggaagtagagagaatcgggcaggagtttcatggcgagaattccacaaatcgattcccagtattggaggaattggagtttgagaacatgccgaaatgggtggagtggactggagtttttgatggtgacttcccttcacttcgtgagctgaaaatcaaggacagcggtgaattgagaacccttccacatcaattatcatcctctttgaaaaaattggtcatcaagaaatgtgaaaagctgacaagactgccaactattcccaacctaacaatcttacttttgatgggcaatcttagcgaagaaatacacaatagtctggattttccaatgctccaaatattaaaagtgtgtttcacgcaaaaacttgtgtgccttgaacttgacaataagaacctaccaatcctggaggcactagctataagtggatgccgggggctattttctgtggtaggattgttcagccttgaatccctcaagcttctaaaaataaaagattgcccaaacctgcagtgccctttacaaccacttcaacagcagcttcagtaatgtattatcacgaactgtcctcaattacaggaatggattgagtggcaacagtctctaatagacaaggaagataaggtaagagctttttttttttatctgtgctttctttgtgccttttgttttttgttttcttcactgaaattgatgtattttatcctcagcagcaaccagaatttgataatgcaagttatgatcaagaggctcttggtgcactgagcgacaatagtgaggatgatgttgaagttttcaatgaagatgaagatgacgatttctatgatgaaatgctagaagttgggcagtcaagcgggacagcaattaatgacgatgatggaagtaacgatgctgtttgaagtatgagagcaatatttttgaacatcacgtgcaaatgattttgtttgcatgtcgttctccaacttcaacttgattaatccaatttgatgtgctacttcctattttttataaaaaaactacagtgcaaaatataccaatttcaggtcgaaaaaaatatgtgacatacattccattagctggatagctatggttttaatgtaggaaaaactgttatataagtgtcttacaaaatatttctgagctcccaatcttgataacaaatgaaaaaaaaactcatagaagtaggaaacatgaaccgtaagtagaagtatttaaaaaacatgtggtttgagctttctaattttatgacaaacttggctaccatcacggatttccagtgctgcctcaaatttccctttggttcagttgcatttctcggataaacaagttttcttgttagcgacaattgcatattttttattaataatttcatatttttgcaactaattgattgtcactatcactattcatgcatcatgtttatgcgtctgcaggactgcaattcgtccagttgtccatctatggtgacaaattgcaattgtctagagcaagacagggtagtaaaaaggtacagctatttcacgcgtaccccaagttgaatgtgtgtatgcaaccttggttgaatgatcgttagttatgaaccatacggcagctaagatccagatttagccgtttggttaaatatcgatccaattatatgcattgaggcagtaccagatacataaggcgttaatttctcaattatcaggaacgaagaaattggaggaaacaaattaaaggttaaagacatcaccatcaactttaacaaaaaaatcatctttgcataagcatctactacatccagcagcatgaacatatagtgtttaaggtatcggacatggaagatacttaaatactaagccaaacggttcatatttcaaaattcagctaacacctcaaacggtttcactaatcatgcagatcacacttcatgccagatgttcacttcttatacttctttggtgccctgcatcattacgaagttgcagacgataaaactttatgaaaacaagcatacatatttgcaaatggatggttcaatgctacttacgccgcagtttgagcaggcactgctggagcagctggctctcttgggccctgtttgtcatcataaaagtattaaaaacacatggccagcaaataatcaaatatgaacaagccaggcaaatatgctttaccatggaacatcttcaaaaaattaatcatgatttgacaagcttattgtaacatgaatgacgtcccagtgtcatttaacatgaatgagttgacagcattgctttactagcatttttttatttggtggaataagatatatttcaatattgaaatgcaaatgctaacacattagatattccaatgaaaaaaaaaaaactataaccatagaaatcgtctcacctgagccaacctctcgtcacgcctggcaatcttcctctcacgactggccttgctcttggcacgcttagcctcaaactggtcagagagtgtcttctctcttgccttctcagccttagacttgtggatactttccatgagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaatcttctggggcttcttgataatgaacccatccttgaccaacttacggatgttctgacctgcaagcacaaaggaaaaaaaatcagatagccttccaagaatttcaggcatgtgatatgagtcacagatatatacagggcaacaaacttcagtatctagaacagtaaataattaataggatattttattggttcttgcaggaaatgagttgtgacctattccaataggacattacacaaactcgcttgcagataagctacaccataattcatacgctcagacaggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaagaagcacaaatgcacatgcatatctaaatgcgccaggcatccccttgtctctttgtatattaatcactatagaggacagttagtcacattcccagaacagcgccttggattagaacccctaacgacaaccttgatcaatcggtaacaacactgcatggtccaatctagatagcatacactccaaggtcaatatactggccatttctctaatgttctcttccaaacaaatacacccagcacaacaacctaacaactcctatagaactgggagcacgcgattcccacgaagcaataaaatattcctaccagaatcgccgggggcaaaaattttcgcgcggattagcagcatggcttcagatctaagcaaatcacgcatcaacaccacacaagtagcaggcacagaacatcatacggtagggcaaggggagggttatgggggggagggacgaggaggggagttctcacgggagttggccatggagatctcgttgacctcattggggtcgagccagaccttgcccttgccgcatttgagcacgctggaggcgagccgcttctgcagcttgagggaaaccatcgccgccgccgccgccggcttcttacctgtgtggagtgtgtggtgaggggggtgcaagggttggccgcgtgcggcgccgggggtttatatagtgagaggggctagggtttcagcccgagcggggagactcatgggccttgggcccatcagtgtgttggggtttgcagcgggaataagttcactttatgaccctcaaatgtccacgaccttaaattacaaaatcggatatctcgacccccaaactcctaaaaccggtgcatttgactccctggaccgttttgggaggcggttttgctgatgtggcgccgtgcggtgcctacgtggcaatattgaccgagttttcggtccacgtagcgttgacgtagcacctacgtggcggtagaattaaaaaatatgcatgggacccattagtcattcacacaaaaagaaacatgggcccactaacatatgggacctatatcctcaagaactcatgtcgacgatactgtggggacgagggctactagttcctaccgcacgatcggaactgtggcatgctaaataggcgcggctcttacccccagatgggccaagtttgacaagtactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtgtattgcatgggctgttcctaaacatgcatgcacctaattaatctaaatgtactgtgtgggtggatcatttatttgctggtctgatagtttgtttagttcaaaaatgtatctttttttcccttccgataacgtttcgatgcacctttttgattacgattgtcgacgggtgatacccgtagaccggatatagagggtattggggtacgctggtacaaggatctacgtagtacgacatcgagtaatcaaaagacaagaattatactggttcaggccccttgataggtaatagccctaatccagttgatatgggattatatggtggaaaacacaggttacaaaggaaagatggaacttgtcgaatccggcgagattgtagtcgagttgattcgactagctcttgacgacgtggcccctcgcaggctccggcttcgtaggctgtgtgggttgtgttggctctgagattcgatcctctatgccctccccaggggtcccttttatatcgcaggtctggtggtctccgagtaggactcgaacacaccagacccagacccagctcaatacgtaggtaacccagttcttatccgagaaggactcttcccgtctattgatttcgtgaaaggtttccttagatcataaaggaaatatccgcatacgcgtgggtatgccatgtcgatacgtaacgtatatcgaagggtagagggtatgcctgacccgtaaccctgacagtagctcccgacttctgctcaaaatgaactcgtgcgaccattcgcgacttcgggtgtcgagaacgttatcattccaggtacgagaaccacggagatgacgtgtagtcgaacatgccgtttgaagcccaacggtcacgagtgaattttgaacttaagtcaaaaactgccgcgcgtaatggacctagaaatttccggcggggatttctctcagttccttggaattcgcaccgtcgggggtgcgcctatttaaagggattttgggtgcgcattttgaagtccgcccactccatcaagcacacaccgcccgttagcgctcctcgccttctccactgccgtaaagaaccctagcttcgtcagctttaggtccatctctggcgatcttccagcagcgatggatctcggcaagtcggcttccaccagcgcgaccctgaagaagctccaggaggatggcgcccttcctggccgtgaaaacgcggagagggaagcaggaggtacaaatcctcagcccatcttaggtcgcatggttgtgatcgaagattatgttgtctgcgggtttctctcttcaccctccgaattccttctgctggttttgaatttctatgggctttctcttctgcacttgaaccccaattccattgctttccttagtgtctttgtgcatctttgcgaggcctacattggggtagagccctttcttgatctgttccgcttttattacgagttgcgctggatggaacccaatagggtgtctggttgcgtcgggttccgacttcgtgacgggatgaagtcgcgctatgtccccttccagtgtccctcttctcgtagtaaatggcggaacaggtggttttaccttgaaatcaaggattcaaatccgatcctcgttgttcccgaggaacaacaagattctggtctggaccgccaagccccccttgaccccctctctccaatcgtttatcgacatcatcgatgatctccgagaacggggcttatcgggatatgaagtcgttgcagacttcgtcgataggcgaatccagccgctccaggctcgggcccacccggcctataactattccgggccagatgacgcgacccgggtttctcctcggggtatctttctcgcattcattttgatatgcttgtactcgcgttccttttcgacttatcaaaaattgattccttcttgacaggtctgagcagcgaagccgtggagcggcgtgttggtcaggtgatgatcagcggcccgactacggcgagcgacatccccgcacccttttgtgaaaggggagtgacggagcacgacgaagcaatcaatgtgagttcattcgataagcgtccgccttctttgctcaaaatcagcttatgacatgatttagtgtaggcccttcctttgactgatgtcgtcggtccgctcgcggatcatcaggtggcggcatctctgaaagagaaggtcgtcaaggtggcgtctgacgctgccaccactagtggtggcaaagctccgactaaggcgaggaaattctcgtctgtgctcggacaccgccgcaaggcggcgactccctcagtaattttcaccttgtcgtcaggttatgtagcaaggaaggtttgttctcactctatgttggttgttttgtaggcttccgacgtgtctcctccgcctgcgcgacgtaagcgcattgtgacgatcggcgagaagtaagtaaagaaacttttagattctcgtgtcttctgtttgagtggaattttgattcatggcggtttatagggaggcgcgggcgaacgttgctcgggccaagtccgggggaacgtctagcgcgtcccctgtcacggcgtcaacagatgtcgtgcccgtggtcgggagtcgggaggcgacgccaagcggccccgtcagcgatcccgctgggggtcgtggtctgccagaggccgtcctcacctgggaggagctccaagtcgaaatggggcgccttctcgaagccggtgctcgcggcatcggccgcgagatctcagaggcgagggcggagacggcggcggccaacgcgcgtgccgagcgcttggtgcgggaactggctgaggcccgcgaggacctcacgaagatgagggagctggtggccggcaacgagcgccagcgcaaggggctcgaggaccgcatgtcggaactcggggataacctctccgagatccgtggttcgctgcgggtcacctacaccggtctccaccagcttgccgaggagtgcggcatcaagtccacgatcccggcgaaccccgacgagttctcgttgacctcttctcttgcggagctggcgacggcgatggggaaatcccctccaagcatacggccaggatcgcggaggagacgtccaacggcatctataccggggcgtgtcatgtcctcgcgtgtgtgaggttgtcgcgtcctgaactcgatatgcgcgagatcttggatcagggggcggcaagcgacacgcgtaagaaggtgatggaagaagtcgatgacctgggggagtctgtcctccccctttttgaagagtaggacttcttgtattttttgtgacttgtaaatcttgaactctggttgccttcgtgcgtgtgattatcatccttgttcaccgttgatctcggaagttttttcttgtcgactgtagagatgctgatgacgaggatgtccagcagcgcgggcagcccgagtcactggcgataattccggtattcgagtttgaaccacacgtcccacatgacgtcgaggaccaaactcttgatgcggaggtcgaagtgactacaactgcctcaagtgagtagccattctaccttcgagttctacctttgtgttgttttggggatttccagcttgtcttagtggtcgttatgtttagcagatctcaaggatgcccttgcgacccaagatcgtcgtatccaatactggaagacgaaatttgaagtggtggaactcgagagaatcatgctatccgtgaagaaagagcaagccgtggaaacgctccgaggccgcgaggtgtggtttgggtcatacttgaagaattgttgcacctcgatggctagggtatgcagggagcttcgagtagtccgcggcgatcctgaagaatcggcggccgggtacatctcgtggctcaacggggcctgtgcccaactcgatggcatcggcaagcgaatcgacgaagccttgaagcaagagtgtcatcttgcgagccgatatttcggaggacatgtgttagcttgcctgcgagatcaccgcccacgcctggatctcgaattcctccgtgaaggtttttcttgttctcggaggaatccggcggagatagaccaccttgcgaggtcgatgtcgccgttggccgagaagattttccagtcaatggactggcattggctttcttggtagtatttgtaccctgcgaccagatatcttaggggaagatgtaatgcagcgaaatatttatgtacaaactgtaagaaatattttgtgaataaagaaatctatctttaacaaatgtttcttactctggatgtcgtgtgtatgagtgtgttctcagttaatgactttagttagccgtttgagtcgtacactctccctagcccccagctttgtcgtcggaggaattttctcggaggacaaggctcttggacccttgacctgtcttggttgaataagctctgatcctagcacccagccgtgaagttggaaagctcggtttccgattacacgacttggttaatacgcacggcgagaactcttacacgaccagatcttacatggtctttcgtctctaaaggatctgacaaggccttatcggctctaggcgtccccagtcgaagatcccttaggttcctcggaggccttgtcaagacggcgtaaagggacataaggacaggtttcaacgctaggtgtcgtcagagtaagggatcattgggtgaaaacactttggtcgtgacatgtgacttagaaataggctttattgatactgtaagggtgcttacaggtacagtggtattgactcatacatagaatttacgtagttggtcaatgttccacgaatttgctagttcgcgatcgtcgccgtctgcgattttgaatgcgcctggccgcaagacttgtgtgatcgtgtagggtccttcccattttggtgagagtttgttttgccctgcttgggtttgaactcgtctgaggacatagtcgccgatcgaaagtatgcatgctcggatgcgcttctcgtgataacggcggagggcttgttgatagctagctgctcgaacggcaactcgctcacgatgctcctcgagaaggtttacatcgatgtctcgctgtttctcctggttctcgtcggaatgcttctgtactcgtgtactttgatgtcgtaactcgccggggaacatggcttcagagccgtacacgaggaagaagggtgtttccttattggatgttgtcagtgtggtgtgcatggcccatagtactgatgggagttcttcaacccattttttgtcgtgtgacatgagtctgtcgtagacgcgggtttttatcccttgtagtactatgccgtttgccctttcgacttgtccattgctttgagggtgagagaccgaggcgaaacatattttgactcccaagccgatgcagtaatcctggaaatcggcgctgatgaattgagggccgttgttagttatgatgcggtgcggtagtccgtatctgcataatatacctctgatgaacttgatggcgttatcggccttgatttccccagtgggtactgcttcgatccatttggtgaatttgtcgattgctacaaataggaatctgtagccgccctgtcctcgtgggaatggcccaagtatgtctagcccccagcacgagaacggccaagtcagagggattgtctggagtgcttgtgcaggtagctttgtgtgcttgctgtggaattgacaggcttcacatcgctggactatgtcgcatgcatctttaaggtcggttggccagaaaaacccttgtcgaaaggctttgccgaccaatgtccgaccggcggcgtgtgacccgcatatgccttcatgtatgtcgaggaggagttgtctgccgtcgtcggtggagacgcatttgagaagtatcccgtttggcgcttttttgtataaatcgttgccgaccatacagtagatctttgctttacgggttattttctcggcctctgtatcgtcctcgggcaactcctcgctgctgatgaatttgattaatgggatgcgccagtcatctgtggtttcaatgtcagcaacggcgcgttctgcctcggtgacctccaagctgatgtcgggggtactcgggccaacttcaccgctaacttcttttaccgatggctttgtcaggacgtcgagaaaggtgccgggttcgagcggttctcgtctggatgcacgtcgtgctaggtcgtctggctcgatgttgtccttgcgatagacgtgtcggacctcgatcccgtcgaacctcttctcgagcttcctgacttctgcgaggtacttggataactcggggttggtgcatttgtagtctttgtgcacctggtttgcgattagctcagagtcccctttgacgattagtcgcttggccccaagtgcggctgcagctcgtatcccggcaagtagtccttcgtattctgcagtgttattggttgccctgaagttaaggtggattgcgtgcttgaattgatctccggagagagatgtcaagataaatcctgcccttgctccttggctgttgagtgcgccatcgaacgccattgtccatgtctcattgtcaccttggttgtctgacttattatctggcatggtccaatcggccacgaagtcggcgagtatctgagatttgatggctgttcgcggcacaaagtggatatcaaattggcttagctcgactacccatttcgcgatgcggccgacaacgtctttgtttctcacaacttcgccaagggggaaggaggagacaactgtgactctgtgggcttgaaagtagtggcgtagcttccttgatgtcatgatgactgcgtagagcagtttttgaatatgtggatatcttgtctttgcgtcatggagagcttcgctgacgtaataaactggtcgctgtattttctctgtctcgacaacaatgacggtgctaacggaatatggcgtggcggtaatataaaggaataattcttcattaggttggggagcaacgagtacaggggggtttgataggtagcgcttgagtgcaataaatgcctcttcggcttcctgtgtccatacaaatttgtcttgtttcttcaataaggcgaagaaaggctgtcctcgttctcccatcctagcgacgaatctgcttaatgctgcgatgcatccggttagcttctgcacctccttgagtcatgtgggcggcttcatgttctcgattgctttgatcttctcgggattcgcctatattcctctgccagaaacaaggaatccgagtagcttgcccgacggtacttcgaacgtgcacttctctagattgagcatgaggcgatatcgtccgaggttgtcgaacgtttcccgcaggtcgtcaatcaatgagtcacttgtcttggttttgacaacgatgtcgtcgacgtaagcctcgacattgttgccaagctggttgctaagtgcgccctggaccgtacgctggaaagtattcccggtggttatcagtccgaaaggcatcttaacgtagcaaaataccccgaacggcgtgatgaacactgtcttctcttcgttctcttttgccatgctgatttggtggtagccagagtaagcgtcgaggaagcttagaagctcgcaaccggctgttgaatccaccaactgatctattcgagggagaggaaagtgatccttggggcatgccttgttgaggtctgtgaagtcgacacacattctccattttccgttggccttccgcaccataactgggttggctagccactctgggtgaagtacttctctaatgaagccagctttcaaaagtttgtcgagctcttcttgtatggcttgttttcggtctggtgcaaatctccgcagtctttgctttactagcttggcatcgggtcgcaccataagtttgtgctcaatcacctccctggggacccccggcatgtcgcacggctgccaagcgaacacgtcggcattatcgcggaggaatgtgatgaacgcgagttcctatttctcatctagtgtagtcccgattttgatagtcttgtcggggttagcactagagagcggaacgatcttgatggtgccgtctggctttggcgtcttatttggcttgctcactttcttaggtggctcagacgtggcgggtggggtgggcgtttgctcgaccatgtcgaggctccgcttgtcgcactgcaccgccagctttgcgttcccctaaatagtgattgttcccttcggtcccagcatcttgagcacttgatatgcgtagtgggatgtggccatgaacttcacaagtgcagttctcccgatgatggcgttataagctgtatcgaattcagcgacatcgaaggtgatcagggtgcagccccctgccacgtcgaacagacttcacgttccactttcttgtattctcgcttggaggagtacgttgtggaaccaccgaatatgtgtgagacgtggaggtcggagtctgggtacgcagaatccgattcgtgaggaggtgtctccttgttcttctcaacaacgcgtactcgcttgcctttttcaaacgccatgtgcttctcgagcgactttttgaaaacaaggcaatcctccagagaatgtctgtccgttttgtgtatggggcaccatgatttctttgtatcgctgccctgtcggtctgggcgcttgggagggttcgcgtattctgctgcgaggacttccgcttgagctttccttttcccgtttttgcgatttttcttcttgcttgactcagatgcgtctgcggatagtttcttctctcccccagtcttcggcttgtcgttcttgcgtcttagcgcgtcatccacatgggctcaccgctcaacgatctcgaataatcttcgagtagttgtgatgcgtcttgtcgccaactcctgggtagtgtagcgatctctgacaccagacttgaaggcgagaattacagaagcgtcggtaatctcgggaattgtgtttctgcactcgttgaagtgccgaacgtattccctcaatgattcccccgagttctgtgttaacgcatgtaagtcgtcttagatcgcgtggcgcttgtatgttccttggaaattggcgacgaactgttgccacaggtctgcccacgaggagattgagtagggaggaagatgcatcagccatgaacgcgcagaaccctttaacgcggatggtaaatagttcgccaacgcgttgtcatctgctccggcagcataaagcactgtcgagtagacttgaaggaattcttctgggtcggtgctcccatcataattttcaatggctctgggtcggaatctctcaggccatcggacatcacatagggaacgaccgaaagccctacacccagcactgggggcggtggtttgtcggcggtcgcgtgaccttcgtggatgtctgtccaacgatgaagaggacgcggatgatgacgatgacgatgggtcgcttggttctggcgtacgattacgaggatgacgacctggatcccgggcatcctgtcgttgtctctcgctgttgtctcggcgccgatcgccttcgtcgtcgtcgttgcggcgacggccatgaccagtattgtctggcccccgccgttcgcgatcgttgtagtctcggtcctcgtttgggcgatttctcgatcatggcgtcgtgaagagacatgacgccgggagcgatttgcgtcgtcccatgtgcgtcgtgcttctcggcgatcattgatttgatctcgaagatctccaatgccacgaggtggaggggtagcctgtcgaggtaattccctccgctccggatctttaccattggtgtcgccgatcggtggctgatcttggtgtgctgcggtagcggcttcttcgaacgcattgctgaggttggtcaccgactcccgtaatcgttccgtccaacgctcgaggtcgtcgttcagaacgggatcgtaaggagtttccctctgtatggcttgaacaaccctgatgtgctgggctggagtagtcgattgatttgccgcctctgcattggcttgtgctgacgtgccaacgtcatcgatagccaatacctcccgcgacgcacttgttgtcgatgacccacagtcttcgaggagatgtaagaccgatggttcgtgggggtcgagatcgattaccccaacgaatcgatctgaggctggagtcgctccttgttccttgccgttatccctaacggggacgtatgacttaggagacggagttttcacggcgccgaggagaactttgcagctcgagaggtcgtgattctttgtcttgtggataggacaatagacatcccgagttagagaagtacgctgaattccgcgttctttgcaggcgcgaatttcagcacggacattgatgaatacctagcaatcttgaagggtatgtttcttggttttgtggataggacacaaagaccagataacttcggaagtcatctttgttggcccgtggtttatgtcggagggacaagacttggccgcatcagaatccttcacgagtttggatgtagtcgataatccgttctctgtttcaacgggtggatttttcgacatggagccgtcctggttcatagccactgcgttctcgtttccagtcattggaggaccggttgagatcggcatcgtggtgtaaaccgggaagacgatttcgccgacttgagtccataccagcattattgaagctgagagtgcttgactggagctggtgttgacgttgttgtcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagga

SEQ ID NO: 41661 - DNA, 14347 bp, Oryza sativa
aaaaagcatcatatcatcgtcctcttctctcctccttttaatttcatccgccattctcgaactgattttatcactaaaagagatatagaattactatactttaaactatgtgtgagaacataataatatgcatatgtattacaatattattaaacatgaaattagaggcattcaaggtggctacatgcataaatacttttaatactttcagcaaataaacagtctgcaatggaaggagggggatcaataatgtgttcagattttgactagttccagaagtactttgtgtacttagttttgtttaaacctcagagatagcaactttaataaagtgaggatatccttctagggtaggatgtttacttgaaaataacagcctcctgttcactagcaaaaaaaaactgagaccatctgccacctgagcaagatcacataacattgtacctacaatctctctctctctccaacttcaaattacttctgttactctagtaaatatgcaggggcaagattaaatgcttcatatcaggcaaatgtaagtacaactgtatttagttttttctcaaataccttgagtaatatcaactccttcagctttacttttgccaaccccacacgcctgtgcctctcctgaaatttaattcagcacaacagattatatttttgtcattcaatagcaatttatatagctttgtatggtatgacctctagtaatatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaattaccaaaactagaatgtatactacagtgtccacctgaccacctcatagcatgactttaaaaatttttgtatcttcttgctcattcaattggcatatagtattggtcgttcaatctgaagctcaaatgaccttggccaaaagcaaagtgatgcattctagacagcaacaacagagtgcactagtttttattttttaggtgtgctcccactgcatctacaataattcctggagaattaacaaaccaggtttctccctcacaaaaaaaagaaaagaaagaagagagcccatgttcagaaatataggatatgccaattcaaatatatatttccttgattacagagcaactgataggcaagatttgcgcacacacacagagatgtgcatggaattttctgtggtttcaggttctactactacaaaccacatcacccctccttctaagcagaacatgactgatacttcaatccatacagccactcaatacatcaactagcaacaaattcatccactagataagtcacaaaatcttttctgagtgggaaaagaggagatcaagaatcagacctgcttcttggtgtccgggctgttgccctcgaccttgccctctcccgcaaccggtgaatccgaagcgaggaaggagagatggcgagcgccggcgactggctgggatggagagcgggaaggagagcggtggcggcggctgaagcgggatggagaccggcggcggctgaggacgggatggagaccggtggcggctgaagctggatggagatcgtcggcgaccgagggcgggatggagagcggcagcggctggagatatgctgctcctggatctccaccctagagccgcctcccggacctcgcgtcgcctcccggacctcacgccgcctccaaaccctagcgcagcgaggagtcgaggaggccgagcgctgcggctggcttggaaaaaaaaatcgtctccgaggcgatttttctctccccgtgggattggtgtggattgggtggagaattactcccaccccggcccaggcgaacgcatacatgggccacggaagaaaattcgacccggccgggatggcacacggggatgttggcccattcccccccaaacccagcctaaaagaacaaggcctgaagattgggggccctgtgcgatcgcgttggtcgcactcccccgggacggctctgagcttgaataaaaacttctgcacatataaagattccaacgacagtaaggttgtgacgttgtccttccacgaggcatctgcatagcatctggtgcctaacggaataggcaaacagttgtgaaaagcatttgtattatctgttagagtaaaatccatcaccggtccctaaacttgtaccgctgtgtcatcctgatccctaaactcgtaaatcgatcgttcaggtcctcaaacttgtttgactgtgtcatcccggtccctaaacttacagatcactcgtttaggtcctccaacttgttcagttgtgtcaccctggtctctaaacaggacggtctaaaaactttatattaaaaaataattcataactttttcatgtgaactttaatgaagataaactttatatcaaaattgtagccctcgacgcgacctacaacattgtagttgagaagttttttaattaaaactgtttagggtcccaaaatattgttgcatgtttatagattttgaaattttaattttaaaattacattttgggaaaaaaatgacttaaaataaaaaaaaattcaactacaaagttgtagatcgcgttgagggctataagtttgatataaagtttgtcttcattagagttcacatgaaaaagttatgaatttttttaaatataaagtctttagatcgtcctatttgaattagatgatattcaaatccaagtttagggaccagggtgacacaactgaacaagttggaggacctaaacgagtgatttgcaagtttagggaccgggatgacacagtcgaacaagtttgaggacctgaacggtcgatttgcgagtttagggactgggatgatacaacggtacaagtttagagaccggtgatggactttactctatctattattacctctggttcttttgaactttgtagttgcgtcagttgggtgtaagtagatgcagcattattacatatatgggattatttggatcaggtgcagtcacaatagtgaccgtaacttgcagtagtagtacgcatcattggatataaattgaacggctcaggtcgcacatggtactgttcatattatcgtatcagcaaatactgttcatgtgggtactgtagcttttgatctgaaccggtgatcacaaaaatggatggtcgaagttgtgtgcagttgttaaatcacctaatcccaattcatatacgtggtatggctcccattcctttgatttgaaaatgtagtcatttatggctttccaaatcttcgaaagcatgatagagattttttatagcgcattttcagttttcatagtagcaagcaaataagccaaaatatcttgcattgtctgcattggtgtgagagcatctatttgaaggtgaaaatcagatacaaaccaagttagccttgaaaattgacaatgaaagaaaaggtgaaaatcatctacctgctgaccacatcttgaacaagttgaggcaatattagggaaattgtttttccaaacttctttaagaagattgattgttaaagtaggaacagagggttgatgaggatgaagatgagagtgaacttctttgtaagcacttttttgttgcactcacctgattgggtatgtttccagcaaagttggtcctccaaaacttgtggaataatttgtacctgtaagattgattcagtagctttctgatcaaacatttgtgaaattttttcagtgtcccatctcttatatatcttgataaaaaaatcagcaatatttataaaggcaataggtatggaagagtatcgaggacaaggtgaacatgaagacatgggtgcacagtgaagatggcatggacacggtcgggccttcacgctcgtgccaaaatttggtaaggctattttgttttcaatcacaggacgagtaatttcaccgtccttaagaaagtaggttaaaataactaaattttaaattaaaatttttttggtaccttgagatatttagtatctagagatatcaaatttgtcattaaaaatatatatctccagataccttctcaagaatgataaaattattcttataggactgacacacattactacacacgcaatacgttcacatactcacgaatgcatctcctaacaaacggcacattcctaatattgataaaattatttttaaaagtctacttaattacgcatgtgtaatatccgttggcacccaaacttgaatatcggttggtccctaaaattaatcttaaaccctagcattccacgaatattttaaggagaaaaacaaaagaccataatgcatttaattaatataaaagttgtatttgttgaatttgtagatgtggggtattgaagtaatgaaatttctcgttttgcgaattggtggtagccaagaaggtagaagttgatttattttgcgacaaacttcaatctttataagttggtttatttcgggacagaggggagaagtgccgtacaagatgacctggttgtccagacttattaattaacaaaataaaacacgtgtagtgtcgacgtgtagtgtgggcatgtcggatcggcgcgcacacacacgcgatgataacatgatagccagccggcaggtagatcgaaaatataggaaggagcttaattagccatggatggcgcgcaggtagctgcttcattcagttgcgcacccagagcatgtcgtcctgaggcaggaagtggcagactgccaccttcccgggcgccacgccgagcctcttgtacgcctccgccaccgccacgccgtgcccgtccacgtccccgtggcacgccgccaccgcctccgccatggtcccgtcggcgccggccagcgtcaccgtgtacgccgcgcccttgatcccgtgcaccccgaacacggcgtacgcgtagggcatcctgtggcatgccaccatgtcgcccccgggcaccggcacgggcctcacggcctccaccctgtacgcctgcctcggcgtcggcccggccctgttgaccacctccgtggacacggcgtggacgtcgcgggtgccgaggctggaggcgacgagctcgaccatggactcgagcgacgtggcgcagtagtgcttgtgcttgggcgccgtctcgctggcgatccgcgcggcctcgcacacggcgagcgtggaccgcatggcgtcggcggtcggcgagccggcggggatggagagctgggagaggatctccgggagcttttcggaggcgaacgggacggagtcggcgcggccgcgagggagcagcgcggcgccggcggtggcgcgggtgaagtggagcgtcatcttggagcccgggaagaggtccttctcgaggaagaacacggagcccaccgtatcctccttatccttcgaagctgaggccgctgagctcgccgggctgatgaggtcgcgaatggcgccgggcatcggcgaggtcgggagcgcgatcttccagtacatctccgccggcgacgcggcatggctggctcccgcggctgcgacctgaaatgcagtcagaaacaagttgaatttaaaacggttaacttcagatatatatatatatatatatatatatatatatatatatatatatatatatatatatatatatatagatatatatatatatatagatagatatatatatatatatagatagatatatatatatatatatacctgaagtcagaaactagttgaattgaaaactatcaaagccaaaagttgcaactggaataagtactaattgtattacgttctcatcagaaattcaatgaactccatatgttgatccatcaaccatcttaaggtaaacatgttgatccagttagtttaaaattttagctagggttccccgcaaaaaaaaaaggttagggtacgtaattttaacttaatcttcaatctctaaataatatatatctctctcccaacttatctctgttctaggcttctagctcaaaacaactaaaccatacaaagagcgatatatatgtgtgtctgctcaccagaaggagaaggagagcagcgagagacctagccatgctaattaacgagctgtcaaggacacaagtatatgatctaattcactgataagagtgaaactgagcacaagcagttcatagcttttgggagctatttatagatcagggaagcgggaagaagacgaacaaataatacattgcattggccccactggattatgcagaataaaaaaatatgtcatgtagcaaagatgctatatcacattcacgatcatgccggatatctctattattgagcaactaggagggtagcctgcgcattcgcgcgggcatatattgtagtgtatttcagatatatacttataagtaatagaccgattgtgttaaatgtcgtatttgttatatagcaaaatatggcatattgatattatatatattgttggtttgattataaacagagtaatagttagattagaaatcagacgtggagcttataattattgattatttctcttttagttatacaaaataggaacgagagagtaatgaaaagcgtagagctcgagctagagtgggtgtgtagtgatggacgcatgtgagggtgatgtggagtggatttttttttgtaatttttctaattgatttaagtgaaagccaattattagatgttattttccttggatttgtaagatttttttttaaagttgtaacatgtcatggattaagatttttataaaaatagatttgatagttgaaaataatattagtgatacgtggtaacttaatatggctctaaaaggttataaaagttgactttgtactttcctaatttttattatgtagaatgattaacatgacataatacttgttgtcaattttttaatatttcagtgttgtttgcttgttggcctatgttcaaattacgtattttaaattttacatagtaaaatatgagtaatataaatcaacaattcaaataaattaaaaatcggatgttattaggttgtcattgctgacggtagttatagaccaattttgactgtcaatacttttgtagataatggagaactagcaatgcttgcatgcatatttatttagaaataatctagttccacttgtacttgataaagtaagtatttgtttacaagagatcatcacataaatggaggagaaatgattgaaaataaccgtttaaccaatcagaggtcgacatgtggcagatatatggatggatgtgcccagaatctcattgaaacacctacaaatgggcccaaccactatgccactgggccgaggatctgtcaggagacgtctaggacgaaggactggcccagggaggccaaccacggttcggccaaccttgggttccgctgacccatgcctggctccgatcgcccaggcccaagccgaaggcggttacataccgatcttctaatgacggttgtactggtattggcgctccaatcatcatactcaatctataaaaggacctccccaacttcacttcaatacacaccaagaaggaaatcaagtgaagaagctctcttaggctgagttcgggaatgaggtttgggaaccctcactccctggcacggaaaacggagcagcgattagggggtaattaactaagtatttgcttgttttttcaaaaatggattagtatggattagcaaaaaatacaccatttagcagtttgaaaagcgtgcgcgtggaaaacgaggaagggaagttgggaacaggaggtaacgagcgcaaccctagtttacatattttgctctagtgctagtagagttagaattaaatattcttccttagttcttcatgtcttgcagagaagtcgggtatggttctagtagctcttcctctcttgtaagactttattcaataattaaatattgttttttatatagttttggtcctttactatacttgcataattattcgagtaccaacttcggtttatacttgactcgtatttattatgtagctagcttactggagatatgcaatggtattggcttagtgttcatttatttggtaatatttagtaatgtaagcgcggtgattagattattagatatcattaagtggtgctatatgccacgcatacgtaaagataggccgctgatgctgacaactcaatacgtgtattcgttcacgtgcgtagatagggctaagaaaggttccgggtgcgggtacttctccatatctttaaccggttggatagtcatgacggattgtcgtaagaaactcgacaatttggggtggtttctcgatataccagtaggcatagttgtacattagcaagcatatactaaaataactatatattaaaaatatagaaatgatgcttttctttattcttctctagttagcctagacttataatttagtgagagtactctaaactatcccttctatgtgtcattcctctccccttcctactttgtatgactaaaagagaaataatctataattaattataagctccacgtctgatttctaatctaactattgctctgtttataatcaaatcaacgatataagattcatatacctatattttgctatataacaaatacgacatttaacacaatcagcctattacttataagtatctcaaatacaacctatgatacatgcccgcgtgagtgcgcgggctaccttcctagttttcctaaaagctacaactacaatagctcaatcttccctacaagctgaacttctggctctacaattgacaatataagtggcgatatttcttgattttgcaggtaccatatttttaacggacaacgagacgatcgcaaatacaatgaatatgagacattttgaagctgatccagcctattcgaatcttcagcggttactgagttaaattcaagcaaatattccttttagcttattgcaggtgttgtggtcttgtggataacgagagaggtcaatcgcatggctgacaagttagcaaaaaatgcgagagatgaccaatgaaatccagcatttgttttgccacaatatcgccaacctagcttatccaagcagaaggtgatttgctaaggatatgaaagaccatttcagtacgtactctaaattgtatgaaaaccatgtaattaatatgtttgagcaatggaataaagtttgagttctaaaaaaaattgcatccttttcatgttctaatgcatatcatctagaatatgcttaatgcttgggctggaatatatatacacggaatggtcatcgtaggcgggcctggcctgagtaaggtgtaaacatatccgagcccttaaatggccttcctgtgaaaaaccaagtcctcttcataggcagccagttttacagccagcatactatagatgaaaacggagcggataattcatggatagtccggataaagatatttttttatatgaatgtgaatatggtatatcagagttttcgatgaatatgaataatagaaggatatccgatgaacaaaatgctattcagatatccactgaaggcatgagacatatctcatttctttctaactctagaccttcaacttacttctttagaattttaatagtagcccatctcatgatactagcccacactattaatattacttaaatatttaaatatttttttgtaaattttactatattttatattataatttcagttagacatgtatttatatcaactctgatgtacatgttaaacttaattagcattgttgactctatgatcaaacttattatataaaacgatatatttatatatgatagtatttgtttctattagaaattgaagtgtttttcatgttctgagaaatatttatttccctattcgtgtccgatcatattcgatctttattcatattcgagataattcatatttgttttcatatccgagctttcgtattcgttttcctatccgacagaaaatacggaaagaaatattgtataagcattatccatccatatccgctccattttcatcctaagcacatacaggacactcaggagacccgcttgcgaaaaaaaactcaggtggagtgcttaagaacctatttgtgaagatgactttttcgcgggcagcccgtatactctcgggagcctatcgtattaccggcgagccttctcatggccggaaacggatcctctgactttggatggaaagtcacggtcttgcaattcacttcatcccagccaaccactgcatccaacggcacacatccatcttcccctcatttgcctgcatatgttgggagtagctaagaaaatattttacgtagtggtgtatacaaccgtgtaacattgtcatacaagatgtatggatcgatgaatcgtacatgcagacttattaacatgctgccacaagtatagtagtggcatttcgggtcgtcgcatacacatatgataagacatgatacgcatatagctccaaaatataggaaggagctatcttgagatcacacaatttttatcccctttcacgcgcgcgcgctcagttacgcacccagagcatgtcgtcctgtggcaagaagtggcacaccggcacgctcccgggcgccacgccgagcctcttgtacgcctccgccacccccggcgccgcgtcggcgtggcacgccgcgagcgcctccgccctagtcccgtcggcgccggagagcgccaccgtgtacgccgccgccgtggtcgtgtggcacccgaacacggcgtacgcgtaggccatgccgtggcacgccaccatgtcgccgccggacaccggcacgggcctcacggcctccaccctgtacgcctgcctcggcgccggccctgccctgtcgacctccgtggacacggcgtgcacgtcgcgggtgccgaggctggacgcggcgaactccaccatggactcgagcgacgtcgcgcattgcttcgcctcgccggcgagcggcgcggcctcgcactcatggcgtcggcggccggggagccggcggggacggagagctgggagaggatctccgggagcttttcggtggccaacgggacggagtcggcgcggccgcgggggagcagcgcggcgccggcggtggcgcgggtgaagtggagcgtcagcttggagcccgggaagaggtccttctcgaggaagaacacgttgcccaccgtgtcctccttcgaagctgaccccgctgagctcgccgggttgatgaggtcgcggatggcgccgggcatcggcgaggtcgggagcgcgatcttccagtacatctccgctggcgacgcggcatggctgtctcccgcggcggcgacctgcagtgcagtcagaaacaagttgaattgaaaattattaacttgatttcaaaatatacctacttgctagctaacatgcatacatacttatgaaccaaaagttacaacgaaagataagtaaaaaaaaacttatattacgttctcatcagaattcaatgaactccatgttcatgagttcatccatcaaccgttttaactatggggcatatattgttcctgttaatttaaattctagctagagtaatttcaacttaattttcaatctctaactaatatatatatctctcaccagaaggagtaggagagcagcgagtgacctagccatgctaaataacgagctgtcaaggaaacaagtatatgttctaattcactgataagagtgaactgagcacaagcaggccataaattttgggagctatttatagaggaggagtgggaagatgacgaacacgtaatatattgcattggccccactgtggatacggaacgaaatatatacatatcagtcttattatcagatgtagcaatgctgctactcgatatatatatcgcattcatgcgaacatgtcggatgcctctattattgagcagtctgatagcttaacagcaatcattctgtggctggggttacccgtgtccttctcgatattctttgaataatccaacatgcatgtctatttctagtaatttatggattccccaatagagagattttagtttggctcagttctatccatggacgaggccatgagaactttttttttttacaagcggttcaaatagttatgaatgtttttttttcaaaaaattacaaaagtaggttattgtatcgcatgttcattgaaaaacaatcaaattcaatatatgcatggagtaaaaaaaacaaatcaaattgtaaaagtaaccatatatactttccacaatttgatttttttctcgatataggtattgaatatgaacttgtactaaaagacgtaacagtgccgtaggcaacaaatttaatgaatcatagggaacactcgacgaatacaatccctgttggtattaatttgttatggtcacacataaatctgcaagtacatagttaccgatatagcatttcacatcagagtattgtaagtgtattgaatcacaagaagcatatgtgtataatccaagaaataggatttttctaaggacaacaattaaggatttttctaaggacaacaattaaatggtaggcttaggagagataggattcctttgggtaaataatcttagttaagttaaggtaaaactctattagtttttttgagcatcggttcacccctgtttgccaagggactccgacctgtagctctatgatgtacccgaacgtggaggattaagaagaacggacatatttgtcacagctgcctataattccatggagcacacaacaaatgatggtaacctctaacctagatagcacctctacaatattgattacaactcggccaaaaacttccttctttatctagagtcttagtactagagtacttaatataaatactaagcgatgaatccacaatgattagaatatatcttacttaaataactgaagtaaatactaaagaaaatcatgaatacttacttatataaaagaagtatttgtcgaggtacaagataggagagagtgccgacatctctagcaatcctccagtacaccccatggagagaatgtcgacatgcactcctccgaaactcggagggaactccgatattttgggcacttttttcggagctttccctcactatcttcctatattctaactctactgtagagtaggctaaatataaaagtgagttgtactcaactttttggtgttttgagagtggaaacttctccttatgtagcttgggaatcaagcataatcgccattgtggaggcctgaggaagtgacacgtggaagctggcggtgattagtcacactccaggtttgactgaaccttggttcagaggaaccacattcaccgcctttcttcatcattttcgcctcagtcactatcctgtgggtcctcatgacggtgcatactaaattcgcttcaattatgttagtttcatatgattagttagcccatagattggccagaggtgtgtttctcttcgcgtggagggtggttttcatccataattacatgcatacaaatatttcttggtatttcttacgaccacagataaatccgcaagcgcacggaataccgctgtatcacttcaccttcgggtgaccccaaaaggatatcgaactcaaggaacgtgtgtaatccacctaaggataagacaatccaaggacaaggtaggctaggtaggctagagaggactttctatgtgttttaattatctaagctaagcaaaggtaatttcctatatgttgcttcgggcatcgacccctgctggtctaccagcgtggttccggctatagctctatgatgtatccgaacatggaggattactgagacaggattcagggctgtcaccacctgccgcctacctctgacaaatccgtgggatacacaacaaacaaaggtaatctctaacctagacaccacgtctaagttattaattactactctaatacttgtacaggaacttctttctttatctagagtcctagtactagagcacttagtatgaatactaaacaatgaacctgcaaagatggaaatctatcttacttagactaaataattaaataacataagaaaggaatacaaatgcttactttttagaagaagttctccgaacctggagcagagtgtaccgacaactctggtactcctccagaattcctcctaagaagctacactcgtcgaggtagaagtcggatgagcgccaaacttccgggcactcctccagagcttcccctcactctctaccttattctaatgtacaaaagatacaatagagcctgttgtaattcagctcaaagttgtgtctattggaatgtgagtgagctcctccttatataggctccaaataacggttaggggcatgggaattgtctaaaacaccctgcaaccacctctgggaag

SEQ ID NO: 41662 - DNA, 1151 bp, Oryza sativa
atcatacatctatggccaaaagaatccactccaccagatctttgcgtgtgtcctgaatgctccatagtgacctacatatggggcagcatgacacttctcaatgatctgcatgccttcatctgccggaacgcatctccgtagtaagccatctgaacaaactctgtaaaggtaaggtgcatcccacaagtgcctacggctctcgtagatcaacttcttcttattttctcccagtggtacatgccccgcgaccatgaagttgacgatggttgcataccatgggtcagagtctgtgactttcaacagcatgtcgtctcgcggatagtcatttatcggtagctcctgcatgttagtgacttgcatacgcgacaaatgatctgcaacagaattctctactccctttttatccttaatttcaatgtcaaattcttggagtagaagaatccacctaatcagccgaggttttgcatcttttttagtgagcaggtattttagtgcagcatgatcagagtaaacaattaccttagctcccactaaatatgacatgaacttatcaatggcaaacactacggctaggagctctttttcagttgtggcataattaagctgagctctagtcaacgttttactagcatatgctatagcatggtgttttctatccttagtttgtccaagaacagctcccacggcaaaatcactagcatcgcacatgatttcaaacggcagcgatcaatcaggaggttggatgattggtgctgagatgagtgaatccttaaggattttaaaggactttaaacactcatcatcaaagtcgaacggaacatccttagctagcaaggcagttaagggtctagcgatttttgaaaaatcctttatgaaacgcctatagaaccccgcatgacccaagaagctacggactcccttgacattgacaggaggtggaagctgtcgaattacttcaatttttgctctgtccacctcaattcccctttcggagatttgatgtcccaggactattccttcacgaaccatgaagtggcacttttcccaattaagtatcaagtccttttcttgacatctttgtaagaccttgtttaagttctccaaacaatgatcgaaggatttaccatagactgaaaaagggctgcaggaat

SEQ ID NO: 41663 - DNA, 963 bp, Oryza sativa
gaaagttgatctaaaatatcagattaatccattttttaagtttgtaatatttaaaactcaattaatcacaagttattatcacctcgttttgcgtgaaacacttaatctttatcttcctaaggagattcaaacaccacttttgtagcctttaagatttgccccaaattataacaacttcttcaccaacattctttttccaaccaatcacaaccctccaccattcaatttttccacctacctacacttcgcatccaatcacaaacttctcccatttaattttttttaacttgttaataaccgtcttatattctacaacggaggtaatattacttttttggacctaaaagcagaaaagcacatgtcactggtgcagaaattatttttacaggtggcgcattacccctttacgtgggcgtttctcaacccgcctctaggtgaggcttttagaaatcagctatttttgataggtgcatgaaagaacaccgcacgtgaaacaaatttagtctcagcctgcaaaactacgattttcacaggttttttcataaaccggccgctagttgtgttggataattgaagaataaaataaaattgcagcacctatgcagcattgcatgcccatagggatgaaaactgagcagatatgaacaaataatgccataccatatttgttttttttattttcttccagatatgaaaacgaatatgaatatatcacatatggaaacaaatatgaattatctcaaacacaaataaggataaaatatgatcaggcatgaatacataaacaaatattcccttgaacatgaaagccacctaatagaatcaaataaatgtctaattgatactaaaatatataaagtatagtataatttataaaaatatttataggtctaaataatattaataatgtagactactgattaaagaagtagctaggttgaaggtctagagctagaaagaaat

SEQ ID NO: 41664 - DNA, 10234 bp, Oryza sativa
attcctgcagccctagtccttttaagagaaacttgaattttagctctttaataatatcattgtaagtttgaaactagtctttattgctaaattcttttaatgtaaactattaaataatctcacaaataagtatcatctattttactttgaaaaagatgagaaatcacaaactaattttgtagatcatgtttattgctaatatttttagacttgctaactaactaaactgataatactttcaaagcaaaatttgctacaggacattcaaaaaacgtgtaattagctaggagacaccacaagaatgtgtatttgctatagagcatcgtaaaaaactggtaattagctgatggacaccaatgaaattattttattatatttgaaggaatatgagagagaaacaagcattaaagaccagtttacccttgcctcaaattagttagtcttcactaatcacatattctcatcgccaagaaaagagcaagagagaggagaagacacggctggccacgccaccgtcactctctcgagcgcagcagcagagtcgtgtcgtttcctccgagggcagcagcagtcaccactgccaccgccgctttctcgagcgcagccgtcgccgctcccttcacgctgccgttaccgcgcaccggaccacgcgcaccctctgcgccgtcgtcgccgctccctttctccgcgcataggaaccatcgtcgcatctcccattttccggaagaagcaaccgccgccgctgccgcttcctttctccacgtgcagcagctgtgctgccaccacagctccctccctccgcaagttgccgctgcgccgccatatgaccgtgcgaggcgtggcgtcggcgccggcgggcggaggcggctgttcggtgcgttccggcggctgcgggtgcggtggctagtggcgttgtaccgccgctcgctgcggcggctgcgcgcgtactacaccaaggcggtccaagacttcctcgagggcgcgacggccatgagcacgctgcatgcactcgtaggctgccaccgactgctcgtttggcgccgtgttcacgccgatggtcgtcgtgaaacaataacaccagtggttgccgctcctccttcgctcgcaggacatgaagaaatggagcagtagcaccggtgacggcaggcgagcgaaggagcggcggcgacaggcgagcgcagctggtggagcggcgacggcgggcgagcttaggaggagcggcggcggtggcaggcgagtgtggcgggcggagcggcgacggcgacggcgacggcgggcgagcttaggaggagcaggagcggcgggcgagtgccacgacgacaggcgaagcggcagcgagcaaggttgaaggcagcggttgagagcagagagagaatgagagagggagtaaaggatatggaagaaaaaaagaaaaagaaaaaaaatcaaagggtagaaccgtacttacatagctgtttctctcttcaatttttccagatataataaaataatcccacgggtgtccagcagctaattaccacttttttgtggtgccctacagcaaaaacgcgttcttacggtgtctcctagctaattacacgttttttagatattctgtagcaaaatttgcctactttcaagctacacaaaataaactagataaatacttatcttagctaacttaatatagagtaaaaacatgggggtgtagtggtggtagtgtttggatagaggggtgttggcacctttagcaccccctacctgcgccactgcctccagccacgcctcctcctcgccagtgtcgcccgtgaaagctgctcctatcgttgccctatgcagaccatcgtatacactccgccccgctgattaactccgcctcggccttggcctctgcctccacgccatccccggtcacctcttcctccatggccccctcatccttgtcatcggcgtcatcaccatcctcatcagagttttaaataaataagttgttattttttattgtttttatatgtaaatcattttacatatgctacacaaaacattttgcgatattcagtgtcaaagaaatattttatgatattatcttctgttttaagtgattcccccctcatatgcaaaataaaaaagaagagtagcctttcaaaaagaagaaaaatacatgcatgaaagaaaccttaaaaaatatacagaaacttctatatattttgtgtagagcctagagaaattcatatatttttgaagagaaaaactagcgaagatgtaccgtccattaatggttataagaaaaggacatccttttttatcgcttggatgtaacctttgtgcgtaccatatcctatcttcctatcccttctttctatatagttaaagacccaaagctaaattgtggttgagccacgtcacctgtaaatctcagccattgaatatgatctgaacgcttggtaacgcttcaatcccagcccacttctccttccggcccgtttggttggggggagtttttagaagggattgggagtttagagggatgaggctattaactattttatttggttgggagatatgagaattttggtgggatggggatggggaattgagaaatgaactccctccttttcaatacctggatagggggtggtaattgggagggaattcctcctttacttcgcctaaacaaatctcagccatccgttttcattaatgatctgatctccatctaaactccctatcaatttccaccacctaccaaacaagagactgggatgaaaaatcaaattcacatcttaatctcaccatcaatttcctcgtgtaaactcccaatccccttccctcaagttaccaaacaagccgttcattgccatccgccctaccgataccgccaccagatgtggtcgcgctcccttctcctgcacccgtgctccttctccgccccgcacggcgccgcgctcgcgctcttttctgcttcgcacccgagcgcgcgtgagagagatgcgccgcggagcgctccttcccctcgatcccccgctgtcgctgcgctctcttcttctctgcccccgtgcgcacgcgagagagatgcgccgcgggcccgccgacccccgccgcgccggttccccccatcgcgcgcttctcctccccacgtcgcactgctccccccatcccccacacggcagccacgccgcagcgccgcgcgcctgtagccctagccaggtgcggctgcaggtatcgcgtgatggaggatgcgctgggagccctagcgccatgccggtattcacttccttccttaatcacccgcatttacaatagaaactgccaaatcaattgggtgaggaggcgaaccgccaaatcaattgggtgaggaggtgcagtggttaatacaattcatgtgccccttctgatttgtcttttataattctcttgcaaaccttttgataggcctcttgcaatccggcctctcctcaaatccatacatccctcacatcaaccgttctgtgtgcaagcctcaaccacgcaccccttcatcctacaagggcacatgattgcaatcgagtcatgtaaggttagttgtcgacaacctttatcgattcattgcatgtaagcctattgactgattttatatgtctgaattggttatttgccctgagtactgattttaatttcttaaaaaaaatgtcaatttattctatttggtaaacctgaacttgatatgaaatttgaccggattctatttgagtgtgcattatgatttaaactaatctgaggcagtatgaaaggtctgtcgattggtttctctgaactaaaagaaattaatccctatcctatacactagctgttgttttagtttgtttatgagagattcgtgatccctgcatcctatacttatacttcctccgttccaaaaaaaggcaaatcctaggtttccgtgtccaactttgacagtccgtcttatatgaaatttttttataatttatattttcattgttgttagatgataaaacatgattaatattttatgcgtgacttgtctttttaatttttttcataattttttcaaataagacggacggtcaaatatttggcacggaaaccagggtttgtcttttttgggacggagggagtatgttctaacacttcaatttatttgagcagttgggaaggacccagaggattgctatatagttgtcctgacatagcgaggagcagcaacttactcggtatgtatttgtcggctcttcgcacacaattcatgtttttcctacgactttctataaatgtaaataaataatctttatcctatgcactggctatttttccaattacttaagaaaaaaaccgtgatgcttgcagcggatacttatatttcctaccactttagtttgtttgagcagttggggagataccagggatcgctacacaagtgtcctgatgtagcgaggaaccgcatacctgctcggtatgtcttctgttcagctcatcctgtgaggcacttcagtacgtgtgaattccacatgatttttgtctcaattaaatttcagtatatattgaggtaaaaaaaaagatcatgcagaacataccgcatttgtcgcagtgaaagaacttatccacaccaccagttctgaaaaaaattgagcatatccaaaattgatcaaactgaataaaacagtaaatgcagaaaataattcatagagatagatttgggacttgcctgcatatgccgcatccatcacagtgatactggttctttgagacctggaacaaaccaaacaaatatatttgtcaggatttatgaaccataattgccacattagaaacttagatgtaacgtagaatcatcatttataatccaaaaatgcttacatcatcatcaaagaagttgcatttttcacagaagtatttccccatgcatgccccacaaccagagcagtactttgtacccgtcgatcaaagcgaacaattttcatgtgatcagcacagaaaaaaaagttagcacactccagaaattctactgttgtacactcgagaaattctactgttgtactgttgcacgcgcaggaaagctatgcactgagtgctgttttcgtttgttaaaaaagaaactatcctatgcactggctatttttccagtttcttaagaaaaaaaaccctgatacttgcagctaatacttatattccattgactttaatttgtttgagcagttggggagataccagagaattgctagataagtgtcctgcatagcgagggatcgcagacctgctcggtacgccttctgttcagctgatcctgtgctattcctaaaaagatcttgctgttcctaaaaaaattctgcttgcaatgtttccagtataagtttgagagattttgtgattgtgactataaatttgcaactccttggacttgaaatgagttttccttgcttggtacttttagcaattaatgatgcaaatatcatatttaattggtcaagtagcagaactactcacttttgaaattatatactatgttatatcctatttggtcaggtagcacaactgcccacttatatcttcattcttccctccataatttttttatacattttaatattatgtgtgcatgtagctaaatctaaaggagtttttgttgcttctaatgttcccaggtcatatgttgaaaggagtaaaacgcagctccacattgttagcttatgaccttgatgccgtttcaaggttttcttacttgagtgcatattttgcgtatcagtttgtttttagaactaaacaatacaatctgattgttcatatttacatgcatatttcatcttttctaatgtgcccgtcgcaatacgcggggtttcatctagtattattggtacctaatacctattaagtggtatttaatcttataaaataagatatataagaagccacatcgtcaataattttaagctatcaaatggtattagtacaaatataacaactgttggatcaagaagctacttatccatctaattcaattatttattagtcgtacatccaccttcctttactcttcctcatagtcactcgtagcacttttacctattttgcacataacaccgtgtttttctcttccaagtctagaaaattagtgctaacttttttcgaatacaatttaaattatattttaagatgttagttttgctttattatgcatgattagatagcaaataatataattattatgtattgtcgacgtttgagatcgcgactacggtatttggacggtatggggatcgttggtatcagggtatatgcgagattgaggtcaaagagatagagacagggatttttatacaggttccggccacttatctgacatgtaatagccctacatcctgttggccgaagccggtgttgctcctttattcatcataatcacaccagtacaataattgggataacttgtctagctgtcgtcgacttggcggcatggataaccaattcgtggtcgacgacagggtagtcttcctcctcgaatacgaactcgtcgagatcagagatggcactagatccctcttgtcggccttcgtaggcaccgtattgggtttgtctaggcttatctctgatgttgatatctagcagcgtattggtttgtgtatatgttgtgtcttgtggcttgtcccctctcttcctagggggcttgtatttatacccataaatgcccccttgtccaaatagaactagggagaccatatggatacaatccgagtagttcttgtcgtttccatgtagaactctagtcgttcttcgacatggtacatggtgggccctgccgagcttagtcaagtactattaggtatgtggtattcataaccatgacatgcatctttacttgaacctattttcagaacaagtctgagtgaagtagagagatgcaaactatctagctgcaacgatacctatattgtgcataaaaataatattcatatattataacaacacacaattacactttaaaaaataaagcatgaattgtattgtaataacttatgtatacataaatccacattatcatatattttgtgcatacaaagagttgcacctaaccatttaaaacttccactactacagatcctatttttccgtgcgggcgttctgattatcccgtgtggtggtccggcccgtctgcagccacgtgtctgggaaaatcggtattttcgtgtgcgggcgggctgaccgcacgggataatagattatcccgtgcggtcgtgttatacggaccacacgggataatcgtttatcccgtgccttccaattataccgcccgcatgcaacaaaaaaaacaaaaaaataataaaaaaaaccctaccctaaccctagaaacggccgccgccgctcgcgagcagcacgccgccgtcacccgagctcagcgcacccggatccacacttcgtcatcgtcccgcccactgccaagccgcgcggggccccgccgccgtccgcgcccgctgtgcgtgcacgcagagccagcagcatcgcctcgtcgtcatcgttgtcgcgcccgccgccgctcgttcgctcgcggagccgccgcaccgcctccgccagcagccgccgcgccgcctcgtcggcggcggcggcagcggcgctcgatcggtggggaggggaggagaggaaagaggcagagagaggagagaaaagcggcagagagaggggaggggaggagatcgaggagagtaaagggggagagagaataaaaaggaagaagagagagagtgtgtgtgtgaaaaatttgaagtgggtgggagggaaaagtgggagagtatttttcggtgtggtccacttaaaaagcccgcacgcgaaaatcgatttttccgtgcagtcctcttaagtcgaccgcacgggaaaatgcatttttccgtgtgggcaagagcccaggtccgatccacggattttttcaggcggagctacttatggtccgcctgaaaactaccggggccggcgtccagtctagtagtgttcgactttgttcggcaagtatgatacaaacatgggccatacaggtgtctctttctgctagactaatcgcgtgttcaccagcccatagagagcaaccgtacctattccgagcaccacacgttatagtctcccaaattatgggccaaaaaagctggacctatatatacttctaactgtgtgagaaagagcgagagatgaataattcataaatttcacatgttgtcgtgactcgtgaactgaatatcagacgctattatcaactaacacaacaaaatctatcttacaatacactttttaccaagtgtaatcatattgtactattaatctctccattttatatcataagtcgctttaaatttttttctagtccaacctttttgagtttaatcaagtttataaaaaaatattataatatttttaatatgaaataaatatattatcaaaataaattcaatgttacataatgatactatttttttagtgttgtagttgttgataaattttttaataaacttggtcaaacctaaaagaaattgactagaaaaaaataaaaacgactaatggtatgaaacggagggagtagcatttaggctcttcatgtatcgtgacaaaagattgttctgagttttgtctttaaggccgagtttagttacaaacttttttttcaaacttacaactattttatcacatcaaaacttttctacacacataaacttctaacttttccgtcgcatcgttccaatttcaatcaaacttccaattttggtgtgaactaaacacaccctaacagttcaggtagtgctcaaatggttggatgaatggacagtgcacatgtacatacacagttgcttgctaagacatgtaaatacacttagtattttgcttatgtagttcatgcaaatcatgcacagatagtttcctttgtttaatggctatcttgtccattggattgcctatcttataattttataggatttctcatcacattaggcatgcccatttgtgaaaaaaaaatttgctaagcccatgatttttttttttgcaactaatgctacatgtagtaaaatcttcagcagaaaaaaaactacctatgagtattttggtttgtcacatgcacatcacaatagtcatgagctaaataaagtttgtcattttctgaattccaatgtgccttcctttatatgtcaaattcatttttttatgcagaggaccttatacttgcaattaatggtgttttcttctacagaaccctccatcaagctagtaagctaataagtctataacccaagttgacaggaaacaagttgactcccattttttgtcaggactcatgaaagtgaaaaacactttcttaactatgggttcttggattgtaaataatggggaacaaataagattttgggaagataaatggctaggaaatatggcttatagagaaaagtatccatctttatatgctattgtcagaaagagaaattcttctgttgctagtgttatggcttttgttccgctcaatgtttcttttaggagagctttagttggtcagaatttaacactttggtatgaattgtgtgcatctattgttcatattaagttgaataatatttctgattgttttagatggaactatcatcagaatggccaattctcggttagatcaatgtacttatctttaattaacaatggttacattgaaaaaataagttaatttggaagcttaagatgctgcttaagatcaagatctttatgtggtacttgcttaagggagttgtgttaaccaaggataatttagcaagacggaattggaatggtaatttaagatgttgtttttgtatgaaaaatgagtctatccaatatttgttcattgattgtcattttgtaaagtttatttggagagcagttcagttttcttttggtttatatattcctactagcatatctcatggtttttatgattggcttcagggagtggtaaacaaaaagagcaaactgatacttgttggagcatctgttttgtgttgggctttgtggttgagtaggaatgatagggtttttgacaaatcacctaccattacctatatgtaggttatttttaaggcaacatattggcttcgtctgtgggcacagttacaaaagtgtgatgaagatggagaattctaattgttgcatgtcgtaagcttgaaacgatggttatgcaactgtttgccaatcatgaatggaaatttaccaatagactggaataatgttattttgtatagtttggtttccttttaattttggt

SEQ ID NO: 41665 - DNA, 5395 bp, Oryza sativa
ccaaaatgtaagtattgttagctatgaatctggacatctgtatccagattcatagctaaaaattgctatattttgggacggaggtggtagattataataattggctgtagctcttttgtgcaaatgccgggatgttattttattccattatctaaaaaatcaagctagtaaggagttgcgagttgcaacctcccccctcctactctctcttccttggttgtacctttttcatccatgttttcccattagctttcagttcaaatgaaccacggttagtttaccatatagttgttttcaacatgattgtttcttaagcagacaaggaagtttgcgatcaccctaatgagcgcattccgcggtagtgagcagacaagatttttttgcttcttttgcaaacatgaattcagttcctctgcttagattgctatgaaaataccaataggccacttcatagctgtatacctgtatcatgtcaattatcaaaccatgcttgcacatccaagaaaagtgtgtgcagcggattattgcagatatactttgatacagtaagtgaagaggaggaatttggatacatttatatgataaataatttccagtgctatgatttcagctgccaaatttacaattttcatgtacaccgggatattcttcttggatgcattcattaacttcaaactatatatgataaggaatttcagtgttatgatgctacctgccaaatttagattgttcacgttgacaggggatacttttttggatgtatttataattaataaattcaaattctttaacaatttatgtgttatcttctgtgtagataacaatttcaaaatttttcagacgcagaagactccaaagctcctattcctgcaaatgacaggagatactccaaagctgtcatcgacaggcttcctatagcttaaatgcttaattattagagtgttattcacttctgtaaaactgatctttgctcggtcgacccaaaaccataatagttccggaactaaaaataatctttagccccggttaaaaaccccacagctattctatgatctttagtcccagttggtatctttagtcccggttcatcccctgttagagacatgtcagggggccgaggatctttagggactaaagatcactttagtcccggttggtattaccaaccggaactaaaattcaatacgtagtatataatcccaaacacttatcctctcctccacaatcgcaaccacttattcacacagatcgatcctccccttcctcctccccttcccctctcctacaaatattacacagatctttcctcccattcctcctctcctcccctctcctccccctcctcccctttctcctcccggcagtggcgggcaggtggccagcggggccgcgcgcggcggcggccgtggcgggcggcggcaggcggcggcccacattgttttcttttcttttttttataatttgtgattcactaagatgtataatgttgtgattcattgtacatttgtatagatctgagatgtataatctgtgtgatgtattttatttgtttgtaattttttgaggatttgtgatgtactacctccgtttcatattataaaagtttctagcattgcccacattcatataaatattaatgaatttagacattcatatatatttagattcattaacacccatatgaatgtgggcaatgctagaaagtcttataacctgaaacagaggaagtatttgatttgtgtgtataagtaactttaagatttgtgatgtggatttgggatgttactttgatttgaggatttagggtttgatttggggatatgtatgccactcgattcaggagaaaaaaaaagggaccatctggactgccgctaacctctttagttccggttggtgttaccaaccttattatcacccactgagaaaacatttgaagatgcatgcatgttgccacaccttgcatagattcagaatgtcgacctaaaaagagaggtgttcgccacttaaattcagagcttgtaattgcaccaagagtcttaagactaaagtatacgccattcctgaatgactcaagaccaagacttgattgttcaggttcagataggatatcaaagctacatggattttttcttatacaattgcttgtttagagtaattgccctactagacaggagtgggtccactattgattcaagggtattcagatgtatacccaagattttttaataaaaataagtacatatacattacatatatgtattaaaaaataatttaaaaaagcttcaaacagcccaacaagcaatcaaactactctttttgggcctgcttcatcctttggcccattggcgccggcccaaatttctcacccggccactccctctcaggcctcagcccgcactcccagcccactccctttctctccccctcccctaatcctagcttctgcctgttgtggaggcggaggtgcgcggcgcgcggcgggaggcgactcgcaaggcggcgcggcgtgcggcggcgggcggccggctgcggactgcggcgcgtcggccagcaagtcgcgaggcggccggcagtcctgttactcctggacagcagcacaggtagtcggggatggggagtgattgtcgcattatctgattgaagatttgtagtataaatattgaattcactgatttcatgatttattctacacttctacttatctaaatatctagtataattgcttagttggtagaaccattgtttatttgtttagttacattcattgaaagagaattcttcttgcaagttaaggataaggacatcatcacttatttttaaaatatcaagcatcgaaaagttgatttctaaattgtaaaatttcttcccaatttattcttttctatcctttatgtattctatatgttggtactttgatatattaccaattagtatttctataagttaaacaatttcaagtaatgatcaattttatctttgtgtgaacttatgctcgattttattttatatcgctatatattatataattattaatgtgtgatactataaaagctaaggcttttaggtgtatgaacaaatttttttaccctttcctatttcaaatacacaagttgaaaatgttagcccccccactgctactagacaagcttggtctagctcggtctgttactcaggtttcgttgtctagctcatgaatctggtaattccactgtaatgtaagcgcactatactaatactcctactacttctaaaaagaagagagaaaatctgcatgtggggtcctctactgagctgtcaatcaagtaaggtcgaaccgtttggtgacatgatttattttccttaattttacgaaactggagttttccataattttactactatcatttctgtccatacaaaaccatgataccatacagacaacaattttctgtacactgacgttttacatggaattgaagacaaatattaaataatatttctatggcacaagcgtaaatacattggtaatatccttcaaaactagatcaaatcttgctagtacatatgatacgttcgataaaaaatacttgatgatatattataaaaatcgacactgatgaaaccaataatacctactcaggtggtgtttgaatcttctgaagatgaaaatgaagattagatgtttcacgcaaaacgaggtgataataatatgttattaattaagttttaattattataaactttaaaaataaattaatttgatattttagagcaactttcatatagaaagttttcgtacgaaacacatcgtttaacagttttaaaaacgtgccacgataatccgaagtggatggcgcacagttttgacggactcatacagggatgaggtgtgactgaggtggctgtcatgtagtagaggtgcatggaggaggcagcatgggatgaatcggctgcttccatgcgagaaagtcacacttatcacgtttatactgtcgacaatatacctacaattgcagcccctgaaaagaatattacaacccccttagaaaaaagaatgaaaaacgctatatgatgttatacaacccagatttctattaaaaaaaaagataaaacgattactcggatcataattgagggtgtcaaagtatacttttttttctttcatctctaaacactaggtatgagtaatccgcgtacggatgcatcatatatgggccgcattgctacactgggcctaactatggtttggacgatggtcgttccaggcttcggtgccagtggcaaaggcaagaccaaataaccacttccatttttcttttccttcgcaaagaatcaaagtccagttgactagtttacgagttgcataaattccacggatgtgaatcagattccaagcattcaacagcacgtccaacgtacacgacaagacgaaatggttacaactaatttactaatcatcatctgggattagcatttttttttctgcctgccagatgctgagatgatttgctttgctgatcacaaaagaaagaacaaacccaacctacagccagctttgaagccccgggtttgttgctgatgcatggcattttccagactggaaacgcagagcaaaaattcgcagcaacggtcctccccccatgtgagccggtggggcccaccgccgcccgctacacgccatcgcgatcccagcgaggtccagccgtgtagtgagcgagagcgagagagagccgttgtgtatacttaacaatgccaccgttgtatatatacaatccgtgttgcaagaaaatcaatcgacataagcaagggaaatatcagcatctgcaaaaatcatctcagattcgttcgccatggcgaggatcccgttcgccgccatcgtcgtcgccatcctctctttcgccatcgccgcggctgcacaggcgcccgcgccgtctcccaccagcgacggtgagggatcggatccttccatgattcagtttcagctgttgtgattttggcctgatttatttgtgaatgtgtgattcagtttcagctgttgtgattttggcctgatttatttgtgaatgtgtgatgagtttgcagggacgtcggtggatcaagggatcgcatacctgctgatgatcgtggcgctggtgctcacctacctcatccaccctctcgacgcctcctccgcctacaagctcttctgagcttatgcagagatctcttcgtcgccatggtgttccttctccttcttggatctcctcctcctcccttttgatagtctagtggtggatctctcattctcggtgtaattaattagtgggatttttatattctttttcagctcgcgttcgtttgtaatttgggtcggtggtactgcgctgaggatcgatttcgcattgtgtatatcattcatcattctttgctgttctca

SEQ ID NO: 41666 - DNA, 6538 bp, Oryza sativa
aaaaaaaatccccaatcgaaattcaatcaatcttcacaatgggaattcaatgaaaccccccgaatcccaattgcactaagaatcgggaaacacatcccaaaattggcacaatcaaatcggatgaacacactgcaagaaaattcaaccaatctttatccccgaaaaatcatcccacatacatacatcacaaaactacactccctcctgccggtggatccatccgcggccgccgccaccgccggcggatccatcaccgttggatctagggcgggagggaggcgagaggggaggagggagccgccgccggcccgcggccgccgccaccgccgatggacccaccctccgacgttgccgacaccgccatcgccgccggatctgggacaggagggaggcgagaggggagaagggagccgccgccgccgccgtatccgcccgtagccgccgccaccaccgccggatccacccgcggctaccgccgccgccgccaccaccgccggatctgccgcgggagggaggctagagggggtggagggagccgccgccgccgaccctagagggagaggaggagggggggcgccgccgccgaccctagagggagaggaggagggggggcgccgccgccgtcgctttgagagaggggatcgggggcgccgctcgccggtcgctgctccgcgccgctgcagccgctcgggggaagagggggggcggcgccgccgtcgtcgctcggcgaggaggggggagaggcagggggaagaagggaaatgaatcttagggttagggttagggtttgggtatatttatttaggttaggattaatctggaccgtccattcgatcggacagctccagctgctcccacgtcgggccgccgacctattgggccaccgaatggaggacgcaaaatagacttcaatggagaaaggaaacaggccagacacatagaatagacaaaagggaggaaatataaactttgctatattcggcccaaacatagaaaggaggattttgatttttttttcaattaaataattgttaaatgatttttgtattattaaaaattagcaattaagctctgataattccaataaaattccaaagagcgtaactaatcatggagaatttaataaaattaaatttaatcatgtcattttatttttcacacttgctttacttgtaaattgatttaattatacacctacctacttaaaaataccaaatattttaattaattacataatgtaaattttttttttaactttttctcaatttttttgttctgtacacttcccgttgcaacgcacgggcacctttgctagtaattctaaaaacaataatagtctttttctcttttttagatacacagaacaaacacagaagctcataatacgcgcacactcatacacttatgagtatctccagaaaattggaccggcatatcttaagattgatgaagtcactacaagtgtctcgctgctgacaggtacgtcgcctatcacaagaaaaataattagctataaatacaaacaccactattaagtataggacttgaatggagctagttccaccacaagtaacctaagctcactttgtaatatattcttcaacacattacaaacgcacacaccaacacatacgccttcgagtgactcgattggtaagctattcttataaacggatctaaggaatcggaccggttaccactatgaatgcctccaaaggaccagatcgtatagtatcgcaattagttggcaaggttccttgtggtacaacttgttcatccgtgttccaattttagctcgccatgtgtgctcatatagagggtggtaaagtagcatctttatctcaagttagcttctgatcttagcaatgatagggagaaaatcagctagacactggcacgggatagatcatctcaaccgggtggcaaacctcatatgtgtcgggggagagctcccgtcacgaaccaaaggtcacagatgtaagaagtcatctgtatcgggcattttaccatcacggatgatagttatctcaatcaggccaaaactaaaacccgtcacaaataggtttgaccctacagatgagtcaaactagggcccgtcaccgattagatcatctgtgacaggctcatacttgactcactagtttgggattgatgaagagagggtgagagaaaagaatggaaccactctcacccctaggccctacgacgtggccaacttgcagaagctaggtcgccgccacaagaggatatgaatctagagtgagcttgcatcaattgcttaggaagattcggcaagaggatgcctagatgacacctccaaggagagaagcgacgaaagaaccgccgccgccatccgtcagggtctcaaagagaaccgagaccgagctttcacctggcagccacacttgaggggttgagatggcccgacaacgccctcaggaggggagtgacgcttgaacgccatcgttgctgatccggccaaggccgggctgggttttcgcccgccgtccaccgcctgccgatctaccactgatgcaccattgctccaccgccatctaaacttccgccagcgcatgggcatcactgcaccggtgccccccaccggccaatctccgcgcactgccaccggttgcacctccaccggcctctcctctcgctgcgccggccaccgtctccaagccagcaaagccttgtcatgtcgcactgccacctcggctgcgcctccacgcaccgcggccacctccgccgcgcctctgtgtgcgctgcctccaccgccgccggccaaccagctagccactactcctcccgctggctgcccgctgtcgccaccatcgccatgagtctctcggccacgcagccacctccgcgagcagcctctgtcgcccccctcccccgggccgtgtcgccggccggccggccagccagccggcactgctcctcccgccagctgcctgctgttgccgtcatcgccgtgagtctcctgggccacgccgccatatcgtgtcggccccagaagcgtcgccgtcgccgccgtcgcccacgaccccgccggcctctccctgccgtcgcgccagcctcctgccgcctgccaccgctcgacgaccgtgcgcctcctcttgccaccgtcaccacgaggtccgccgtcgttggggtcgcccagacccgatctgaccgcagggaggctagatttggcgccgggaaaggcggatccgcatccggtgtgggcggatccgctgcgccgaccgtccggccgccacctcctatgatccgccactgctgagaagcctccggtgtcccccgccgctgggcaacctcgtgaggggagcgtcgcgccgccgccgtccttgtggccgtccggctttgccgacgagccgctcaggcggcggcgagtcgaaggggaggaccagggaggggatcctgtgtgtgctcattcaacagaaaatgatttacggcattcgcaattttcctaaatgccaacaccgactgtacaactacgaaggtaatgagttcaggtcggctggcccttccattgattgctaaagaaacgcaacaagtaagttgaaaacaaagcatgctgcaaaaagatccgaagtttgcaatcatacattgtccaatgctccaaaggtacagtatacaggtagcaacatatatgcaacttacagaaatacagcacatagacattttttagataatgggttaaaccagcctctacatccggatatacacaaccaacagaacatagacatgaacttacagaaaaatggatgtacataggcaacacaacatatacatgaacttacagaaaaaaccacttactgcatatcaatcataaatcccaatgccagcagcaacaaaccgcaaatgacgacagagggaaaatgtgagatacttcaagacatcgagcaactagatctggttacgttgttgctaggaaaacacatcggaagatacttccttacatctgggggaaaaaaattccagatacatgcagttgaaaaccgaaaaaaaattcaagggaagagcacagcgagtgcttgttttagttccagataaaagtataaagaataaagatatcaattaagaggaggccgtgggtgccgcatctacacaaattcgaaaaatttatgatgttcctcctcctcctccatagtcagcaggtcacttttaaagggctgctctacttgctgaagcttcgtgcactgcgatatgtacacatacttcatggatgaaagagcgtgcaatccttcgatggatgatagctccgagcagccaaatagaaacaggtatttgagctgaagatttgtgccggtcggaatggactccatgttacagtactccaaatttagggcgatgagatgagtgaggttctgtagacaggctggaaatgacttatcaagaccaccgcacttgttaatatagagtcgccggagtgatgagggcaaaaccattgcctgttcgcacaccaagttatcgcaccatgagatcttcaggtcctgtaggtgataaagttccgtgaaactaccaacgggtattgattgtagacttctgcagagcctaatctctatggacttgatggatggcagatgttccggggacaagaactgatcaagatttcgcagcatatcacagttgtcaagacatatatactagtgaggcatgaaatggcgttgcttcttctgatactgctgcttgcctgctgcagcattctgccaccaccagtagaaccacaaaaaattgttagtacttcaacacctaatgatgttaaccttagctcttcgagggaaggtaacgaggggattgataggcttctcaagaagatacacttgcgaagctccatcatccttaaagtcggtaggctttctggattaaaccaactaggagaaaagctgtcacccgcaaagctatcgacattaaggcgctgaatccttgacggagggcacaaaccttcggccacaccattgtcatcgttcatcaccctgggtacaggctgatctcgccacagtagaactagtgcctgaaggtattgcttgtcaatgagtctagcctcaacagcctcttccttgctcttaacattatagatagaactgatagttagcgttccactgagctgattcatgcccttcagctcactaatcttccgcccattccctatcccaactgtaaaatgtatcaagttccgtagaagagacatatttccaagcccacttatctctgataatttcggagagcaacccattggcagtgctagacgacgcaagttgattagctttgtgacatccggactaataacttccagactagaactacttgcatcaagcacttgtaagcagtaaaggcaccataatttttctggcaattcttgtacatggctacgagatatatcaagataacggagactgtgcaactcaccaatgctttcaggtaacctgaccagcatgcaaccttttaagctcaaaaataggatattagagagctgattaaaccaggtaatctcaaacatgaggatggttccaaacttaagtgaatgcaatttattcaaatactgaatatctcttgtttggctcagggactcgctgtccacctcgactgacatatagcgaactgcatgcggcattctcctctggttctgatagctcaaatcctgcatcaagaagcacttgtccacggagatggactgcgccatatcatggatcaagtcatgcattacatatctactttgatcaaggcaattggtatcagtttgaagaagaaacctgcctcttaaatcatccaaatacctaatccctatgtcttcaagacgcatgctcccttctggtgcaacgaagccctgtgccacccacatgccaacaatctcatctcgttcgaagctataaccctttggaaacatggagcaaaatgcaaagcaactcttaagttcttgtgggagatgtaagtagctcagttgaagggctggtaatatatcattgtctcgatttggcagctcccatagttccttgttctgaacagtcttccaatgttgcacagtcagctccatattcaacaggcgtccaatagttttggcagccaaaggagacccgcataacctagaagcaatgcttcgaccaatatcatgcaattgaggatatgactcagggcactgtttaccaaatgcacacttcttgaagaactcccaaaatatatctctatccaatccctcgattcggaaaggattacagttgttgctagcgacaagattagcaacatctggagatcttgtagttactaagatcatgcttccttcaaacccatacctcaatggtgcaaaaaatgtttcccattcgtccttggcattaggccacatatcatcaagcactaaaaggaactttcgtctcctcagttgcttcctcaattccacctgaagagcgtctaaactgttcgatgatttgtactctttcctggtgatggactcaatgatctcttttgttatccttttcttgttgaagaggtccgaaatacagacccaaattctcttgccaaagtgagcttccacccttggatc

SEQ ID NO: 41667 - DNA, 7442 bp, Oryza sativa
aacttgtctctggcatgtgttgaactttctccatcttaagacccagaggcttaagcgctctctctaaatcatccacggccttgtcaagcttatcttgagcatcctttatccttgttttgctaccacagatcaagttttttgcacgatacagagaggaagaaaagaatttacctgctcggctacggtcagtgtcctccatcttctgccgcagcacctggtcatcgaacttgcgaagaagatcctcggtgtcatatgtggtgtccttgagctgcgtgagaagcaccgcgagatccttgttcttgaaccttccccactcgccacgattgatgactaagcgagcattgggcaaggatgcccggaggcaggatagatcatcttccagattggtcgctccgtggatgttgatcccagttgagatgatcttttctacggtctccatcaccgccatagtcgtccttggctcctccggatcttgtcttcgtcttctttgatgagtgcgagcctcaagagtgcaaggagattatggcgtgggaagtgaataatgcagcagcattgacctactaagtctaactacagaggcactcctttccacataatgatgcaagttgtgagttttgcatttaatgagttttgcatttaatgctgctgcatttaatgctgcccaagcagcattaactcctttccacataccgatgcaagttttgcatttaatttactaacaaattaaatgcaaaacttgtagatatgactcacttgacaatcattccacgtgatcctgttcaattatctaatcatctctctaagaccttaaccgcactacatattttgcatcttaagattccatatgtctgccagtaaaaacacaagtgcgcaacccacgagagaagaataccttcggatagtagactgtagcgtgtactttgtataaaccttgggtttctgtgaaacattttggcgaaaaatctagagttactagaaaaaattagatatgtttgaaccatgataaaatagaaagtggcatgaatgctatggtatgtttttgtcacctttttgtccgtgacactatcacaagaagtgaacgagcacatggattcccacttgatcgttaagaaagtgggaggaaatgcaattgtggatgcatttgaccaaaaaaggagtgatattaacaaaggagaatttagccaaaaggagatggaaaggaagcactaagtgctgcttttgcaattgtgaagaatcaattcaacatctctttttttattgtcactttgcacattttatgtggaatgctcttttcatgatacttggttttcaagtgccatcctgtattgctaattttctggtggttggtcatggtgcttagtacctaagtttagggaccaactctttgttggagttgtggcaatgtgttggccactttggcttgctatgaatggtatacactagtggagaaactatctttggtcggtctggcaaaatccacaatagttccagttccaaaaagaaccgggactaaagattgtttttagtcccggttataaaaattttgatgatcattaatcccggtttatcccctgtcagatgtttgtcagggggcgaggatctttagtcccggttggtgtcaataaccaggactaaagatcacttatcctctcctccacaattacaacttagacagatcgaatctctcccctctcctaagatctaacctctcttcctcatcctctctcctccacctcctccccttcctcctctcctccccatcctccccttcctcctccccctcctccccttcccatccggcgggccggcggggccacgcccggcggccgtggcgagcggcggcagcggcattgttttttcttttttatttttaaatttgcgattcactgatatgtacaaatttgtgattcattgtttggatctgtgatatatttgatttgtgtgtaattttttaggattttgtgatgtattaaatttgtgtgtataagtaactttatgatttgtgatgtgaatttgggatgttactttgatttggagatttggggatttgcctacttgattcgggtgaaaataaaaaggaaaaaaagaaaaagaaaaggggaccatttggtactgccgttattgtctctttagtcctggttggtaacagcaaccgtcaaccgggactaaagatggatccttactcccggttgaaaaaccgggactaaagtggggttcccaagcgggagtaaagatggtttttccaccaatggtagtctttaacgtcactatttttttgggcgggcaccgggtgggtggggggggcattaggctcaccagtggtctttgcttcttaaggaggaggaggatggtgaggcagtgaggaatggatacaaagaaactggaaacaatcactatggaactgttcttaaaatcggggtggaatgggagaggaagactacaaccttatttggctctggtgaagcgagtaatgtaacgtggattttggttaatttttgtcacctatggtggcatatgttctataattcttttttaagcccaagtgcctgacgttgtatgaccgtggttgtgtaaacccccgttgggtgtataggttgggtttttattaggcaaaatttactacagcacattgaaaaaaacgtgtaattagctcgtggacagcgcaagaatgagaatttgctatcgggcaccacaaaaaacgtgtaattagctcctggacactcagggccttattttaatattttctgtgaatttggagagagaaacactagtgagagtacgattttgccccttccctcacaagtcacaccggccagagcacagcgccgccaccacctccacccgcggtcgtgcgcccacgcaggccgccatcacacgcacatctgcgccgccgctgccgctgcagccagccaatgaacgggcatgccgctgccgccgccggcagctgacgcactcgtgcgccgctgccttctcccccatctgcgccgccgtgccggaagatgaggaagacgacagcgacaaggatgacaggaaggaggaggccgtggagctcggagatgctgcgcatcgactgcgcgtggaagtccgtgaagccaacgagcatccccgccgtgtgcgtccaccgcgagaagctctacgccaacacgcggtatgggatggtgtacgcgttcgccgagctgcgtacgtggagcgcagcttcctggtggagtccccaccaggctctccaccgagcaccggcgaccgccacgggctgatgcaggtggagctgctccggcccgtggccgcagctgaggaggaggggttcaaggtgcgcgtgctggacaagtgcggcgagacgtgggaggaggcggacgacatcggcgacgtggtggtggtcgtggacgcgtccggtgcgggggcggcatctacgcgggagtgccccaggttgaggctgagcaccatgtacttcgccgtcgaccccaccggcgagacgcgcgtgtgcacatacagcctcgccgcagcgggcagctacgtgtcgcccacctctcccgccgtcgtgagcggtcacgctggccgcctctcacaccctttcccaccgacatcgtcacgcccgctcctcgccgctcactgccacgcccgcgtcgccctgcctttcccgttgtcgcgacctagcgccgtcccgcgccgcgccgccagcgcacgcaagccaagccacccctatggtcccaatccaagggcacacttgtctttatttagtgtttctctctcgaaatccacaggaaataataaaataacaccccgagtttccaggagctaattacatgtttttttatgccaggcagcaaattctcgtttttgcggtgtccacgagctaattacacattttttcgatgccatgtagcaaattttgcctttttattaaacccattattataaaaactgggaaggtagtccgcgcatacgcatgggcatatggtttgaattttaattatgaaagttgatgcgtggatgatagttttgaaatatttattgacgctattttaaacatgtgttcgttaataactgttttgggcatattacttgaaaccgtatatcctcaaagttattagaaaaaaaatgtgtcacaataatggagttgcttcatatctatttgtattatgtgcgactctttttcaaaaaaaatttagagttagtctcatttggatgaccctaagttgattttagatatttgaatatagcttttttagttttctaagtcactaaggatgtaaaagcttaatcataaattattttttatcgctaataagctatttagcatataatcagctattggccaaccgatgggcctgctgaatgtttcacgttggagcctatatctatagttgacttgacctatgctgctgatcaatgttacacgatggagcccaccggcctaattgtctggcttattcgtgaaataagccaaatagaatatacataaacgaaaaataatatgtgaataaaacttttatatatatatttttagcaatttaaaagcaaagattgaaaaataaacttcgataaaaaaaacctaaaattaacttctaatttaagattgaaaatttaaatttttactggtaagcataaccataaacgaaaaaaaagatgtcgaagctccttcaagatttttgtgggaggtatcgttaattcgtgatcacatttgcgtcgaagctccttcaagatatctttgacccggcacctacaatcagtacagagcgttaacacggacggaagaagttgcaggatctttcctcagaagcatccttttgccaactaccctaggaattatatattgccaagaaaataactactgttctggtgctgaatgtttcattcaccttgaacttttgtcaactgccgtctccaaaggagagaaaaaataacataaacttttacgaactccagatgctaaaaacttaagatatttcatctcaccattatcttgtattatgtgattcagaaagtaaaaaaggaacagttatgcagtaactaggagtggaagtgcagaatggattccattagacagtgatgattgagagtaaattgaaaagaaacaacttgaagctctagtcctgtggagattatggtaacccatacccactcggccactatattttgattaattggatatagcgggtaatccatgtttatattatctattaggctagaacttaggtgttatgttgccttatatgatacagcacggcctatagtctcggctaaatactaccatgtaatagattaagaaactgatgcctattcggtttggttttcctctttataaccctgttctccaacctatataaggtgggtggaaagtcctccaagagcataaccacacaaataaccagagataaacacagttagatcgtcagatctatacacacccagcggttacaattctcgaaacaggagtagggtattgcttcttatcaatatggcatgaacctgtctaaacctttgtcccctctattcatccactttacaactcatgcgctacacccttttcttatgggttaatcgtatccatgccattgtaaaatatgtcgattcagagaaatgccctacaattcaccaattcttaaccgctccattgaaattttagaaaattaggaccacattttcaatccatctccatcttcttcctcatgtgcacgtgggacccacccatcagattcatcttcttcctctatcctcactttttttatgatctctctccaccgcagtcaggagggagggatggactggtgcggcatggcttggggcatgaactagatgcctatggcggcggtgacggcggacggtggcaggacgaacctaaggaggcgggcgtcaacttcagtgccgccgtggcgtagattgcgcggtggtgggtgaacgggaggagcgacggcgacagggtcgctacagggctccacggtggcagccagggcggggcggtgcacggcatgtgcgtgggtatcgatgcgacgcttgcggaatgccgggcatggagggggcggggtggcatgccctatagcaccagcacgtcgtggtggcgcgggggcagctagaaagaggtggaggttggagccggaggcgaacggggacgttgggccgctgccagggccgaggctgaggtggagccagtccctggcgccgttgtttcctcgacctccgttgctgctgctcctgtcactgctactaccactggtcccggcgaccttctactggtggtggtggtggaggtgggtgttggtggctgtggtcgtctccgttgcgctgcagctagaggtgctgcttccgcgtcagcagcgagggggacccacccatcacctccctccctcccgcggtggtggagagagatgagaaaaaaagtgtggaggatggagaaagaagatgaatctgataggtgggtcccacgtgcagatgaggaagaagatggagatggatggaaaatgtgatgatagtggcacggtcctaattttgtaaaatttcaatggcacggttacgaatagacgaattgtagtggcatttctctgaatcagcatatttacaatggcatggatccaattaatccttttcttattgccgatctagaacatcgatagttgactgttgacggtcgttatagaccaatttcgaccgtcaatatatccagaaataagaagtagcaacgcttgcatgcatatttgtttaagtataatctatcagttaacgccaaaatttggtaagcccaaattcatcatcggcctagagtcagtatcggcttcagagtcttagaatcggccgatgggagtcgtcaaatcgccagcagttgtgttcttggtggagttggatcaattaaaggaagcttatctagaagagtccgagttcaaggaggatgtgacatggcagtttatctattaattaggcagtatttgtaagtttccttttatctttaggaatgtgtgtttagtgtccgataaggactttatgttttccttttatctctaggaaagtttctttcttgttctacaaggactagtatttacccatgggtataaatatgtacacccggggttattgtaaattatctcttgatcaataatactactttcggcgcatcgccaccctctttcccgaggtttttacatatcaaccggcagaatttggcacttgacgcggggctgcatcggttcagttcgatctccagcgaaggggtaagtcctacgttccaccagccctggtgaatctgccggctacgttggtgttgttcaaggctgcatcgcttcaatatcttagatcgctctggtttggttgatacatttgcctacctgatatctcaattctatctctagttgcattgtgtctagagatgcatcggtttagttgggactgtctcagttaggtccaatcttctgccttagccgatatatctttacaatcacaatccgggctgcagg

SEQ ID NO: 41668 - DNA, 1657 bp, Oryza sativa
tagattatcatatacaatctcgtgctgcatcggttaggttcgacctactagattgttgttgataatataagtcttgttaatccgataggttcatgctaatgttttatcagggtgctagctaataagttatctggacgttgcatcggcttacaaagattacatataagttggatttagccgattgcaataaaggtttcattgttgaatctaatcttgtggatttcatgacatcggacctccagccaatgtatatgctttaaccttcggatcagtgcttattctattatatcattgctagccgattggtttctactggattatattgtataattatattgattatcatcagccgattgtctttatatcattatctacattggacatatagccgatagctcagaaccctatcactatcggctggtatcggcatcggctggctatttgatatgttgtttacgtatcttgtcagttgcaggatcaaactgactggcacgcccgcacctcatcaacctttggacctgcactggagctaagcagatctcccaggcctgtgtgtgttttttgcatcaacactatctccacttgtacttcgaattttatttgaatacatagatctccacataaatggaggtgaatcgatggaaaataaccaaacaatcaatcgaagtccgagaagtggcagacttatggatggatgggcttacaaatccaatagaatacctgcaaatagggccaaccactgtgccactggacttaggatccatcgaccgatgcaccagagaagacacatgccaaatggttcagcccagggttcgaccgaacccccagctgcgccgttgatcctctccttccacgtggacgctcgtgatcactttgcaatgacagttgcgaggcattttccaacaattccaaccatcacaaccgtcaatggtaacctataaatggacttcacctcctccatttccaagagcactcttggtaattcttacgaccatagataaatccgcaagcgcacggaatatcgttgcagcacttcaccttcgggtgaccacaaaaggatatcgaactcagggaacgtgtgtaatctacctaaggctaagactatccagggacaacaactattggtaggctagctaggctagagaggactttatatgtgttttaattatctactctaagaaaagttaatttcctatctgttgctttgggcaccgacccctgctggtctgccaacgtagtttctgctatagctctatgatgtatcctaacgtggaggattagtaggactggataaagcgctgtcaccacctgccgtctacctctgacaaatccgtgggatacacaacaaacaaaaggtaatctctaacctatacaccacgcctaagttattaattactactctaatacttgtacatgaacttccttctttatccagagtcttagtactagagcacttagtacgaatactaaataatgaacctgcaaagatggaaatctatcttacttagactaaataattaagagaaaattcatgaaataccatcaataagcaccctaatcccagaaatgccatcgacaaaatcaacttcctaaaaatgccattgcacaagcctctttctcccaaaaatgccatcaccatcaactccacaccgttgca

SEQ ID NO: 41669 - DNA, 2842 bp, Oryza sativa
catgtgaagcttctgaggtcctagggatgacacctgcacggggaatcggatggtggctcaacggagaaggaggatttggcggtggtgctcagcggccggagttggggaagacggagtcgatctcccagcttgctccaccgatcttggtggttcttggggcgttttgcagagggggacgaggagaccttcacggcgtagtggcttggctcggggcggacaggttcagccgggcgacgatgacgctgaagcggcggcgaagaccggtgcgcgcctcctcctcgccggcgcctgcggaccccatgccgacgcctgcggcctcctccgcgttggcgcctgcaacctcctctccgcgccccgcgtcaccgccgacacctccttggaccaccgcgccgccaccgggcattgcggcgccaccgctgtggatcaccttctcgcagcagtcgccgaccaagagaggtgcgctgtcaccgggagagccgcctggatcgggtctagtgttagggattttcaccatttcatctcccttttcccttttaccgtgaaatactgggtatgtatatttgtgagtgagggaaatttggtctttgtaaaaaaacataacggttgtaatggtgtggaatcaacgggatgttgacggtgatggcatttttggaagaaatatgcttgtacaatggtatttttgggaagttgcacttgtcgatggcatttctaggataagggtgtttgttgatggcatttcatggattttctcattaattaaataacataagaaaggatcccgaatgcttacttaatagaagaagtttctccgaacccggagtagagtgtaccgacagctccggtactcctctagaattcctcctagaaagctacactcgtcgaggtagaagtcggagagagcaccaaacttccgggcactcatccagagcttcccctcactctacctattttctaatatacaaaagatacaatagagcctcttgatttagctcaaagttgtgtgttttgaagtgaagtgagcttctccttttatagtctccatatgacggttacaactatgggaattgtccaaaacaccctccaacgatcattgggaaaaaatcaggagtgtacacatggaggtgaacgggttcggccgaacccaaaaatccacctcccggtctctcttttggctaggaggttgcttaatgggcacccaacatcatgtactatgatttggcccaattctaagtggttttgattgacatgtgggtcctccaatccatgtaaatgtatcatgattgtccggaggtgtattttgttgcatgacagacgtgttttctccttaatatgcatgcatacttatatttcaccaacactagtggaaatgattagtaataatacctaccactaagttggataccatatattttatttcgttatatgcaagtattgatggtcagatattatgatttaaggaccgtcaacaagttagatggctttgcctctgcttttcaaaaccagctaagttttaacaaaatgctagaaactcaactagctcagatggctactcttgtccctgctaatgaatctaggaggattccagggcaacctgagccctctctagagaactttaatgataaccacaaggggaggaaaatccactcgcgaccagccacatcctaacactgcaggaacaagaaagaacaataaggaggcttcaccatctaacacaaatggagaagaagagacaattcagcgggagaaggctgcgccgcaggagtactgcgacaccaacctgctgccattcccccagcataaccggaagccatccatcgatgagcaattcgctcgctttattgaagcgatccaaaagatccacatcaacatacctattttggatgcgatgcaagtacccatgtacggttgctatctaaaggacattctcaacaacaagcgaccgatgccaaccgcggaagtggtgaaactaatggaggagtgtagcaatgctatactcctccaacttccggagaagaagaaagatctggggtgtcccacgaacaggccttgtgcgaccttgaagcaagcgtgagtgtcataaccaaggatgtcttcgacaaattgaactacacagtgttcgcaccaacactgatgcggctctagctagccgattcctcggtccgttacccagcaggtattgctgaggatgccctagtaaaaattcgggatttcttcatcctggtggactttgtggtcttagacataaactctgacaaggagacgccgctcatcttggggcgtccgttcttaagcatcgtggaagccaacattgatgtaggagctggagaaatccggctcgacctcaatggaaaggaggagaagttcgaattccgaccgagaatagaacaatgctctatggtgaagatcaagtacgggccaaatccacaaaatatccgagaggtcgaagttaaaccctcaaagacggatagcctcattgcattcatgaagaacttcctggagaaggaagcgatgggcaggcaccgtccagatccaaaggtggcatcaagaacgcaagctaaaaagcctgtgacaccagccgccaagaagccacaggatgcacccaagacgtaaaatgactagcaagtgaagaaatcgacacccactctctcacctccggagcagggtgccgcatcatcaagctaagcatgatggaggtatggtcttgctcgtcggactaaaaacgacgttgcccttgccaataggtaatttggtatgtatctcatatttgccttttgcatcaaaacatgtttattttttcaaaattttgcattaggaataaatttgagacaaatttataaaaatc

SEQ ID NO: 41670 - DNA, 5056 bp, Oryza sativa
taattcctgcagccccaatttctaggtaccttgctagaagtagatgatggcattttgtcacgctcggaaaatagaacactatattccgtttgtgagtgcataaatccttgtcctatgaggcaaggtacacattacaaagttggtaaataacaaagtatataagcaaaagcataaatagagtactttattacattggcaaccaaagttccaacactaaaagataaacgataaaagccgaaagctatgttgggccaccacaggcgcttgatggcaggcacgagctagacatcaaagccatcatctccaaagtattcctctgctggaagggggaaaatggagcaaggctgagtacaaccaccatactttgcaagccatgccgggaaaatgcaaatataatgcaagtgagtacaaagaattcatttataacgttattttgcagaaaactattatttcaaagcatgtaaatatttaactgtatttgaataaaacacgaacctatctctagtcaattattatcaagccgcgctccaacgcgatcttgcctttatgcaggccaaaaagtgataactccaattattcaaatttcaatagaattaaactctaactagggtacattgcttggtttgcccataaccgagggcgtggctattcaaatagattagaggtgtacatcgttacccaccaaacccgtcttcctcacatgttgccatgtgccacatgccaccgcggcatatgacataagctatgacataactcatcgtttggtaccgccctaaacaaagaggaccgacatagacttcccccaccaggtgccctaggtcaagcaaacagtctatgcccccgagcatacagccagagacgtcgaccccatcaagggcttcatccatccctatccgtgtcttccttgtttatgaccgtactagacgatgcattaagcctttcctattagacaggtggttgtacggaatatgctttgcaacagaggcccgaagactgttacttatgacggccgagatgcgactagcgaaaccaagcaccccaagcccagccgaaaacatgtttggggaattttgaaggggaaatatcatgtcaaggttaaacagccactaaaccatattaaccattatttaaaagttattcccaaagtctaattattggaaaacatctaattgtttctatttaagcgaggctaagcatatccctaaatttactagtaagcaccacatacataaagttcccactagttttattttcctagagttatcaaggatcgtaataatacaagtaataaagctaaaacaaggagaatcggtaaggctaaataaaacagtgataagcgcggaaatttaataaagtgaaatgcaataatttaaataaacataattttataaattaggacaacaatatgatcaaaatgacatgacttgccttgctcgctaccaaaatcttcaaaatcaacctcgaggtagagcatctctccggatctgcagcgtctacactgcatacgcaaagaaaaagggctaaaacataaattaaaaccatataagatgcagaaacaaagcactaaaatgggttctttactgattaagggaaaattagcaatttgaacgagtcaattccgagttcaaatagtcaatatatgaccatttgaattttagatgttgtctgaattgcattttgcgaatttgtggattgattttgtaaaggaaacctactgagtgtgcgtgctgaaacagcaaagagagaaaaacagagaagagggagagaggtggcagaggacatggcagtcggtctccaccggcggccatggcgcagcgacacgggagaggtgagggtggcggcgaggctcaccagagcagcggggacggcaatgaaacagtgatggtgacgagcttggttttttgttgatgttcgtcattgtctccgaggtcttgatgttctttttttgttgttagtttcttcttcctctttggtttcattacctggtatatctcaaacatgaggtgttagagccctgttcttcgaagaatcccaggcatctcccgctcatgacatttgcggtcatcgttgttgaaattcttggtgggaaggggtacaacctgagccgtagatagtgaagcattcatggaggatcccaaggatgcgaacactaccgaaggatagcgtgctgctcccactgagcaggagcaggacaagccactcggccatggtgaggttattgtgcactgtgaatgctcctagcaaagccaatcgtttgtgccttcggcttcttcaccatcgcctagcagtcacacgccatacggtttttctccagtctagcagctgtggacatggcgacaacagaattttggcacttagtttccctatcttcttgtctaccttttaggccatttttttagttttctaggagtggttggaataacatggtcatcaactccagcccaaagcacacttggtttgcaccggtaggtaatactagtacaaaaaaaatagaccagactgacggtccaaccggaaaaaaccagactcagagtaatcacggttcggttagataggaagaccggacatgcatttgaaccgctttagaccagatgaactgggaaaaccggcaccggtcaaaacattaggtccgatgttgggccattccaagactaacttaacgctgttgggccataaatgagagtgcccctttggtttttttttgtgcaaaaatagggaacaaaggtgctctagctaggattcaacctcaggtcactgagttggagggaaaagtcactagcctttcgactagcatggaaaatacacataatacatgtaagatacaaccacggttcaaccgtcgggtcaacggttggattggtggaccggtgaaccgagaggtcggccgggtcacccaccggtccggctttttacactatggtaggtatactcatgcttgctttatatagatatgcggaaacgacggagtggacactaccggttgacggtgtgctgctccagctgagtaggacaagccgcttagcagtgattgctcttcccatagccatcgtcgatgcattcagcttcttcgccattgcccagtagacatgaaccgtaggattttctgcaggaaagcaacggtggatgtgggtacggctcaattttggtatttatttttcccatcttcatgtcaaccttttaggcattttttattagttttctaggagcggtttgaaatgatatggtcatcaactccagcccaaagaacgcgtagtttgcagtgataggcatactcatacttgttttatatagagagatgcgaaaataatagagtggacactaccggtggatggtgtgctactcccactgagctggacaagccatgaggtcatgcaccgtgattgctcctgccatagccatcatcggtgccttcagcttcttcttcgccattgcccagcagacatgaatcgtaggattttctctaggcaagcaatggcggacgtggcaacaactaaattttggcatctaatttttgcatcttcctgtctaaaatgtatgcctttttagacaatcattcagttttataaagtgagttttaagcatactaagaaagagcaaagtggtttaaacacaaaataaaaatgtgtcttccagttttcggttgtttgtgtgacaatcataactaggcttttatttttgaaaatatttggtaatagctacaaaataaagaactgctcattcgttgatccttcacacagcaataggacaaagctaagagtacatcctttttagaagagagtggtcgctgatatccaaattccgtaatgaacttgatgaaatttcttgcacatgaatcaaacaatctatcactagtagattttacaaacaagcatgtgttgttcaataaatcaaataccatcacatctagagaaacaattgtaagctccatatttttctactacatggctcgagatcacgagaaagaatactgcaagcacaagcacatggtcacaacctgcttgagctacgccgtacaaattattcaaagttacatggaggtccctctgttctctatgtctatgtctctgtctttgtcattgtccccgagttcttgatgttcttttttgttgttagtttcttcttcctctttggtttcatcacgtggtagatctcaaacatgaggtgtgagagccctgttcttcgatgaatcccgagcatctcccgctcatgactttcccaatcatcgttgctgaaattcttggtaggaaggggcacgacctgagccgtagatagtgaggtgttcatggaggagcccaaggatgcgaaaacgacggagtggacactatgggaggatggcgtgctgctcccactgagcaggaggaggacaagccacttggccgtcgtgaggttattgcacactacgaatgctcctagcacagccaatcatttgtgccttcggcttcgccgccagcgcctagcaggcatgaatcgtaggattttctccaggcaaacaatggtggctgtggcgatggctattttttggcatttatttttcccatcttcttgtctaccttttagggattttttattagttttctaggagctgttcgaaacggtatggtcatcaactccagcccaaagaacgcatggtttgcagcgataggcatactcatacttgttttatatagagatacgaaaataacaaagtggacactacaggtcgatggcgtgatactcccactgagctagacaagctgtgaggtcatgcaccgtgattgctccggccaaagacatcgtcggtgccttcagcttcttcttcgccattgcccagcagacatgaaccgtaggattttctccaggcaagcaacggtggacatggaaacaactaaattttggcatttatttttgccatgttcctatctaccatttaggccttatttttcgtatttctctagccgtgcttaccaacgacatggtgatccactccagaccaaagaaagtttggtttgcatagggtggtatactcatactttctttgtatagaggcgtcttggcaaagaaaaagggctgcaggaat

SEQ ID NO: 41671 - DNA, 4092 bp, Oryza sativa
ctgagccgtagatagtgaggcgttcatggaggagcccaaggatgcgaaaacgacggagtggacactatgggaggatggcgtgctgctcccactgagcaggaggaggacaagccacttggccgtggtgaggttattgtgcactacgaatgctcctagcacaaccaattgtttgtggcttcagcttcatcgccatcgcctagcaggcacgcgctgtatggttttctccaagctagcagctgtggacatgcgatgacggaatgctggcacttagttttcccatcttcttatctaccttttaggcccattattttttagctttctaggagtgcttagaaatggcatggtcatcagctccaacccaaaggacacttggtttgcaccggtagatatactcatacttgctttatatagagatgcggaaacgacggagtggacactaccggtcgatggcgtgctgctcccgctgagtaggacaagccactttgcagtggcaaggtcgtgcaccgtgattgatcctgcgatagccatcgtcggtgcattcatcttcttcttcgccattgcccagcagacatgaatcgtaggattttctccaggcaaacaacggtggatgtggtgatggctaaattttggcatttatttttcccatcttcttgtctaccttttaggcattttttattagttttctaggagcggttcgaaacggtatggtcatcaactccagcccaaagaacgcgtggtttgcagcgataggcatactcatacttgttttatatagagacacgaaaataacagagtggacactacaggtcgatggcgtgatactcccaccgagctagacaagctgtgaggtcatgcaccgtgattgctcctgccaaagccatcgtcggtgccttcagcttcttcgccattgcccaacagacatgaactgtaggattttctccagacaagcaacggtggacatggaaacaactaaattttggcatttatttttgccatgttcctatctaccatttaggccttatttttcgtatttttctagcagtgcttaccaacgacatggtgatccactccagaccaaagaaagtttggtttgcacagggcggtatactcatactttctttgtatagaggcgtcttggcaaagaaaaatgtgtatgaaaggttgctcttaatgactaaacaaatccattcagttttataaagtgaggtttaagcatactagaggagagcaaagtggtttcaacacaaaataaaaatgtgtcttccagttttcggttgcttgtgtgagaatcataacagaagagaagtgtgctataaatttatagctaattgtagcacagattccaagacgctgtgtatacgagaggtgagactagatattaatggtgtaatatacatgaatttataggtaagaaggaaacatatcctatgcacacaaagcttcccgtgcacaccaactagcaaatatcacagaaaattctacaaaaaaattggacattccctcctaatagtattacacgttcgtgtgaaatcttattttcaaattcattatattttagctgtaacaaaaaaagataaaattctgacagatttttacccttaaaactgtcatatttttttacttttttgttacagctaaaatataatgaatttgaatacggtactttacagatatatgtaatactattaggagggaatgtccaactttttgtagaattttttatgacatttgttagttggtgtgcattgagtatgcacgagaggcttgtgtgcataggatatattcccaggcaagaataggccattagattagctatagatcactacaagagtgcaattttcttggcggtccaaccgccaagtctaaaaaggcagggatattacgatttcttggcggctaaccataagaaaatgtcttcttagcggtccgccttttaagaagattgtcaactttcgaaagcgccaagaaaaataaaccttgttgctttggaccgacaagaatatactttactcggcggcaacaaaactttttattcttaacagtcagaaccgcctatgaaatttcttattctattaaagatagtaggtgattatactattaaacttgctataaatgcatgaaatacattagttagtagaggtaaatgcaagcaatccacctcagatgtacgtgggttaaaaaaggggcaaaaatgtttctagatctttcattttttttctttagcactgtactggttcactttataagcatctaataaagtttcctacgtttcggacccccttcacttctccatcataaaacaattcccaatatacgtaagttgtgttttgtgtgctgagtattatgtctgtaccgcttttttttcaaacatacatagtcttatagcatcacaaaaagattacgtataatcttgcccaaaaatttattgttgacttcccccaaaaatttattgttgggcttcctaaagtgaaaatagcaagtaaaaaaaattgatctctccgagagagagtctaaattttatcaaaaactaaaagtgggcccaattctccattttttttctccatatacgcagattagattgcgtgctctcctggcgcgggagagtcacggttgggagtcggaggggagcactccctctccctcaaatcaaaggggcgagaaatactggaaatggaactccaaaacatgttgacgactgtagggttcaaatcaaaggagcgagaaatacagggaaggaaactccaaaacatgttagaggactataagggatatgttggatccgattttctaccttaaaaacccttaaaattagttttgagaagaatataggagaattgttagtgattctcttaaatattttctttcggctgtttagttcacgataccacttgtcgccgtagcgttagcacatgaatattcctaataccagtcaataaatgggtgatgggtgtgtttgatctctacataaccgggaaagtaaaatttcaaatatgttattacacctaggaaattcacctctcttataattattgtgtttttttatcagtgtgaggattttttgtttgaaacattagcagtgtggggattgaaaaaaggattaattggtaacaaggatttgcggaaaattgactcaccgttatgtggcagcgatatgagatgaccgccaaaccaagagcacaaatcatcttaatttattccattgtccgagaaagtgagcaaactaccaaaaaaacaagagaagttggtgattgtcttgtttgattaagcacatacggagtagatttttagaggaagcaactcagaatcgggcgccgatgggagggagaaaaatcggacgccgacgtcatgctgacgtcagtatgatacatgcgtgcaaaactactttaaactatttttctcttaaattatttatctaaatcatcgttgcaattaaatctttaaaacaataccacacatggatatattctgacaaaaaaattagcttattattgaattattttaaatgttgcaacgatgttccaccaagtatattggaattgtttcattaagtagatcgaaaatgtttaaatagtttaaattgggcgttgtttcaccttatataaaaataatggttcagtaaatagcgaaagaatgtttcaattcactgtaatatttgatccatacatagtaaaacgttataagtacactaagtgaaacattttttatgcaaaaaaaaatgaaacgaattcccttaatagagggtttccaaaatatgtgggtgatttgttgcaaaggaatgttgcaattcactgcaacattagatatatacatagtgaaacattgtgagtacactagatgaaacagtgaaacattatgagtacactaggtgaaatattttttagggaacaaaaaatgaaatgaatttccttaatagaggtttttcataatatgtgggtgatttgttgcaaaagaatgtttcaattcactgtaatattatatctatatatagtgaaacattgtgagtacactgggtgaaatatttttttttgagatacatgacaggtggggcagaacacatggtggggcccgggggtatgtgcgcgtcgggggggg

SEQ ID NO: 41672 - DNA, 4786 bp, Oryza sativa
  unsure (1)..(4786): unsure at all n locations
cacaccgaccataccgcgatcttgtgtgatctcccattctcccccgtactacaatattgctcaacataaccgggcaattgctcatttgacgtatttcgaagtgtaactaccaatttaatcccattttttcggtttgattatttgaccctattttttaaaatcgaagatgaacactgaccctactccattaaagcgagttaacggtgttaactaaggggtaaatagtccattttgcccttgctttataacaaatttataacgaatttgatttatcttttacatttgagacaagtttgaaaaatttagcttcaatattttaatttgaaaattttggatcggtttaacaaatttatctttcattcgacggttttcacaaaataaggcaaataaaatttggcagaaattttttaaaaaattgacagaatattgtcttaattttgtgaatcccaaattacatacaatgaagcaaaaacataaattatggtcaaatccaacagagaaaatatcaaatagcaactgccaccgcgcgtcggttgcccgctgcctccctccgcgcgcccgcgcaccagcagcggcgcaccaccgccccctcctcccttcacacgccggacgctccggcctccctcctcgtgccgctccccaccgctcctctctgcgtgctccggcgcccctgccgccgcctctctccacgcaccggcgctgtcgccgtgcctcctccccgcgccgacgttgtctcctgctcgctctccgcgtcggcgtcggtgccaccgctgccatcgcctcctccttccctgtgttgccactaccgagatgtgaacaagagagggtgtcgaaccctctaccaccgccacccccgacggcgcgcgtcttcccaccacggcgcgcaagagctggggatcaaccaccgcaccagctggggagccgctgccgccccagctagggatccactgtaatgaccacgngcaggngnggatccccccgtcccaccaccaccacgcatgcagagcaccgccaccacgcacggagagcaccactgccaccctccacgagcagacgtcggcgcggggttctgcttcacgccgccgccgccccctcagtgccgccgccgcaactcacacaagaacgagagagagaaatgtgtggatagggttcggtggatggatagggtttcctatgggtattctgggtattacgaatattagttatatttcttttttattttaaatcaaaacttaacagggtcagacgggagcttcattttcgaaaaggatggtcaaataagtaaactctaaaaagtagagtcaaattggtagttaagcttcaaaacggggtcaaataagcaattgtccctaaatgaaatgtagaccccgattttggaaatcgaaaatcttctgtgtttatccgtaccaatccctggatcagtagttggtatacacatacatagttggatcacaacatatcacgaatgaattcaggctaaaagaattaaatacttacattagggccaggtaggccaacaactatcagagaacaacagcggaagacaaaataatataagggcccggttaacatgccacaggtagtcgactggggaacgagacctagaacaagaccgcactccgatcatcttgtgagatacgcaagcgtaccgacaagggcttctcttcaacactctcctaaaagatatataaatagcaagggtgagtaccaaccgtacccagcaagccaccacaacaacaatgcatatgatagagggtttttcaaggaatggcttcaggttcttttgcataaagctagttttgtaattcttttcacaagcctaagacctagcatagactgatcaaattttaataccagttttcacattaaacaacgacggttctatccaccatccattatgatcccaaggatagcttcccgccattgaatcgtcatggttttctgaggacgtccaccttcccgcctctcaggaagtggctccaacagcataaaatcatcatgcaatatcccatcccacacaagttaagaactttgagtctagccaagtgtaatacatgtcccggtgctcaataaccgcgagcacggctattcgaatagatttggtttactcacactgcagtggatgcacactttacccgcactccgtgactgcccaacacatgagcctcgtcccaacacatgagatgcgtcacggcaaagcttttcgatgacctcgcattggcagtacccgctccataaacttaaatcctcatgcactctaggcgtccatgtttctagcagtgagaggagttctggcgctcccgggaaagagaagtctcacacatatattaaattatggttcaagttaagttctctctctcacacactcatggcagtcctaccaatggcgacaccgatgtagggcacgcctctcggccctacctcaacggctgttccaccgtagcgcacctgcctcactcaggggtgaaccatctatgcagggatactgcctccgctcggctatctaatccgctaggtctatacccatatgagaagtgcggttgtacgggggtcgtttcatgcttaacttcatggctcggtccttaattgaccggggacggtactagccttttccagataccacccaaatcctccgtccgccccaggcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaaattgctgacgttgcctcacgactaaccgatacacaaagtctataatacgcgagaaaaaccaatattcaaacaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttgtggtttagtctagctaatggctatggaaggattatggctacacatgcatctatctaaataaaatggtcgtatactagaggttctgttgtcgggtggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctgatatacatgtttgtcatacactccctcttaatttcatatatgcaacacgcaaattaatattataccgtaccactataatgggatgtatagtatatgtgtaagcaacaatatcttattattggatcatatatttgagtagtttcttttactgtaagctatacaatacatgttgattttaagatggctctatttggttaactaatggatatcaactgactctatatatatatattctacttcacatgacattgtatcaactaattttttttaagtggtccaaatacaactagctctgtgattactctcctaaacaagttaaagattcatctatgtgtgtttatattttagttacataatcataaggctatacttgatttaaataacctataagccatggatttaattatatggccatcgaatattaaataagtactagtattttcctatacatccattcatttgagacatcacataaaattagtttgtgtggttgttacagtggcaagacatgttagagacaaaacttattacatccactctactgtacaatactaattttatttattagcatatttttaagttgactattatgcatcatcttgatattaattatttaatatttataaatatattttatcaaatagtgaattatatatcattggaaagcttatgaatttagatgaatttaggttcaagtttcactcaaatcggagctgaaatgaataagttatgctagtgtaaagattcaaatttgaattaattctaataattgtgaaatggtactgttcctaattcatttatttataatacaaccttatccacaagctatagtgactgacaggtggggtcaaggtcttgattttcttttctacagaattatttttctaagggaaattggatggaattaatgacaggtggggcccactctaacctctctcctccattctcttttctctctctcctctgttttctcctctctctcacggcctcggctagaaccggcgggcggcacggcgcgatggcaagtggtgggggagggggaggctcaccggttcggcggcggggtcgacggagacgcggcggcgaggtcgacggcgga

SEQ ID NO: 41673 - DNA, 6049 bp, Oryza sativa
ggggtaggaactcaggattaggggagtctgtactaatcttgtagcaatccaatgtaccaaaatttgtaagatttggaaagtgccgtcttcccttttttttttttttgatcttcaggggttggattggcaggctgggtgtgtgggcaatggaagcatggggaagcatgaccagtaacggtgggtgtttatatagagctggtttttgggttatcattaaacaaaaatagaggatgtatggccatactgtccattttatctcgttgctatgtccatactgtccattttctctactccgtaatttgttttgtgaaggcatgcagcagacaagcaccatgcgaacagtggcggagcaggaaaaaattatagtggggcttctcagccttttgggccttctaacaatctcctcccctttaatagatatatagatttaaattttagggaggttttaatgggggctctaatgaatcattaggggtaggggtataaagaccccccaagcccccacgctgcctttgccactacatgcgaaggtataattattttcccaatatacgaaaatttaactaaataggcacaagaatagaaaaatgtgttgagttttttcacatattttttagcattgagtttcattcgttatatgattttccccgtattgctcaatattaacccaactatgcactttgtaatctcatccctacgctcaatatttatacacacccatggtctattggctcggtcacaaaataaataaatgcatttcttatagcaatagcaataacatgaatagactagtaactcttgtgtaatgaccactgtgctcctaaggtttgcttcccattagctatgtggattatatttaggtcctgtttaacgcagctctagatttctcgaagctttgatatttcaaactcgatgtataattacgttgataatatttgaataaattatttttaattattgtataaaaatattaataaaatttttaaacaccataatttaatatataaacttcaaagccactatacatataagggcatgtttagtagagtttaagattctaagaagcagttagctggtagccagcttctaaaaatctttcacttatggctttctttctagttcattttcagctataccttttaaaggaacttctgattctgaaagaaagtgcagctaacacaaacaggcccaagcttttcctaggcagcgctataataagataagctctaccttaccactatttaatttttatataaataatataggtgcatttattctaattttttatttataggataaattttaaataaataatagatgtgcccttattttgggaggtaataaggaacaccaaattctctttccacattcacgttaccggcaaaaataaattaataaaaaagggaattgctaaccttcagtcgggagaaaatgcatgcccaaatcttgcagatttttagccactggatgagcttcatgattcgtgctctagaccttctcctccaactccggcaccctctttttctccaacgccggtgaaagcacgacagaggaccctacaggttaggatctcgggagtgggataggggtgggagggggatggggaagaggggggttcaccggctttagagggatgcccatgtgaggcaacgaatcgggcggacgatgaggcgtcggtggcagtcggtggcagtgccagagccacggggatggagaagggtggtggaccggctttgatggcaggggcatctcgccaccgatggctcgaggaggaaggaggccggcggggggggagggggtctcgctggcgctgttgatgccctccgggcagccgacaagacgggtggtggggcggtggctgccgaggatcaggcagtggtggcgaaatgcgtgatgggagcggtggcggcggaatgcgcgagagagagtggaattagagggagatagttagggttaagggctccgcacgaatcttaaagcatatccaacggttcaaaatttgaaacatggttggtgagattttctgcgaacaaatatagacattcccttaaaaaaaaacatatacatgacccattccatttcactctcgtcccatgagcaatcttggccttgtgttcttgatcctgcaattgctgtcacactagcaaaacaggaaacccaattcgatcccttctatctatcgatccaatccaacgctgcagagaccctcaaacttcacctctactctctctctctctctctctctctctctctccctccttccggcggagctacggcgagccttctcccccgcgccgccgcgcggccggcgagcaggttcggaggagtcgcggctcctcctcctcctcgccttccctagccttctccggcctcgcgctcgctcgctcgagccgaatttggagtcggaggtatccattctcatctcgtatcctccctccctcatcctttgcgcgcgccttcacgtgctgtgtgctggcgtctgtaggtagattgggaaatacattcggggtggttggatcgaatcgattcattgcgctccaatttttaagtaattaattcttccagttcgtcccgatttgcggcttcttgttgcctgtgtggccgcagtgttgatgtgtgttactggcagtttgtttccacggaaatttgagccctcccacgttagatccgcacctgcatagatctagacacgaaatttcttctcaagtgaggggatgggtgtagtgtagatcaaccacagctcctcctttcaagaggagtataatgatgtgcttgtttatggaatgtgcactgtcggtttgggtgcaagtctcagaggcgtaggtctacagccagatgaaagatttgttttgtttcttatctcttctcaatttaccagtttaatttgattgcattgctaattagctatctccgttttactaattatcgtatatctcctagttcatgagtcggcaccttgttgtttttgttttgttataaaggttgctagtgtttataggagataaattaattaatgagaagtatcacaaagggcttttcagccacactctagcattagctgatcggccgatcagagccgcccgacaacatgcagggatgagccctcctcagcttgagggttgttttctctgttcctactaatgttccctcttcccccacaagatatttggcctgttcttgacagacgcaggcttccgtgtatcatgttagtccagcacttctagtataattactgtgctatatgcccttctattaacagtctacagtttaatgttgaaaatagggaagaacataatgagaggatgctcaataaaaattactgaaatgtagagtattccacataattatcctgaaacctagttagtgcaaatatgattccacacttcatgccttaagataggtctatgactctggtagattatttgtctagtgcatgaccatttgttatgccaaacaaattacagggtattcaggaaaggcattatactgtttttgttgagcattctcttgttttgaggttctccattatgagcattaatgcttagattgcaacagaacaaaaaaagagcattaatgtgaatcttttacctgtgctcaaattcattagttattgcatgcctttgaatttcagaaggtccgaaatttcagatccagaaaaaatcaaacagtactattacagtatttgagaaattaagaaccgcagaacatgaaattatagtaacacaattgcaaaatccacaagttggaatgtgacgttgcaaaaggcgttagattaacaaaatatcattctgttagttgttacattcacttgatggttggtcccacctgatagccacctctctctttcctcttctccaaatctgaatctctctctctctctctctccctcgcccattcattactgaaaacagtgaacttgtaatgtaaatttctcagcactaacagagccacagagaacacatgaactaaacggtggtgttattttcataattttgatctgatctttataggatgatagttgataaagatcttcttttgtggcaatatttccctaatttcatgtccctgctatggtagaaaaatagttttctcaatatattttagggttagtgactagtgactcgtattgatttcacttgttttttctatgtgcatttatatatgcttatattattaaactcatgtcttaattaaaatatgtttctaatgtagattgtgatactccaaaatccaaattggattagattctacatgacaagagaacatggcacctggaagcaaggcagagagaaaagcagcattagatgctggagcttggatgttcaacattgtgacatctgttggtatcatcatggtcaacaaggccttaatggctacacatggttttagttttggtacgataaattgataatgctttattatttactcatatgtgtgatcacttggaaagatgaatctgtaacaaactcagctactgaacacatgcttgtactaatatgggggtgctattgcttgtacagctacaacattgactggactgcattttgcaaccacgactttgatgacattagtaatgaaatggctgggatatattcaaccgtcctacttaccagtgccagaactaataaaatttgtcttttttgcaaacctatcaattgttgggatgaatgttagtttgatgtggaactctgttggattctaccaggtgaagaaagtaactaagtcctttaatgttcacttttagaatggatgcatatactaatttgctcctcatgcctttttcagattgccaagttatgcatcattccagttttgtgctttctggaaatcctgtttgataaagtccgatactcaagagatacaaagttcagtataatggttgttctagtaggtgttgccgtgtgtactgtgactgatgttagtgtgaattcacaagggctcatagctgccataatagcggtttggagcactgcactacaacagcatgtgagtattgccactcctagattgtgcctttgttgtccccattctacatactgagaattctcctgtattaactaagtctctactttgatacttttgctcccaagttggtaatattcaaacctgaaaaaaaatagtatgtggtgttcccttctacagaatttccaagccattaatgtgaactcatgtgtattttgcctcatcctataaacctgaattttgtcccctttgttgtaggtttggtgagctaaagaatgtattagcttccatctaactactgttctgattaatcgtgtagaaaagaaatgtttagttagtaaaagatcttcaaatatttggatattgctcgtttgtctgctaatagaagtcttgtcccttttctacgcactttcatggcaaattttcttaacactattacttgttttgtttctttgcttctgtgctgcagtatgttcatcaccttcaaaggaagtactcgcttggctcattcaacctcttgggtcatactgctccagctcaggcagcatctttactagtactggggcctttcgtggacttctggctgaccaacaaaagagttgatactttcaattacacagcaatagttacggtatgcggtgattctctgtttatcttgttataaactgatcattagaaacccatatagctctactgataatttcaccaggtaaatattaattaccatgaaatatggtagtatatcctggaacttgaaacatttttctgcttgggttcccatcggtcggtctagtcttaggtggtgttcttttgtcctaaaaatgaagatgaagatgaagattaagttttttacgcaaaacgaggtgtcattaacgtatgattgattgagttttaattattataaacttgaaaaatatattaatatgatattttagagcaactttcatataaaaagttttcgcacgaaacacaccgtttagcagtttgaaaagcgtgccacgaaaatcttaatcttcatccaactcttgttggagaaaagacaacaagaaaagaatagggccttattataagccataacggcttatta

SEQ ID NO: 41674 - DNA, 3500 bp, Oryza sativa
tatcgtggcagggcctaacattttctttttttcatctacctgcattgtagttcttcatcatactgtcgtgcataattgctgttgggaccaaccttagccaattcatatgcatcggaagatttacagcagtctcgttccaagttctaggccacatgaagacggttcttgtgttgaccttgggctttcttttctttggaaaagagggccttaacttccatgttgcgattggcatgatccttgctgttattggcatgatttggtatgggaatgcttcatcgaaaccaggaggcaaagagcgccaggtttactcagcacccagcgagaaaacacagaaacacaatatactgtcatcacagtctgagcttgaccagaaggtctgaaatacaatgttgatgactagtgttttattgaacatcttgaggaccatgatctgatttattctttttacacgttttttagatgcttctatagaatttgtaggctatagcagaaagagggtacctgggcaaactgtcctggctatacttttgcggcgtatatgtcaacaaaaagtaactagatgttaatttgaattttaatatttctttaactgcaagagcagtgctgtgtaacttgtgttcctaaagtttttatgtgcaccacctgcatggggtaaaagtacaaatgactctcccccttgtgttgtcttggttgttttgacaataaattgtgtcattcattcagtcgacaagttagcagcatttgtatttggggcactatctgtaaacagtactgaatcctcatgaagagctttgatacaaaggattggttcctcttaggcaagcaaatggttttcccctcgttaggaggtcgaaaattattttactaactgtaaaccaatatcttttgtggctgctattctctatctgcttctcccttcagactgcacacaacatgagcagattgtcacactgagtacagtccatctgccaagtatatatcaacatcgtctctttattaatctagtaagagctgacataattgacttgatcctctatgtccagacccttctgtcgatacaaagacaagccatctgcacatcagcagcacatcatcaccttaccccattcaactggagtgcatttcttgcagcattcaacgtcactctaattgatactaaataggtgtgatttttttttataagaattagcttctcctcccacactacagcgatgggcggccaagtccaattcgcaagcacgcacgagctctccctcggcgccaatggtttgagtcagaccatcgtagaagaccacgtgtactctatatacatcgtgtatcgtacttactccattctaaaatatatataactatctggtagctaatatatactccataatataactatatggtagctatattattttaagacgaatagaatagtttgtatctcagtactgacggtttctttgctaaactcacttgataactacttgagagaggtttgtaaaataaaaaagaaaagtagaaaactgattgaaaatttctagtaaatacgagaaccattttgattagagaatacatatcaaactatagagtggagttctcaaaaaaaaaactatagagtggaaaattttcatttagaaaccataaaactttgtaccccacccacagctttacgtaggaaatgtaacattttgaatgtgatattcaaatttggatagttttcataggatgcaactttgaacttagatgagatgaattgagcttcaacgaaaatagtaacggtgaaatatgtgcatatggaaaaaaagcgaaggcactagaggaaaaaacagaatctcgtataggccctcccaccacctgatatctagttttttttttattttaaaaacaagtctcgcctttcaaagaaattaattataacgtgaagaagaaaattttcacttataaccatgttcctttttataaagatataaaatttcaccttggttttcattagcacacattttaaaatattaaatggtgtatttcgtacgaaaactttttatataaaatatcagataatttaattttcaaattatgtaataatttaaactcaattaattattatatattatgctaatggttttcttgttttctagtatattctaactttgatcttcaccatgttactactacttcctctgtttcacaacgtaatgatgttaatgaatgtatatagcatcaatatgaatatggaaaatattagaatagaatgacttacattgtgaaacggagggagggagtacaatactagtttctttctccaacctactaccatttattattgacgtggcggcgaaaccgtgtatctcgttgatggtattcatgcacatccttatcctctctacagtctacacccttgtaatagcaccaccctctcctccatcgcaccaaccaagcacacagtcgctcgctagcgaagcacgcgatctcgcaattcgcaagcaaaccaaccaaaccaagaaaaccgaggaagaaggaggcgaaagccattagccatccatggaggccaacaagagcagcaagccggagagatcatcatctcagcccacccacgacgccgtcgtcccggcgtcggcgagcggcggcgctgcggcctcctgcgaggcgggcaggacgccatcgtccggtggcttgccgttgtccaccgccgcgtcgagcgagaagaggccgggctccggcggcggcggcgagctgccagggtggaagctggactgcctctgcagggagtccggcatgtcggcggcggtcatcagcgggggattcccctgcttctgatcgagtacaactaggctaggctcctgtatttggacgcaagaatttttgtttggatcgcgtcggaattcaaactattctcggtgaaatctctctgaaattctcgcgtttcaaacagggctttgcaaagcatactttactacgtacttgtcttgtctagtttggttgtgttgctgtgagctatgatccatatatatgatatatgttcatcatgttcatttgtttgtttcttttcactcttaagtataaggttgtaagagatcatgctgatcaagttctactgatcttgtaattcaggtctgccaattcttcttagaaaagcttatgattaatgatttattttatggacatagacacaccaaccaaaagcctgtctcaaattaacccaaatatcacgaattattacatgagaaaacattaggaaaaacaagaaatggaaggtactacatcactaatagcagtatggattttggaggcagggttatcggggttagtagcttccaaattatgaaaaacaagaattggaaaggtactacatgtggaatggcagtatggcacatgttttgaaagaggtgttcagttgagttcatagtcagcttcatcatgtgctaattgatttgatgctagtttgtatgattcagatccatatctgctactaataaagattgcaaggttcagttgtaatatcagaagtttcaagt

SEQ ID NO: 41675 - DNA, 1936 bp, Oryza sativa
ataatgagagtccttcatgttttgctgtttgtattcgctccgccccaaaatataagcacgtttggacttcgacatggtcttccagatactactttgatcaatgatattcaaaaaaagagttgtatattgtaatagtttgtttaatgataaatctagtaacattaattttacatgattgatctttttaattttttttttctattaatagccaacgttacaaatatttgacttgacactatgctaaaaatacttatattttaggacggatcgagggagtatattagagagattagctccaatcattgtgttctcttccaaagaggggtctacatcatttttttagtcgccacgataattcaaaaaatcaagagcgaggacaaggtgacaatcatgctatattttttttagatgtacatatatagtgttgcatatatagagtagccagtagaaggagaaaaattagaggcgcatagtagagctttgttgcagtatgcatgaggttcattttcttctgtttaattcagaatactaccagggatatagctttaatgtacctatggattgatttagttcactcaaactaattccctgatgaaaagaaaagtgagtgaagcaggtgagatgctttttttaattagaaggtgagatgatttggctccacgattttgtccctagtgtttaccatggaaaacttctgaatggtcgatataatagcagaagattattatgtctgtataaagaaagtatatatggtcaccgttgcatgcaaatggtcgatggtatttaggcaaagttagaaatgttaacatggcatgttcgaacaaccactcttttgtgctgaatagaatggaatggaatggatgagtggatgaattatttgtgataattatttgaaggtacaaaagaacgaactaactattacaaattaaattcaaaaattattttttgaaaggtattctaagaaattcatatatatattgaaagttattagaaaaaacacactgtttaagaacttcggaagtgtatccattatctattccattccattcctgcatgtctcgttgacattttaattcccaggtgaaaaaataaggtcagcagcaacttaaaaattggtgccgaaacgggattgtgggaacaagtaaaaatttggcatagaactagatctcggttgatttatggatcgaaaattcaaacaagattcatatatatttggatatatgtctattggatggacaaacatcctcataaactctttgtatatccaataccagtacctacttgtcgaattacttcccacctattgactagctaggactaatactgtgttccaatggtaaacatttatggaggtccagtagtctatatcaactctagactttattttgacatattccaaccataatttcaattacagaattttcaacctcgagcatatttgtagtggtttcggatggcacacggcactggcattggtgaatacggaaattaataaactgtcgatgttctatataggcgatactaaaagggctagcgtacgagatttaaaagtggatggattgtatggataaaagtttagataagttcaggctcgatgagaggtaataccctactgtgttttgagaattgttattcaccaagtgtattatgttgatatgatgatcgatcagcttctgctttctcttgaacttataagctaaagggccaccaaatatgtggtttagctcaattctgggtattggaatttggaaaccatccggacagtattgtcattgttctgtcctgaagttccttttccagctgctagcttcaactgcttagcacggtcttcaacaaactcagtccttagcagggtgtttggaatttgggtgatttggactgggcccgttcaagattcggttgtaatttctagcactcggacaatgtgactgacaat

SEQ ID NO: 41676 - DNA, 5149 bp, Oryza sativa
  unsure (1)..(5149): unsure at all n locations
aattcctttctgaaaattaacgatgatgacattgtttgtgtcttctggaatcttgttgcatgtctcgaagaaacgccggatgaagtcctttaataatttatttttcagttgtatgacgtggtaaacgtcgaactgtatcccgggcctctcgtaggtgccttgaaaatttgcaacaaaccgatctcgaagccccaaaggccagcttcttgttgaatcagtgagtgccacaggcaagtagtttgccatggctttgctatctcctcctgctgcgcgaatggccaaggtgtagatggtgagccacgactcagggtcggttttaccgccgtacttctcgataccagctggattgaagtcggccggccagtccactcgacgtaggtctcgggtaaaagttgctattccttcatcagcataatcaggttatatgggtcgaccggggggggggagtggtgaactgcagcgatcctggtcttctctctcggcgacgacggtgttgttcaatcctgaggtctttgccttcccgatgcccgtggtcgtcttcctgtctatggtcactttcatggtggtcgtcttcacgatgattgttatcacggttttcgacgaaaggatttgttccgttattctgctcgcagtgttgaagatttgaggctgtgtggccccgactgctctcggctgaccggcggtcccttgaaaggtgaagagatggccatttgcttggtcggttgcccgatggagtcttgggtgtgttggtaatagactcctctggcggttggcttggtcgctgagtgcctctagctccctttcctattgtgcgaccgcggtgaccatcatggcattgaccttgatgagcatcagagtcatggcgttgtctaaggcatcgattagggtgtcaagtagcattacaacagcaatgctgttttgttgtagtttggatgatgttgtcacatgtcgcgcaccctggatgcattaggtcacattgtttccacaagcggtctttctcctctttacgtaggcgctcctcctccgcttcctactagatgtgggcctgctcgtcctcttttggtgctccaaccagaaagacttccctgagtagggtataatcattggagtacttggagctgtagatcgttcccgtgctgaatctggcatagtcctccgagtggtcgaggtcatatacaatctccgtgatgctgcaggaatcatcgagcaaacgaatcaggaggcttacttccctgggaccatgttcggacatggtcgaatcatgcctggattgaattcacggggacggtgtaggtcccaaatcgtcgcagcgagaagcggagagagttgcatcagaatcttagggtagtttgccgccgttgttggagatgttgtccgggtaagctagtggcattgactcccctggccaatttgaggccgagccatggaaatccgatctggagtgggccacagccgcattcgagagaccaaaagggaccgaggaagtctcgaaccccgccaacttgtttgaatctgagtcgaagactgaatgcttgctgaagttgtcggtgagaaagtcaaaactgccgaaactaaatgtcttccttggagggaagacaaatctgacgactcctaaagatgatttcatcacgattgtcattgtaaaacttgatgcaacccctacatggcgcgccaactgtcagtgtcctatatcaacagtagtaaaaggggtagcgtatgagatctaaatttggatggatatcaggacaaaggtttagacaggtttaggctgtgcacgttggttggtgttgggaacccatcaccctcacacggaaaatggagcggtccattagcgcgtgattaattaagaattagctttttttcaaaaatggatcaatatgattttttaagcaactttcgtatataaactttttgtaaaaaaacacattgtttggtagtttgaaaagcgtgcacgtggaaaacgagaggggggagttaggaactcctggtatcgaatacagccttaggccctctcgatgagaggtaatacctactcatgttttgaaattgttgacggtccttaaataccaaatataactatcaattcctgtaaaaaagcaaatcaatgaaatattaaacctattgataggatttattactaacaatttccacgagtgttggtgaatattgttgacggtccttaaatcataatatctgaccgtcaatacctgtatataatgaaataaaacatggtatccaacttagtggtaggtattattactaatcatttccactagtgttggtgaaatatgtgtatgcaagtaatttgaggagaaaacacatccgtcatatgacaaaatgcatctccgcgtattcaggacatatttacacggattagatgcccaataagtcaataaaaaccatttagaattgggccaaaacatagcccaggttgttgggggcccaataagcaacctcccagcccaaggagaggccgggaggagagtttttgggttcggccgaaccaatcctagcgcttcccgccatctgctttcacctagacggctcggatttcttcccagaggcggttgcaggttgttttagacaattcccatgcccctaactgtcatttggagcctatataaggaggagctcactcacattccaatagacacaactttgagctgaattacaagaggctctattgtatcttttgtacattagaataaggtagagagtaaggggaagctctggaggagtgcccggaagtttggcgctcatccgatttctacctcgacgagtgtagcttcttaggaggaattctagaggagtaccggagctgtcggtacactctgctccaggttcggagaacttcttctataaagtaagcattcgtgttcctttcttatgttatttaattatttagtctaagtaagataggttttcatctttgcgggttcattgtttagtattcatactaagtgctctagtactaggactcttgataaagaaggaagttcatgtacaagtattagagtagtaattaataacttagacgtggtgtctaggttacagattacctttgtttattgtgtattccacggatttgtcagaggtaggcggcaggtggtgatagctttgaatcccgtcccaataatcctccacgttcggatacatcatagagctatagccggaaccacgctggcagaccagcaggggtcggtgcccgaagcaacagataggaaattacctttgcttagcttagataattaaaacacatagaatgctcttctctagcttgcctagcctacctatagttgttgtccctggattgccttagccttaggtagattacacgcgttccctgagttcgatatctttttggggtcaccgaaggtgaaagtgctacagcggtattccgtgcgcttgcggatttatctgtggtcgtaagaaataccaacaagcatttctggcgccgttgccggagaacggttgctaatctttatttttatttcttcttcttttattcctttccttaatggagcaacccacaattcaaaacctttctgctcctcgggctaatctttgtgagccatcgtgttcttcaaaaccaaccctttcggatggctatgaaatcagtcctggctttatagccatggttcgagagaaaaccttctctagtagtatcagtgaaaacccatacctccatcttcgggactttgagctagtgtgttcttgcatatccatcgtaggcatgacacatgaaactcttaagtggaaattgtttcatttttctcatagagatgaagcgaagcaatggtacactatgtctgtcaagaaattccacggtgaatgggagtagcttaagtgcaatttctgccttactttctttccattaacctgtgtaatcaatcttcgattagacatcctttctttccgacaacgagaaggaatccctcggtgcagcctgagtaaggttctcactgttaactcagtttggcccagacttgtctttacatgaccatgtgttgttacaacatttttggtacaggttagataaggagtctgttgaaaatctgaattccgtgagatggttttttttnttggggcccaaanccaaaattaaaaaaagggnaacccaaananncttggtnnncggnaaaagggaaagagaacttcctnntaagatcttatcttcgnaaggnaaaantgaatttcnttttggccaaagcgaagnccgtcccggaggntcgagattatccatgaggaaccctctgcacgtggagtcggaacccgactcaactatcgaatcctcatcccagtcgcaggagccggaggaagaagaaattcatcctccggaaattccattccaattcgaggaggatcttttcaaagattatgagaacacctcgaattattcctgcgagaagagaccaccgaccaaggtcaattctaatgaacctctcgataaagctatgcttaaagagacggtgaagaagttgaccaccatcgtgagtaatgaatgtttaagggaaggagagctctcatctgaatcgattcagatacgatgccactcctcaaccattacgtgtctcattggaggtaatttggtccgtgttctgtataatccctctgttggtgccaatattatgtcagcaacctttgcatttgattgcttaggggacaaaccgttggaaccaaccgtcaaaaccttccgaatttccacaaactctactaccgaaggtttagggattatctctggagtgcccacacggcacaacagcgttgaggtcatcttagattttcatgtgttcgatatatctgatttcgacatactcataggccatcccatagagaaactcttagatatgcccgaatccggtgtcctcaacctgaacataggaagaatcgccacctctgtccttgtgttgcaatcaatcaattcattgacggagcctcttcctattcctgaaccaattgagaaggtgatggccatttctccattcgaggccccagagtctatttcaatgaatccatcgaagaattcaatgaaggggaggatgaatctggagaaacgattgaactgccaaaaatggatcagccgtcacgtgccccaattgagctaaagcccttaccttcaggcctacactatgcatttctaaacggtgat

SEQ ID NO: 41677 - DNA, 703 bp, Oryza sativa
agactgtcaatgagattgggaaggcatggaagaacaagctacctgatgcatgggcatataggactgcttataagacgcccatcggcatgtcaccataccaccttgtctacggaaagacttttcaccttccagtacagttggaacacagggcgcactgggctatccggacttggaacatggacttaaagaaagccggacagcacagaaagatgcagctctctgagctagaggaatggagggacaaggcctaccacaatgccaagatctacaaggaaagaacaaaaagatgggatgataaatgaatcaagcacaaggagttaaaagctggggacaaggtgctgctgttcaactcacggtgaagcttatcggacatggaaaacatcgaagtaaatggatgggtccatataccatcgtcgatgcttcatcgcatggagccatcacgctatgcgacaacgaaggtaacatcttaatggtatccaacttagtggtaagtattataactaatcatttccactagtgttggtgaaatatgtgtatgcaggtaatttgaggagaaaacacatccgtcatgtcaaaatgcatctctgcgcattcaggacgcgtttacacggattagtggcccaataagtcaataaaaccatttagaattgggccaaaacataacccaggtggttagaggcccaataagcagggctgcaggaat

SEQ ID NO: 41678 - DNA, 753 bp, Oryza sativa
tcctgcagcccacaaacctttgtactaaagcatgtaactgatccaacatgaacttggaaggtgatgacatcaaatttgtgttttatctttgttactgcattggctgtgatatgctgcagctccgccgacgtataagaaacaggacggctgaaagccaaacatgggaatcatgctttgcttaaagcattacagtggaaatctgacagccacagtgaaagctaaatacccaaaggctatcaaagaataccaggatcaacatattagccaccaaataacagcacacgccgaggattaaaaaacggacgcctatgataagagtggatctagaaacatctcatcacatcactgttttgatgcaacgtaaaaaaccattagcattcatttctccaagaaagtatctgaatcccggtggttcaaatgctcgccatcaatattaacatgactaacattaatgaaaaaaagcaacacctatcttcccgggggtgcagaaggcagcggcaatattagtttgcttccgttaatgagaggaacgtcggtacgtgagtctgatctcccttttcttttcacctcaaacatgaaggatcaaaatggaaagtctgcacaacaaaatatgctgtcaggcaacgcaatgcaacatttgacataccaaggttacacaaacaccagtctttcagcaactttagaagccagaagatactaaaatgtttgcatgcaagccaaatttcttcatatgaaaatttgaacatacatctc

SEQ ID NO: 41679 - DNA, 9986 bp, Oryza sativa
  unsure (1)..(9986): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgaattaactaattgatggtgggcatctgctttttatgtatcttgtcgccctactaaactattattcatgcatgcacaattaaactttttcttcttataaacgcattacaaatgtaggcgctcacaacacacgtgcactcacctctatgaacatatacgtacaccctatctctataagcatttcttgaagactggaccggtaaatcttgagattaacgaagtcaccacgaccgtctcgctgtcgacggatacgtcacctaccattaaaataataattagttctaaatatgaacaattaagctaaacaggcacgtggtgaacaaattgatcgaccagtgtataataaaaggttacaacacataagatgccgaaaaatggacgaactaataaaaaataatttataagtttttgtatttgtgttattagtattttaaaagtaaatgctagaaaatagctagaatacagcgaaaagactctaaaattaaattaagttttaaaatttaaatttgtgtctgatatgctaataagtacagtaagggacttaatttgtatattcaaaatgcagtctcattttctttttcttgttccttcttcgaaatttcagcaattttctcgtatcaagaaaggaaaatttcagcgtgtttctgctgatgaagcgttgcatgtgactaagcaaattaaagcatctgtagtttctgaagccggaacctcagagcgggtggatcggcgatccaaatggggtccgaaccccatttgacctctatattttctcacacacgctctgcatatgtggctatatattttcttcttctcctggttcagtggttgagtacgtactttaagggattgatttttcttaaccctatttgattaattccttgtgatcaggcacagagactaattaattaagtaattaaagcctttaaaggaacgagaaagtaagaaacgtcctaatggcagattcagttcatattatattagcaaaagaaaagcagcagtatctgggtgggttagtggggattattatcgccgccaattaaaagaagagctagctagcgagctaagctaatcgtaggagcacccaatgggcaatgcagcaagtgatcgaatgggtaattaattgactaattaagcaagctttgcgattgacttgtggtgtgcagagcagatgacacacactttaatttggcttgcttaatggctaaggccaagccatgcatgcaaatgcatgtatctcaaggggtaaaaaaaaggtggcatttgcatacgcacttacacgtaggattgaaacatgcacgagagcaacccaatgtcatatatggctatatactcaggcatgtgcttatgtgcattggttgcatggggccatatatccatgcatcaaatccgaaggtgaattaagcagccaagaggcatattggttggttgcatggagcattcggatacatggcatgttcactttattatcatttttaactctattaaattggacactatcacaattcctagtaagtctgtaggctgttattttttttcccgtaaatgatctaaaaaaatttcgtcggtaatttttatcggttcacccatggtaaaataattttcgacagtacaatgtgttataatgtattttttttcgacagttttgggcttataggatagttctggtaactaataaactaaagataaccttaacattattatcctattaaatttggtattttcgaaagtatcttatcaagaaacactatacttagtctataaacgaaaacacataacactgccaaaaatatgctaaagctaaaatgtgtcaaaaatttaacattatcaaattttagtaagttgactttttaggacaaagtgaacgtgccaatatatccatttgaccaccctcatcatccatctattcattcgagatcgatcgattcgtttatttcgattcatcaagagcatctgcaagagacacatatcgcagcgaggaaatgacaaggaaaattaattatggagagattaactcgatatatccattccctgcaggatgcagctaacagtacactgaatatataaaaccttcgtcagaaccagctggtaaaacgccaccatagcggcatgcttatgagctgctttagctgacatcaactcttaattaggatgattaacaaaacagtaaatcgttttggaggttaaatatatgcttagtttgatcataatgtgttatttttttgaaccagaggggttcggtgagtaaaattccgaacccctggacctcctttttcccttctctctctgtcttttctttgttcgagatgcctcgtttttttttccttaggaaaacaaactgaacaaagcaagccatgggcccatatggcccaataaaaaagtgttttccccttaaagaaaggacccaagaaaaatgctgggccgtacgaaataatatctggcccatcgttgggcctacagatggtcacggggccagagtaattaaatgggcccttgagtatatggaaacttatctgctggtctcgtacaagcagacaggggcaaccaatttaattacactatctgattgttacatctgttcttttttttttaaaaaaaaagtcttgctactatcatgtaataagaacaataatagtctatctaggtactggaaataaaagtaattattgatttattggaacacataaagaaatgaatgcaaaataattagtactatagtaatatcgagtagcaaataaacagacgatgccccgcaaaaatgaaataaaataaacagacgatgagttgtgctacgtagctagcagatcaatcccctttgccactcacattgttggcgatagcatcataattaagcatatatgcatccacgagtttgaggaataatcgaattaacagtggcgtggttatcgacttatcgtcctttggtgtctgcgtcgacgttgacttcatcgctgtgtacgtatacgaatgcgcgtaattgtgcatattgctgtttacgttgaatttaaatataaaactatcaaaattttagccgaatttgattctaaatattaaatatttatgacccaaggagatactaggttgctgggcaatcacaatacacacacacacacacacacacacacacacacacacacacacacacacatatatatatatatatatatataaaacatcaagacaatgattcgtgcccatcctgtaaagtgagtcatacatatcgtgaaaattagctttagcttaccgtgctataccacaaccaaaaataaagcaattctctctcatatatttgatggacaagagctaatgcggacgtttttctatccattatagaaattgctttaacaataattaactattttagacccacttctataaaatcacaaatacaccagatacatcccgcttgcggtcaaagacacgtgactttgtcactgacatgtggaccctgacaaaaacatcgtgcattttactgcagaggatctcaattttaagatcatgcgtgtactgttcattcatgtttctctgcccaaagagcatgcatgttactgttcattcatgtttccctcacatgcgtaggtgcagatgccaactcgatggaacgatcaccttgggcgttcctggacctcaaatcatgcatatgtgtgacgtgtggtccgatccagaccaaccgtgcatatgcatatgctactgctagcttctcccataagaaaagccgagcgatcggtcggcaacccggcatccttttccctaggtggacatacaccgtgcagtcgtgcacgtacgctgcatgcagcataaaccgaccaagagacgaccttagaacatcttcaacagagttactatttttactatccaaatatctatttgatcaatttaccaaaagaattagagccggatttttctttcactacaataattctccgttacattctccaatctgacagtgcttttcatatgttggcatcctactctttttctttcctcacgtcttctcaaccaagtaaactcttaggctgtgttactcaactttccgtagtttcccatgcctcagttacttgtgatccgccgctccttgattccgccggtcttggtcgcttaattgcatttctgaaactagtcgagaaggcattaacaattatctaattaaatactatggacggtgtaaatatatatacatgatcaaggaaaaaaaagcaataaacatacatataatatatagtggtctccctatcatgagagtacgatgatactgtgcgagttttctaaacaacagtttagtccaaaccaggtcgccgtcgttagcgcgacagaaagtctagattagggatctccaacatcaactctcccgtgcatgcttgctgctttcttgctccacctaacaattatttatttggtacaacccaatcagtgactataaccaataaactgccaatgcacctagcactttattactactacctccatcccataatcacaattttacactatctactatcaatgtttaactatccgtctaattaaaaaaattataattaatatttttattattattagatgaatggtcaaacgttagacacataaatccacaactgcacttaaaataggatgggtagtactatattcatgatatattatggagtatataatgtgagcctcccagtgataatttttttaattatattatgtgtagtggcaccatctcaattgctttaagattctcttgattatatttagtgataatttattgttcttgatttatgcaagcactacacagacagtactgcattattgctactacatgtacatgcagtggtccatatacaaactgcattttttgacagtaggtggaaataaggacaggagaagaaaaaaattaatactactatactccactagcatctccatataaaaagccagcggaaacaacaatctgacaacagtttctgatcctgtgtgtacaacagtccagcatggcccacaagcagtcaggcccctgcacggggtggcccaccagtcagcaatggaacagaccgatgtggcgatggacgcacgagaggcatctcactgactgcaagttctaccgatcctgacttctaaagtgaaaactactgaaagtctgaacgtccgaaaactaatgcaaatgcaaacctggagactcaaattctgaagctaattcaaatggttttgcttgaaaactggaagcgtcagcaagaacctagaaaccgtgtttgcaaatgcaacacatggattctcaatttctcatactgaattcttgagtagcataatgttttcagaagaggtaaaatggacatgaagactcatcagaaacatcgaaattctcctccacacaacatcgatttcatgcatttaggaaggacattgatcttctgcgtattttgcagaataaagattgtaacaagaaagaatctttataaaactatctgtaataacttttttttctgtattttaatataaatatgtcactgccggcctgccgggcgaggctcgcctgtcagtgtttccttaaagagaacatacagatgtttcgattcgatcggtttgtcttgcttgttttctgtgatgcatttggcaacgatgttgtgatagctgtggagtcgaagctgctgtgtcgccaggcgacaagcccggcaacgataacatttgcctcacgaagtcgaagcctttgtatcgcttacaacaagctctttatcgatagctgttttgggctccgccatttttcctttttccatggtattggtagcttaggttagagtgttgtggttttcgtccagtttttccctaattaactgtgcattgtaaggtttagtctcgttttctccttaaaataagacaccttcttctttatataaaacgtcggcaacagcctgaccgttcgaaaaactactacttaacagttctgatctatgccagtacatctttctcattgacttgatttagggcaaatcgctggatgacgaagtgataatctaatatgttaattagctacgacaataagcgagcgcgggtgcctcaaacatgatgtcattctccaagtcatggccttaattaaacatactttctagccataatggaagcatcaactatatatatggtggatccctgatgatgattgctaacatgataaggccacgattaattgtcatcagaaagagggaactaaatcaattaaactgaaattttcacttgctataggtttatgggcttggtaggtggtgatacactagctagcacattgacaaataaccacgttgatctgacccatggaggtgaactttttccccttagatgaatggaatgaaactaatgctacatcacatccacacaaatgataaaatgattaattaattaaccctgtcactgcattatcataatagtaagtgctgctagagatagcgtggattttataattttgcggtggactctcggcggattttagaaactcgtgatggcaacacgtggtacatatgcttgccacgataacatgagtagtgccgcgtgtagttaacaagatagccacgttgtaggttatatcaatcttattgacacaactcgtgacaacactatggctacggcgttgtcatttgctatgatatcgagactatatgaccataaagggtacttccaacaaaagtgacacggccatgatggcactgtggctacgatggtgtcgttttttatgatgccgaaactatgactataatgagtacttccaactagagttgacgagagacacgtccattgataaatgtgatcaatggttatatgggtggatttataaaaatataaatgcatgagtatgattcaatatttggttatcaacgttccgctctgggagcgcattatacaataaatttatgagaatggcatacaataatagtatatatttacagcaatatatttttatatgcctttactatgttaagaattgtagaacaaataatgtgtccatatcaagatagtgaatggcacctggtaatttattccatgggaacacaaacattgtcttgctccaagttcttacatgttgccggaaaagtgccattgatcgagatggtaatgaatcatctcatcttgattggaacgattaaatcttttactaccatcatgatgtgatccattatttaatttgccagttattgttgtcatatatatctatggaccatctattgttatcacacaattttatgcagttaggatcagaaagttttaatccagtactcattatggctaaaaatcctcctgttttacatttgacgatttgaatattccgatcgatctccatagttttaaaagaacttccttatttgatgggtacttcttgttagataccagtatgtacttacacatgatttaatgacaatttgcatgatgcacgcagttgaatgcttctccccctcctacgtaaattggaacgggcagactttggtccaacaactcacatttgactttctcacaacgatctatcttctgtagactgcgtacttcgtcgccagccaatgtgagtgtcatacatttcaatgcttcttaacacgtagcagtaccgcacaataactttgcatatgccccacaaagtaacaaatgtctccaaacatttatgtgagtaattatagtttaatataatataaccttattgttgtcactacatttgaactctataaaaatgcaatgggaattggggagtgaggattggacataaaataaaagtccaatacccaacttcataaatattctgcaactcagtaattgtatgcatacactgtaaaatcataaaaaaatgcaaaaagaaacaattaatcacatcatccatatcaagttagaccatataaattaaagttgctttgacttttctcttattcaaattcatttaaatttgactgaatttgcaaaaaaaaaatatagcaacattttcaacacaaaacaaatatactatcaaaatgtattcaatgttatatttaataaaactaatttggtattataactgttgctaattattctataaaatttaataaaataaaaagtaatatgaatcagagagagtaaattacagtaacctgcatatgatttattttcccctaacctgcgcggagaaaattgtcgtgtagccaacccggggtgctccttgcaaaataggcgccccctatttgtaccataccaccgcgctacgcgtccccatcccatcccccctccctccccttcttctgctctttcccctctcccccacttctctcgtcttcctcttcgactcttgcagtttagtccactccattcccaccaaaattcctctctactcccaaattccccccacccctcccggcgaattccccccctccgccgctcgattcggcgctcgaatccgccgtctccgccgccaattcgctcggtccggcggttcgctgatccactctctcgtttttttgttttttttttaccttcttacgcggcgattcggggtgtatgagctcggtttcgcggcgggttggttgatttgctccgccgcgtcggagggcggcggcgcggggaagaggggggcatgtgggtttcgctggtctggatccgtgggtgcgtgggcgtcacgttcgtcgactacttgggcgggagggaagccgagtagatccttttacgcggtgtgccggggagggaggtggtggttgaggttgaggttgacgaggggttctagggtttcgggggcggggggccatggaggctgcccgggtcggggcgcagagccgccacctgtacggcggagggctaggcgagcctgacatggacaggcgcgacaagaggctgttcggctgggacctcaacgactggcggtgggacagtgaccgcttcgtcgctacgccggtgcccgccgcggaggcgagcggcttggcgctgaacagctcgccgtcttcctccgaggaagccggggccgcgtcggtgagaaatgttaatgctagaggtgactccgataagaggaagcgggtggtggtcattgatgatgatgatgtggaggatgacgagctggtggagaacggcggcgggtcactgagcttgagaattgggggtgatgctgttgcccatggagcaggggtgggtggtggtgctgatgaggaagacaggaatggcaaaaagatcagggtgcagggaggcagtcctagtggccccgcgtgccaggtggagggctgcactgcggaccttactggtgtgagggattaccatcgacgacacaaggtctgcgagatgcatgccaaggctaccactgctgtggttgggaacactgtccagcggttctgccaacaatgtagtaggttagtttaattcaaactactactgcctttcattctcattctataatttgttcatattggaatgattaggtagaatatgctatgcaagtttgatgcaatgcggctaaacagattctagaccctcacaaacttccaaccctaacaattttgtaagcattggattttgaaagtaatcctgatgaatatggtaaattaaattgataaaatgatagttaaagagaggagttggtgtgatctatcatctgtgcatgttcaatctagattggctgagataaatttatacgtagacttgtctgtattatatacttcctccgtttcacaatgtaagactttctagcattgcccacatacatatagatgtgggctgcagga

SEQ ID NO: 41680 - DNA, 27017 bp, Oryza sativa
aagtcttacattgtgaaacggagggactattatggaagtaatgattttggatcgtaccttttgattttgaagaataattttaggtatattttttttccttctcatcctaaagtcaaattctcaaattcatgatgatatgatatttgtctgcaccttttgagcttagagtgtaatgattctttaactcaggacgtggtttattaatttgacatctgtcacagcatatgggcgcagtggtagtaaaatgaaaaggacaccataatttgtggagcgaagattaaaatgacgatgcttatgttgtaattgtgaaaaacacggactatcagtcataggcaagatttagtgatgatgctggaagaagtgatcaacgtagtgccatgctaagagaaatcgttagggattaactcttatgaaagcagtgaatacaaccgaaaaggagtcgtattgcacaacccatttgaatatacgatataaaagaaaatgttcgaaagtaaatatattataaaatggcctatgcccttctagctgtgcctgtatatctaagatctatgtggtactgccgatggctcagctcaaaattacagttgtacgtgtcataacaatcagactgctttctctcgtaatttctttggattattttctcttcaaagaaaatacttttttatttccaacatctgtactgaaagtctgaaattaattttttttggggaaaaattagttgaagttgacaaagccagaaacatttttgctaagatattttttgaatcgtagaatttctgagaccatttttacatttcgtaattgctagaactagtacgcacgtttttcatggaccagtattttcatatattctttttcgtctgatgtaagagaacatttggttccttaatgtcctcatttgtgcatcccacgtccaacagtaatgctttcttttgctcacccttttatgtgtgtgggttgttcctatgcttaacaccactgtcaacttttagaaaatattgtgaattcttcttgggcactgtcaattataatagtttttacagtatttgtttttcatgcatattttttcataaatgtttcaaaggaactggcactctgttcaaagagtaccgtgtgattacatagtgctaatactatttacaatgtactgtgctatggtgccatagtatgcattttttttttcaaaaagatatgggtgaactctgtaattactgtacatgcttacatgttccttttacagattccaccctcttcaagaatttgatgaagggaagcgaagttgccgccgacgtttagcaggccacaacagacgaaggaggaagacccgccctgaagttgctgttggtggttctgcatttactgaggacaaaattagcagttatttattgttgggtctccttggagtatgcgccaatttgaatggtaagtaaacatattcttatttgaactgtaggtaatgtttttatggtacaataacatagatcctccatctgcacgtatgtattggtgagctggtactagtatagtttgttttcaattgcgtacttgagtttgactttatctgaatatgtttctgagtgaatttacttggtattgattgaaataagacttctgatgttttcaagtaaggtagcttttatgttgtatatggttcttgtttattggaaaggttgttagtggcatagtttctaggactacaaagactgtagtgtggtactagatgagttcatagttaagtcttatattcaactcccagatttgcttacaggaaatttccacctttgtgtcaagattgcctatcctatgtcaagacttcacaacagcacaattctgcaatcttttagccatttgcttaaatgtagagcctcccaaaataacgtaggaatacttctagtgcctagactggactattatgaacatacttggtccatgcaagctagttttatgataatactcacaggactccacaattgtacttgcagctgacaatgctgagcatttaagaggtcaggagttgatatctggtcttttgagaaacctgggggcagttgccaaatcattggatccaaaagaactctgtaaactcttggaggcatgccaaagcatgcaagatggatcaaatgctgggacctctgaaacagctaatgctttggtaaatactgctgtagcagaggctgcagggccatctaactctaagatgccttttgtgaacggtgatcaatgtggcctggcatcatcatctgttgtaccagtacaatcaaagtctcccactgttgcaactcctggtgagatgcacaacatttctagcccttcagtgaatgtttccaaatgaagattttaagttacactagtggctttttttcacagaccctccagcatgcaaatttaaagattttgatttgaatgacacttatggtggcatggaaggtttcgaggatgggtatgaaggttcacctacaccagctttcaagacaactgattctcccaattgtccatcatggatgcaccaagattctactcaaagcccaccacagactagtggcaattcagattcaacatcagctcagtcactgtcaagctcaaatggagatgctcaggtttgcaaatttgttccttgcaacttaatgtaaagaaaactagtttcccaaaactaaagggatcgcttcaattttcaaatgctcacgacttattggtctataataacatccttatcttttgataacaagttaacaagaggtacataccaaataaggaaataactatcttaagtgggcattagttcaagtgggattttgaactggaaggggattttagtgcacttctacaagggttggagtgctgtcaaacatgccttaatttatgcagtactagatatgcttcagattctgttttaaggggtatataagtatgaacttaactgtacattttgaacttaaaagttacacacttacacgtgcatgacttttcagtacctttactagaaaaattgttgcagatatcatcaagaaccaaaaacattaagtctgcagagaaatttgaacagaatgcacattttcccagatccaaatttaactgactcatctgcaccagtgaaatgtctctaactaattcatcgcatctgtttctcacataaatgccacataaacaaggtgaactgaactaccttttgatcagtataaagaagtgcatgaagaaagagaatttctactgataacaacagtcggtctagtacatacgtattgagatgccaaatgccagtattttctattttgtaatattgcatagtggatttgcacctcaaatatgttgaaatgcgtgtgctctctctctctctctctctctctctctctctctctctctcacacacacacacacattgattgtcattatgaatgcttgcagtgtcggactgataaaattgtcttcaagcttttcgagaaagttcctagtgatttacctccagttttgcgatcacaggtaaattatgcattccctcagcaacgtggaagagtaaatatcgtaaatctaacacttcaatcctgaatttcagattcttggttggttgtccagtagccctactgatatagagagctatattagacctggttgtattattttaacagtatatcttcgcttagttgagtctgcatggaaagaggtatgatttttcaactaattatttcatgtcatgacaatgatctttttgcttaatgcttgatagcttgatgttttcctcttatttactacagctctctgataatatgagctcatacctggataagcttctgaatagttccaccggcaacttttgggcatctggtttggtatttgtaatggtacggcatcagatagctttcatgcataatggtaagcccgaatgcttagttagcgcagtgctcttcaagttctattatacatattttacatcggaattttgttattctcaccactcctttatatcactgcaggtcaacttatgttggacagaccacttgcaaacagtgctcatcattactgcaagattttatgtgtgagaccaattgctgctcctttttcaacaaaagtgaatttcagggtagaaggcttgaacctagtcagtgattcctcaaggtactttgccagtttgcatctacagtttacatatgtttgttcttgatggagacataggttgatgtttgcttaagcttacttgtcatctaaagattgatcatctcatgttttcaggctaatttgctcatttgaagggagttgtatattccaggaagacaccgataatatagttgatgacgttgagcatgatgatattgaatatctgaacttctgttgtcctctccctagttcaagagggagaggatttgtggaggtacagcttttcatatgtctgctgttttcatgtgtctgttttctgtcacaacctttgaatttactagaatgccatcgttaatttcaggttgaagatggtggatttagcaacggcttcttccctttcataattgctgagcaggacatatgctctgaggtctgtgagctggagagcatatttgagtcctccagtcatgaacaggcagatgatgacaatgccaggaaccaagctttagagtttctaaatgagctgggctggcttcttcatagagcaaacataatatctaaacaggataaggttcctctagcatcctttaacatatggagattcagaaatcttggtatatttgccatggagcgggaatggtgtgctgtgaccaaactgctgttagatttcttatttactggactcgttgatatcgggtcccagtctccagaagaggtggtgttgtcagaaaatctgctacatgctgccgtgcggatgaaatctgcccaaatggttaggtttctgctgggatacaagccaaatgaaagcctgaagagaactgcagagacattcctattcagacctgatgctcaaggcccttccaaatttacccccctccatatagcagctgccacagatgatgcagaggatgtattggatgcacttactaatgatcctggactggtattccccttatctataatccttaggatatggttttaagtatttgctcgtattctatgtgccttttgcacagaaatatagacttccgttgcaattgatgttgggcacatcaacaacggtgccgtgccatgtgcactatagatctttctatcctagtttttttaaaaaatgaattacacttgaatatcctgtctaatcttcctgctgctacctgttattgcaggttgggatcaacacgtggagaaacgcgcgagacggcgcaggcttcaccccagaagactacgctcgccagaggggcaacgatgcttacctgaatatggtcgagaagaagatcaataagcatcttggcaaaggccatgttgtcctcggcgtccctagcagcatacaccctgtaataaccgatggtgtgaagcctggtgaagtcagcctggagatcggcatgaccgtgccgccgccagcaccgagctgcaacgcctgcagccgtcaggccctgatgtaccccaactcgacggcgaggaccttcctgtacaggccagcgatgctgaccgtgatgggcatcgccgtcatctgcgtctgcgtcggcctgctactccacacctgtccaaaggtttatgcagctcctacattcagatgggagctgttagaacgtggaccaatgtgaggaggagcttagaatggaataagtgtagttgtgttttacgtaagtcgagagcttagtgtgctggctaagatcaaaataacagtactatgtgaggaggatgatcctttgtatttaaagcaggatcgtttcgtttatataaaagcttacataccgtcattattaattattattgattagttattattatttatattatatttaccgcctaacatgtaaacagaacatatgttccataaaattcatggtgtggttgtagaattcattctttccagagcttcttgttggagccatgcttctggctgctttcggttcattctagacttctagttttgtggctacaagattttgtcggtgttgtattgttgtaaactcggaataaaacttttttttttcgtcagcgttgtattgttgtaaactcagaataaaacatttttttcatgcgctttgtgagtgttgtattgttgtagactcggaatagaacttttttttttcatgtctttgcgctcctttttttttcttgtctatatatcacttgagatcaaatgttgattcagaaacgatgctgaatctttcccaacatatttgttgtccaagtgcactggacgctcaaaatgcgtgaaaaccaggtcgatttgaaaagtttctcaaagtactatcatgatacttcctatctcggagcttgttaatggtacgctatacgcatcggcataattgtaatatcaaacccaacggtaactagtgagataggaaaagatatatttcagcactatgtatcattcaaaatgtgattcaatactggaatttcacatggagactgctctcatattgaaatttcacatggagatatagcatgctctccggatgtttttggcttgcacacctaatttttcactgaactgatgagcaccatatgtcataaattatacaaccaaaatttgcgaacttaatcaggttcaaaatggaacatgtaagcttctttttcatcctgataaagacgtacattttgcaatgagtaagtgattctctggagaaatatttgatgggacgtagcttacaagatctgcatctaaacccttctctctaagccataatagcctaccagtatcaataatatctttacacataaaccccaaggcagctctctcccctgctggtatacttcggatgagtctatcgattccgctgacctccacatcagacttctctgcttttccgcacctgtaaaaaaacgtagcgacaaacatattaagcttccgtgacaccattcgagaatgattcaagaaaacgaactgtaccatgtttttgcccatacatgatgcatcataacaatttaaaagggtgatacttcccaccaagatttgaacagatgatcttttatagctatcagaatgtagaagaaaactaaggcttagttcaactaatggttcttacctgtcttctacagatgagtcttcaacctctaaagaggaatccggggagctgtgatcaccatccacagcccagctgctaaaccaagtcatggtatggaaatcttcctctgtaatccctaaccctgagaggaatgtcttatctgcaatgagaacaggaacattattctctaagaagaaaatctaaaggttttactgcaattttcaaaggaggacggtataatattatataaagtagtcaaagctgtaagcgacataatcgcacgatacatcctaaacaaaaataattagcagcattggctggcaaaaaaaaatttacttgcatagtgattccattggcacagatggtggcagcaggtggccaaagcaaggccacatagattgcttttgccatattctttttcatgtgcctggttataccgttcatgaaggcagcacatcatggtcatatctggagaggacaatattcattatatacaatcaagcaatcagttaatctcattgtcatgtattatacatcagtttgtcggagtataaaatccatgaataaatttcatatgttagaacttagaaccacctgttgcaggtccacatagatgctttccaattgctagataatgaagtccactcaatgcctctattccttgaaggttcaaatcttcaactgcattgtgtttatgtttcttatgagtgcttatatctcttactatctcaaatcacagggtatgaatgtgacaattcgttttaagaacacagagaccacccacacatgcatataagtgaactgataacaaacacatttggccttcagcaccaaaggtgcctaaaaaccacttcaaagaatgaaaagaaatcttactatcaattctcaaacgcttcaaagtaacgccttcattttgtcgcaaacttcgatcagcctagaaagtacagagaaaaggaagaaacagggcaacaacagagcagtcaaagaaccaacctaagctgaaattagatttaacacaacaagcactttcagaaaataacaaaacaataaaagttttactgcaaatcatgaggaatacagcaacaatgtgtcgaaacaaactcaaacttcataaggcactagacacagataggacagtgcattaaattcaaaatcactgtaaacaacctatacatgccttcatacttaaagttgagacatcttaaacaacgaacacaaaatactgaattaactattgttgagcataatagcaagccaataaattgcagatatattctaatctggcacagaaataagtaatgtccttctaaatttctacatgaaaaataagctgaaattgatttcaaaaggtcgaataaccaatggcaactgtccatgtttgacaagctcaaagtagatatcatcctgaggcaatatgaacagagaaactgaccttgagcttgtatgatcttctctcaaccaagaaaacattcctaatcccgtagcagtctgccagcatctgagtcaagtaccctctccctgctccgaattccaccactgccggagcatttttcacaccattctcctccgccacctcacctcccttctgcagcaaaccaaatgcctccatattgccaatgatggatgcctgctgcgtgacatgcttttcctggtatggcaccttcctgcccaacacaccagcttaaatcactcctcactacaaaatcctcaaaaaaatccaacccttacaccatcaaaagtggtaagcacacacacctatcaacctggttcctcatccaattgtcgcaagcatctgtaacaagaaatgaatcacgcattgccatggccgccgacgcatgcgccaacttgatcttctcaatcaaggcgcgcaattcatccttggtgagcttgtgcaccaatgcacgcttagcggccgaggtgacacccccaccgccttctcccccaccggagttgatgcccttggagtagaacggctgcgctgcgagcgccgcggcctgcttcttgagggggcacttgccgacgtgcgcctccaggttctcctcgagcacggtgctgcccaagacaaggcggcattagcggatagggacgctggtgatggagatcacttggcggtggtataggattttggggggtcttactgcgaggggtcgacggggcaggggacaaggcggcggaagggcgcaccggcatcggaggcggaatccgggaggtggttcccacagtacctgaggaggagggggaggaggcggcgatgggggttagggttagggttagggttcaggggttaagcaggaaggtaactcggagagctgcttactgagaggttgggagcggagtgttggcgcagtggcggcgcttgttagggagccagaagtggcaacggcccggaggcggaggaggcggcggcgacgagggcttccgtttcgccggagcacggcccatctctgacagcggcggcggcgagcgggagacgccggaggcggagagggagcagaagtgcagacccccggtgtgaacacaaccgaaggggaaatgcgtgacgtcattgctaaatttgcatcttatgaatttgtttttttttaaaaaaataaatttcgagtgaattcgaacatgtgaaggtgtcctccacgtttgacacaaaatcagattatcgtaccgctacatatcccttataaatttgacgttaaaaaaatattactagattactccctccattctcatttatttaacaccgcgcactaataaactaaccaacgtcaaatgaaaaaaatagatacttcctccattctcatttatttgacaccggttaactaatccacgttaaaaataaaaagagatagagggagtagattgaaaaacacaatagccatttttcattcgcagagcgatactagaactaaccgagaagagacataaacacaaattatgtcagacaaatttacaaattcaaaactcaaaaattgttacatgaaaacatgctccactgagtccaaaaggttgcatcatgatgagatgcaatggcaaccaacatataatattacaaacgaacaaacacaattttacaaaccacatgctatgacaccacgtcaccattgatcgcctaataagaaaaagggatcatctttccagtcaaaacgcggtaaaatttatcgtaaagatatgtttttcttttaaattaaattaatggcgtcggtccgtgtcacaggccgacggactggagcacggcgtagttgacggcggtggtggcgccgtcgacgacgaggttgtggccgctgacgaaggcggcctggtcggaggcgaggaagagcatggcctccgcgacgtccgccgccttgagcaccttcccgcggagcacgttgtggggctccgccgccgcctccatctcctcggggctcatccccgtcagcccgcagctcagcggcgtcgccacgccgccgggggacacgcagttcacgcgcacgccgtgccgcccgagctcgccggccgccgcgcgcaccagccccagcaccgcgtgcttcgacgccgtgtacgccgccggcccgaacccgccctggcacgacgccacgctcgccgtgcacacgatggcgccgcgggtgccgcgcgacaccatggcgcgcgccgcgtgcttcacgcacgccgccgcgccgcggaagttcaccgacatcacccggtccagagccgcgaggtccatgtccacgacgggccccgtcgggagcagcacgccggcgttgctcaccatcacgtcgagccgcccgtgctccgccaccgcggcggccaccgccgcctccacctgcgcctcgtccgtcacgtcgcaccgcacgtaccggcacccgccccccgccaccgacgccgccaccgcctcgcccagctcgtcctggacgtcggcgatgaccaccgtcgcgccgcacgacgcgaacagccgcgccgccgcctcgccgatgccgctcgcgccgccggtcacgatggccaccttgccgtccatcctgcacgcccccgctcaaatccatcaaacgaattcgacccaaaccaatccaacatcctcaaatctaaaaaaaaatcaaacgaaaaaaactactagtagctgcgagtgactcaccttgtcttcgacatgatgcaatgcaaaagctgtttcgtgtctgccttctgcatcgggatgtggttgtttatatagtgctcaattcgcttttaaaagtcgtcaactatgccaatattttactcaaaagcaaaattctttttaaaattcagaggaatgggcatatatatccgtacacgacgagtataaaatactccaaaacccaattctattattaatccaaatcaacagaatgccacatccttcaaaccttcaattcaatatttcatcaattaggtagcagcacaactaaaaaaaaaacgaaaaacgagtatccaagaacacggcgtttccaaatccagtgagatcatcagacagacaaatcccagagaaacaatagacatggaagcattgaaaaactcatcagagtttcagttttataatagatggatgaagcggagaagacgagctgagctggagaagacaaaagcggttgatccaagcacgctgtcatgtggggaacaccatgaaccctaatcatctcgcgttgcaaatccggtcccaatgctcatggcgctttgcttaccatcactgtcattagcggatgagaagatgagcttaacaagatcaattcaagaacagaaaggataagaggaggaaatctagagttggatttgggttgggtcgctgccttcatttctactgctaatgattactccacgacagggtcggctgcaatgcaatgctgcatcctgatcctgcaagaaactccatgcactgcatgttcactttcaggaaaagatgcagtcaatcgaacgcgaagcttgccgggatttctgttcttgcttgtaattgttgctgaagcattccactctcgtaagtttgcttatgactgataagcgtgaaaaaataaacaagcaaccaaaaataatttatatgcaaaacttttatatttacgaacttagcgatttaaaagctagtacttaaaaataaactacaatgaaaaaacctccaatcaactgtaaaattaagttttaaaattctgatttaggctgtgtataactatattgtcggtgcctgtcttactaactttactgttaccgttactgttagatgctgcctgttggtgactgattgcctgacagaagaaaagaaaagaaaagataatagatactacaggtattgttcagagaacgacaatagtgaattgtctgtaatgtggtatggtcaatggccgcaattattggatctcacgccagttttctcgcactggcatgtttaattgtttgcactgctgctaatgctatctcccaaagtcaattagcttcagattagttattggctctctgaccctgctgatatgacagctcccttggtttcatctgccagtaggatcatttgcagtagtcaaagcacaagacttttgcttcagaattgacttctatcgcactgaatgactgaatgaccatatcatttgaagtttgaactactagaagaatgcaatgttttcagaaggagcacagttccttttcctgtgcaaaagtttgattctcggattaaagaattacacagtagcagtgtgctttgtaagtagactttcaaagcagtatatagcacttgaactgagttgcatggatggaccatacatgtgacaggaccagcagacatctttcagaagaaaataggggaaaactaacacacttggaattgaatttttgcaaattgaagcaatagttcagatagatatatatggaccagcaaaggtgagctgttacctcaatgtctattggttattaccagccagagtttctttgcatttaatgacgaaatgctttgaaaagcactcagactatggaaggatttgaaacaaaagggacatggtagttatgcactaaaagaaattaagtaaaccaaaacaccaacactatttggttgttgtctactagtaccaactaccattttttccacattatacgtagacatagtaactatttacacagtgttgttgatattatcttcgatatgtccaaaaatcggttaagctaggaccatttagaaaaatcattgaggctaactaccttgacacgtcttgatcaaatagctgtgggatttattatcctatgaacacaggttctttgccttgccacttatgtcagcagcgacaacgtatatacattgtattgtactatgtagccttattgtactgttcaatgttcatgcattcatgtaagtagctgttagtttgccactgtcggtctaaacgaatcaacgtgttggaattgatggatgcgactctgctcactggactcaatgatcaggtttatcctacacaattcatctgtctaaatgattagtaaattatactccctatttttttaactaaccaacgtcaattagaaaaaaaacaacagaggtagtataatattactccatccgtctcattttaagtgcagccatggtttttcgcgcctaactttaacagtccgtcttaattgaaattgttttaaaaaaaatttaaaacataagtcacgagtaaagtactattcatgttttatcatctcataacaacaaaagtactaattataaaaaattttcaaataagatggacgatcaaagttgagcgtggaaacttatggttgcatttaaaatgagacggaggaagtatgatgcatttgacttatagtaatgtatagtagggcatacatattgcaacgggtatagataactgtagaattcacatcttccttggtgttagtgtatagataactgtaaaattcagatcaatctaacattgtcatgacaagtgacgactataagaagcaaactttagtttttgctatgaaaactttttacactgcttcctagtgagaataggagaggatgcaatttagtgttggtaagaaaaaccatggtagtcataaaagatataatataatgtcataaacaagacaggtgtgggctggccgctataggctggccttctagttctagggctaatgggctattgcgtcaataactaatcaactatgttgtcagcccttaggtaaccacattgccttttcttaataaaaccgttcaatattttacttggaagtaaagatgatactacaaacacgactttgtttgagctttgtattccttttacccatacatcttttccttctcttttaagcatttatatttgtattcagaaatattttctggactagatagagtaccaaagatgttgttatacctaaaggctttctatggaacatgtgatttgaaaaaatgcaaaagaaaatgaaaaaaaaaatagaggattggagtgtcatatatggacaaatcctacataaatttgaaacatagtaacatactatgtttggatggttcatgggactatgaatttgatataatcataaaatgggtatgccaactcacaagttttttcctcatccatcccaaccacatttttctacctagacctatccttgggtatccctatattcatattcatattagactgagtttatttcaccattttcacaacttctattttctcgttttcatgcacatgattttcaagctgctaattttcaagctgctaaatgcagttattttttttgcaaaaaaagagagaaaagttggcttaagacatcgggcctgttcactttgatgccaaaaaaaaccttaccaaattttggcattaccattttggcaacttgccaaaattttagtaggatttcttatatagttactaaaatttggcagcaaactaaatgtagccactttttttaagtgaacaggcccatcatgccaatccattttaagttttttaagctaacaatacaccgttttgttttgcgtgctgtgggggagaggttcctaaccccattgtgcaacacaaccttatttggataggggatagataaaaaaaatatatccatttaaattttggatatagtgagggtattactcattttgtccattttatatgaacccatttgctatgtgtaaaatttagacctaaaatttttaaactaatgttcatattaaaaaaaactgattaaaattcgggagatgatttattatatagaggagcaactttgtataaattttgaaccatttctacatggtcaattattttattttattttttattctattttttaaaaattatatttctacttggactttatttttatatttaaaatttgtattgtctcttcacttacccattgatgagtaatactcaattatgggatggataaaattgagtatgaataagtgttaccctttatgcttccctggtggcagatcaataattatgcattttatcaaaaggaaaaaaataaattaacatatagcaaaagagaaaaaaaataatactattaatcaataacaaaaacttacttcctctgtcctattttaagtgcaaccatgaatttccgtgtccaactttgattgtctgttttattttattttttttgtgattagtatttttgtttttatgagatgataaaacatgaatagtactctttcatttccaaattgatcatcatataatggaattcaaaatttctcaaattgattatcatataaccgtatggatacagattttatcaaaatacaattaatgcaacatgggagaatatgtacatgctaaggtgtaattggtatagtgtttaatcgatgcatgtattataggagaatgtgtgcatggtgtcttgattgatgtgatttaaattatcattggtcttggtgtataaagatatatgatgatcattttaggaaggaggagtactttactcatgacttatagttttcatttttttaatttttttaaatacgatatatgattaaagttagatgtactccctccgtcaaaaaaaaagacaaaccctgggtttccgtgtccaacgtttgaccgtccgttacgcataaagtattaatcatgttttatcatctaacaacaataaaaatactaattataaaaaaattcatataaaacagacagttaaacgttggacacggaaaatcaaagtttatctttttttttattttacggagagagtagaaaactatggcgacacttaaaatgctgacggagggagtaagacagataccaaaataccaatatctcatattctcgggcatccttgcgtaattgtgcccaagaaaaaaagagcaaatcgtggcgtcgtgcagtgcggtgcgtcgaggatattttccccgcagaaatcctaaattcccccgtcccctctcggcgtcgactcctcgtgagtgacttcgcccgccgccgcctgcgccaccgccgatccccatccgtcccgccaccgcgagcgggcgagcagcggcgccgtcgtccgtccgccctgctgcttccgccgcatcgcatcccggtgagcatcccgtcctcttcctcattcatctctctctctctacccacccactttttttttcttctcgaatttgtattaaccctagcttctgttctagaaatttgcgttagactcagtactaataacagtttctttgctcccaaaatttttcgtgggttcgactgaacccccatgtggccatgtccgttgttagatccgccactgcgttatatcctcgtgtttttgattgggtggcttatcaaataataggtttctgaatgtattatacaaatatcttgtgcaacctacccttttatggttgttattgcctttatttaggtctttgctttgatactcttttagtagaaaaggcttgcgctaacctcgaatcagtattctgttactaatgcttttaggtctttgctttggtactcttttagtagaaaagggcttgcactaacctcgaatgaaaattcggttactaatgagtcggggcatcgcgacaaaacactaaacactgaaatgtaaaattagctctgtcctattctggtgtaaattagttaatcaaaatacacttctgttgtcatcctaaaccaactattcttaattctcagccatgacttcaatttcatgtttctcttgtgattggttggggctaaaatttgttcaatacagtttgttgctcaagggatgaatgccaacaatttactgtcactcattgatgtaggttccgttaacacacttttactatgtctaatggatgagactgcattaagtaatcgatataccctctaaatatgctatcctttcaatgtaattcgcacccgactacattaacctgctgacagtcacatgcaattgtctcttgctgagtgcatgtactgcatttgagtcccagtgactatttatgtgcttagagattaataaacttcttattatatggagcactaaagcatggcacatattttctagtaggtttattttatatccatccttatggcatgtctttttgtacccataggtactgttttaccaaggaaatatggacagatttgtataacattgcctaagctttgaatctactttgaaaccatggcccgaaaaggaagtcaaagtaaaagtgttctgaatcatgcttcacctaaccgacaaaatgcagctaattgtgaggtactaaatacaccagaaagtgatgtgatggatggtgaaaatcgaagttcacatgttcaaggtggttcaaatgtttctggagtaaactatggccagaaaacaaaaggtatcaagaagaataacagaagcaatggcatttcatcctctggcaaatcagatgacagagcctcaaaaaagcagtcagtggacaccaattatgatataggtaattcaggagaaaatgacaatgagttatcatccagcacttccaaagcaagaagagatagcaagagatcatcacggcgtggatgtggtaaaaactcatcgatagaacaaaccccaatgccagtttttgcagaaaaagttttggagaagaccaggtgcatagcttgcatggctgcatccatttttagggcttccgtgatgtatataatagaagaaagcaaattgctacttgagagaaataggccagcaatcacaactttcatggctattgtgcacaaggggcatgactatgtccgcagcaaaattaagtatacttatcctatttgtcgggcatggatgtttagtgctggaaagttgatattgctcttgttggcagtttggttcaactgcaacataaggggcttcgattctttgctacgcctagggacaaactcactccttacagtactttggtgcagtacactatcagtttttgcaatgattggactaaagaaaatgctaatattaatggtatgattcagctatccttttgccttttgagttgcctctgctgtgaatgtttactaggctatgttgcatgatgcaaccaagagatattattgttgtacagttcttgcctacagttcggtttttctccacaaaacaacataactatgatgaaataatgcaatgagtatagattaatgggcattaatagtgaaagtttgaattatgaaatggaaatagatgctcctgacatattttcgaaaacattcatcaattctattctctctgtgacccaggtaattgctgctgctgtagttgcctttgttggtcttggttttgctgttctggttatcgcagtggctgcagtggtgattttgtggctgtatggaagcttttggacaacaagcggcatcataattctcggaggtaatattctacagtttgtttactattagtcaagtatatccagcacttgagaatgtctaagaatgctgtaatatttcttgaatcacaggtgcttcctttttcctgaagcatgaacgttttgcattgcttgtcacctgcctatattcaatgtattgtgcaaaaaactatgttggatggcttgggttacttttgagcctgaacttatctttcatttcaagtgatgttcttgtgcaactcctaaagaacaatgtagacaataacaaatctgctggctcttcaaggaactctgagcaaaattcaggcaaatcaggcttctttggagaatttcgacaatcatcagcagataatacctcacagtccgagtatgctcaaccatcagatcggggccctggcgatccttcaactagtggagctgagaaagagttgacctctgaagatgaagtgtctcgtttactgaactgcactgatcactattcagcattaggcttccatcgttatgaaaatatagatgtatcattactcaagagagaatacaagaaaaaggtgatactataaacattaaccatcattgtgcaccagactgttcatgttctgcaaagttgtagtatgtaaagttatttgttaattaaatttaataatttcgcaggctatgttagtccaccctgataagaacatgggcaatgataaagctgctgatgcatttaaaaaacttcaaaatgcatacgaggtttgcatgtatttcttgttgagttaaccgcatatctgataaatatcctatatattaatgaggccccaattcaaaatacacaggttcttcttgattctttgaaacggaagacatatgatgatgagctaaggagggaggagcttttgaactacttcagacggtttcagagtgcttctcaaaaggtcttattagatattcctttttctgagtgttcatttgtgctttgctatattttttttcctaaatcttctttctttaaagtagttccaagcagcatgctgagaactatttgcaactgctgatagcccatgaactttggttggctcttatcggatgaaaactgtctagtttagctggactgaatcctcaatttttgttgtccaaatgattttgaagcgcatgtggaatagcttgcattgcataactaaagtaattatatatatatacatatctttaagtatcaaacaagaggatgagcctgcctgaggtcctgggtgaaactgaattggtctttgtctgattcatgttatagattaacagtttgtgttactggagcaggattcttgttatagctcaatggtagattcatatgcggcatttggcaattgtagttttggcagttgaaatggtgttatacttgcaatcttgtcaagcactgcatctgccaaaagcaaaattttggcttaccaccatcaaatgttttttttgttctgtagtcaattcactaaagatggtctgaaggaagtgtcagtatgcacacatggttttacttgtaccaatagtattttagtagtatgtgctgcaaagaaactgctcttttggattgggcatattcttcctggtttcctatcagttgctttaatctgtcctcttccttgtaactggttattcttctggttggcttgatattcttttcttatttgttttctctctaattgctagaaaggaggaagtggtatttttcgacaagggtttagcccttctgaaggtgttgatgaaggaccttatggtttatcaagaagaatagcctgcaagaaatgtggtgacttccacctgtggatttatacaggaagagctaaatcgcaagctagatggtgtcaggtattttcttttggcatgtggttgtttttacttttgataccatgcttcaaatctgttatgaaacttctgtgttttctgcaccataggactgcaatgattttcaccaagctaaagatggggatggatgggttgagcagtcttttcaaccagttctatttgggttgctgcacaaggtaatgtcaggttattcgagcccttgcccaatactgaaaattcagcttctttttgaactaagaagaattatttgtgtggtaactagcgatcaaaaatgtgctatgactgtcatgtaatgttgtttattgttatgcagcctgaattgcctcatgcatatgtttgtgctgaaagcatcattttcgatgtcaccgagtggttcacctgtcaggtaattcagatattcttcaatgaaatttctgattcgttcagttgcttgtttaatattgctccaacatggtggcttgttttgtacataagggccttatctattttattcttctaacaatgttcatgcaagacaatatacagcaagggttgcatgttgaatgctcatagctatgatctctggtctgtacggtatacaatacactatcatgtagttctgcgctttaaaacgtatacagatgctatgcaacatgagtactatatgcagtattgccgaaatgctaaattatttcatccactgaaagctttgttttaggtcattaaaactgtgagcagggacattaaggagaacaattattattgttttttaagactaacgattactaatatcaacttgaagatctggcaaaaagtagtactgggggggggggatttctctactctccatgtaaggcctttgtgttatggataggaaaacattacactattcacagtaacacacaaacacatagactggttgaggtgcccaatggagttatccaacaatgtgatgcaccgacaaattgtctctgcctattgagcagagagaaaatagagatttatgaattgatatgcaactgttctgttcttcagggaatgagatgccccgcgaacactcacaagccgagcttccatgtcaatgccagcttgttaaagcagaatagtggcaaggggagcacctcggcgcagaggggtggagggatccctaatggtgtaaacatggatggcggaatcgatgaagaggagttcttcgagtggttgcagaatgcactgcagtctggcatgtttgaatcgtttggcgcgcaaaacgagcccccttcccctggaagtggaagcaatgccaagggtagtaatagcagtagtaagaaaaagaagaagggcaagaagcaatggtaactgaagaaggtccgataatggcgattcttctttgtgagcagaaagaagtaaaacatatggtgtttgttcggtatagttatgcaggaaaacaccccaataataggggtcctagatgctcaaccatcctgactcgctttaaggcgatgccattcaaaatcatgattcatcttgctgtgatttttcatatggagaattagaaatcagaagagaagaaagggccatgtatgtggcaaagattgttggaatgtaaagcgcaaaatatgttgagcctacatgattgaattgtttggacaggtagcgcaagctacaatttccatacacttgtcatcagatatattacattgttgctgatgtctcgttgatacatagaaatctttctgcccttgctttacgattcaattgtgattttacccctactttttagggtttgtgatttgcccttgtttttctgaaataaagcagccgtctagccttggttttgatagaagtttggtgggtccggaatttcagatttaaacgaagatagaaaatgttattatcatttttgaatgaccattctacccttacccttggttcaatgaaagaaccaaatccccaatccctatcccgatttccactccaaaacccggcggtggcggcggctacgcgcggcagggaggagcggcggcggggccagctgccacggaatagcgcgcggcggagtcgggcgcgggcagggaggcgctgcggcggcagcgtcgcgcgtgcatggaggcgcggcgcggcggccggtggccccgcggtcagcgcgcggcggagaggagcggcggctccgtcagccagccagcgagcgagcagcgagcaggtagcttggcggcgggatggcgctgttaaaggatgtaggcaggcgcggcggcgacctcgggctggagcgcaggctagggacgcagggaggcacgacttgctgccggcgggctggcgctcctaacctcttgccggcgcagggacggaggcctagcgctattgaaaatacaggattaagagacataatggagtaaatcttgtgcatggtggaaatctgctgcaaatcccctgttttctttcccattttcctgtcttgtatctgcgagagatttgtttggtgaatggtgatttcttcctgtgatgaatcttgttggtgaatttttgcacccgatgcaagttctttgaaaatgctgcagaaatgatgttaaattcttccaaaatttgtcaaagtttggtcaaattcgaaatatatacgcattatatcaagaaaggagaggcaaatgtgtaagggtatacaagtccttctactgctaagttgacgctgttaagtgatgctaacagaataggggcaaaacagagcttcgtttgaaaaaagtgagggcaaaatcacaaaccctaaaaagttagggtaaaatcacaattgcaactcaaagtgaggataagaacacaattgcccctagaagaaatatgttactacctgcctaaagaactgagaatataaggtgaagcagcaatcgaatttcgcagttcattataacttgatatgagcatttggatgagtacaaccagtgtgtcttacacttccccttaattaactgcgggattaaggatgctaattacaagccacgtagtggagtacacaacagtagtagacagtagagtagttgattagtaaattaattgctcttgttgttgttggcgacgacgccatcgttgccggcgagcacgaggtacttgtccctccgcgtgagcgccgtgcaggtgtaccccagcgtctccgcgatccggcgctgcacctcgttggccacctccgggccgccgccgccgccggcgacggggtcgaggaagtgcacgacgtaggccggcgaggggttcatgaggaggaagaaggggtcgagcatcttccaccccccggccgtggtgccatggaacatggccacctccgagtgcagcgccacgggctgcacgtcggcgccgagctccgtgaagagcgggctgaagcgcagcaggaacggctcgcggcaggtggtcccctccgggcacaccaccaggccgccgccgccgccgccgcgccgggagcgggagaggtgggcctgcatggcggcgcggtcggcggcgcggtcgcgggtgaggcggaaggtgcggatcggggcgaggatctcggagaggcggctgatgctgtaggtggcggcggcgaggtcggcgcggccggcgacggcggagacatagagcgggtcgaggagggagcggtggttgcagacgaagaggtccaagaccgcggcggcccgcagcgtggaggcggcgatgcagcggcagtggatgccgagggcggcggcgatcggggcggcgagggagaaggggaggacgacgacgatgagggcgacgcggaggagggcgaggggcacggccagcggcagccacacgaacatggccagcgtcgccgacgtcgtcggccggaacgcgacgcggccgtcgtggaagatgaggggcttcgcgtatcgccggggatggaggggacgccatcgccgccgcgcccactccgacgccacgtacacctcctgcattcattaatgtttgccattctcacttgattaatctatcttgcatcttcctttctactctctccctaaaaaaaaaaaatcaacttctagagcttaaattttatcaaaaaaaacttgtacaatcttatctattctcagcatgtaaaatgaaaagttttattccttcgatactctttacctatctatcaccattactattttttcaataataaaaagtattttgttcatttttactctgcactaactttatatagggatgcgagggtttgattttatatgggatggagggagtacacaatgtgttcagtaccatcgcacaacacctcaacaccatgaatgcgtccgttttaacccacagtaaaagtatcgggatcaatagtaaatctttagcccgattaaaaaaaatgtaatctttatattaattatttgagcgtgtaaatatttttctaaaacacggaacaaactcagacgtacacaaaaacgcgcacactctatccctgtgagcatttttaaaaagactgagcgacattcttaagattgataaagtcatcgcgagcgtctctctatccctataatgaaaagaatattaattataaatgcgagcacgtgagctaagtctaggaattgaacccgaaagacagtttccaccacaaggaacccacgcagttacaaaattactaattagcgatcgactgcgtgtctggtcagtttccgatcatgccttttttttctatttttatacatacacgcataatttgtacatagaagtataaagtttatatgcgtatgtgtattttttatacatctaaaaagtatacacacaatttttctaaatatagaaaatttgtagatgtatatgtgaagtttatactttgtatacatacatataaatttagtatatatacatgtataaacttggtatatatacatgtacacagtttatacgtgtgtatacaaaagtacagtggtggagcaaagatgccatgaagcccagacaagtattagcgtttttcagtaatcaactaattttttgggacatcaaatgctatctacagccgagacgccagcgacagagcctaagcgaccgcccgacctgcccttgagttagctctaccactgcaaaagtatgtacaaacgtacaggggatgtaaggaggtgaggtgaccgtgctaggcgcgtggcaagccatccatcagcagcccctaactagttgagctacgctcatttcgtaagatgtaaatatacatgtacatgtatttattaatcacgtagtagtatatactattgtagataataaattttattctgtttgtgcacaagcatgggcgtgaatgagaaatccttacgaatttatggttgagaaagatgtgtagtaaagagtgatcgacaactggtagttaatcggtagattaattgaccgatgtcttaatcggttatgcagatttatttgatcggtacgaatattaatttgaccggtgtcttaatcggtcggtagattaattgaccagtgtcttattgttggtaaaactaattttatcaacactgcagctgatcatgcatactacctccctaaataaatttattttttatcaatctcacacgtatcaataggacaaaaaaaactaaaatagttctattttattaaatcacaatataattgtttcttattttatctagtttcaatgtatttactattcacttttacaaactctaatacaatgattgctaaaagtaaatttaatttggaataaactggaggagggtaaacacgatgttattttaggacagcggaagtaaatatgtaggatgcatgtcgggtgaataatacgatttgattcacctgaataaaacagtgctcttaattatatctgataagagtagtaatataaacgtgcaacgtacgtcgattcataacgaagtgatgcggagctactgtatgcacgggtcttttcttaatgatgatgttgatgtgaacagagacttataattaattgatgaaaaaaaaatcgatcagtgccatatatacgaaaatacggttcatatgaaaagaatggcaggggcattttagtctatatgaaaaatacttgaacaaagacatcctagatgtactgcgtactacataatgatatggtttaaactttgcaaaataatcattatatcacccaatttcatcctttgtaatgataaattttaatagggtattttttataatgacataaatccaattaaccttcttaaatatgcatggttatttacatactaccagtatgaacagttgaaaaccatttgaagatagccttaaaagaagcatttaattttaaagtggcatatatataggtactacaagacaagaggtgaataaactgtagctctgctgacaaaaattcagtaacatgccaattaccgttctgggccgtgtgtacgtaaactgagatttcaatgaaaaccggcattcataccttacccataactcgctatatacagtccggc

SEQ ID NO: 41681 - DNA, 25678 bp, Oryza sativa
  unsure (1)..(25678): unsure at all n locations
ataggcatgcaaatcaaattaaactctgtatcatatcactaactactactcccccgttttatattataagtcgtttatttttttcatagtcaaagttactaaatttatagaaaaaatataataatattttaaatataaaataaatatcaaaatatattcaatgttaaattatatgaaaataatttagtgttgtaaattgctaatttttttttctataaatttaattaaatcaaaagaatttttttaaaaaaaaatcaaaagacttgtaatgtgaagtcagggagttctggctttgatcatcaacactagatacggagtagtagctacgaagagatatgcatgcataacgctgacgtggagtaaagtagtttgcatgtgacgacacatgcatgcatgtagagtgaattaggaagtagatttttttccctcgagggacatcactcgttttgcgtacctatagttttaaaaaatacttttaagatagatcactatataatatatcttttcgtaaacatattagttaaaattcaacttatataatataaaacaaaaataacaaatttgactatgaattacgtgttcacttcgtagttaaatttattatttttgtttttatctatataagttgaatttgaattgaagtggcaaatcatatactgacctatcttactaaatttttttaaaaattttgatgactttttaagtgatatcccctttaaggattatttgagttttccgagtgaattactccactcctaccttgcaatagttttggaagagctgatggaacgagttcccgagtccggcgatgccgacgacggtgacctgtccatcaccgtcaccgtcgccggcgccgccgcgctccttcatcccgatcacctcctccatgtccagcctctgcatgacctcgccgtcggactccgcgaggccaaggtaataccccctgaacgccctcagctccggcgccacgacggcgtcgacggcgaggtactccttcaagaacggctccaccatctccctcggcatggagctcacgcacaccagccgccgccgccgcgccgccgcatcgaacacctcggcgctgacgtcctccaggaacagcttgggcatcaccgccctgcccacccggaaggacggcgacccgtccttctccttcctgactccggcgaagctgaccatgaccatgagcttggtggcccggtcatggccgagcaggagcagcacggggtagagcagcagcaggaggaggccgcggaagagccccccggcctccagcgcgacgagcatgaagtacgggaaggtcgacggcgacatcagcaggccgccctccaccttgcacaccgtcacgtccgccgccgccggcagctcgtccgacgacggcggccgcctgacgacgtgcggcggcggcggaggaggatgcgcatggaggacgaaggatttgagccgcctgacgatcttgttggagtggaagaggagggacttggtgaaggccttccacgacatggctgctacaactcgttcgatcgagcgcgaatattaaagcagcatgggcaaactctaattaacaactaattaagttagctagttgtattgggagctagtgttgcacctgtactaacattatatatagacggccgggcaggggcaccgcaggggagagggagaccagtgagagtaactatctctgcaattggcatgcttttggtcattgtgtttttatcaaatcaatcatatatttatgaaaagaataaaatgtatattactatatgaatctatttcatatagagattggtttcttctgtacggggaggattaaattttggatactcgtggcacgcttttcaaactgttaaatggtgcattttgtgcgaaaactttatatacgaaagttgctctaaaatatcatattaatctatttttcaaatttataataattaaaactcaattaattatatattattaccatatcgttttgcatgaaacacttaatttttatcttcatcttcatcctcagtagattcaaacaccaccgtactaccacgtatagaatcacactacaagctaccatgggtgggacccacgtgaataaaaaagggaaatagagattgatcactttctttgtgagcgcaatgatatctgacatgtgggttcagtatacttttccttaactgaaaccggatgctaccactagtgcctgtcactacgcttaattcaataaggagaattttgcaatgtatacagtcggctctatcaccttctttctcctatggaaccctttctaaatccaacaatgcacgtgctatataacatactcacatcctttgctccaaacaacatatagagtaaaaattcctaaggtttagaatactttaaattccttcgatcaggtcaacgaggagccctaaaatacattaatgtcaaggtaaaaaggtagagaagttaatagtgccaggtgtctgcaaatcatccaactaacaatatttaggttgcgttcgagagatgacgtacacataaagctagaaagtccctagcctttccacgcnnccaccacttttcttaaactattaaacgatatgtttttggtaaaaaaaatctatacaaagttgctttagaaagttcacattatctatttttaagtttaaaataattaatacttaattagtcatgtgttaatggcttactcgtttacgtttattttcattttatcattctgttttctctcaaacatagccttagacgccaaaattctttatcgggtaagttttcatctacatggaaggcaagtttacacctacatgaaaggcgtaatgatgtatgagagaaagagactcgattagtataggatatattgtaaagatgaaaactacctatatctagacgaatagctttgttgttcctttcctagctatatgcagcttaggtggaagttaggcacaattaagtcatcaataagatattatatattttagaggatcctgatctaacgcaacactgtatatttccaatatttttgagatatttttaatagacctgtttatgagtagctaggttagtacatcgacatttcactatatatgtcaaagtctgaaatgacatattggtttattagctgatgtctcacattttgttggaaagccccttccctgcacacagttagttgagccttagctacatggatcgatttccagctttaaagtgattaatacagtggtaaccatcaacacggaaggatggttaattaattggagcatacatgattaaattgccaagctggtggcaggcgtctatctatctagtacggagtactacgtgtccacttgtacagggctgtaattaattatatcagcgcttaatttcactctgttaattttccttgaaaaagtaaggttcactgttgcaataattactactcctaattagctgttcctacaacgacatgactttcgctaatttacatttggagtatatatactttggcgacacaaaacctcatgaggtttctggtagagtgatatgatatctcattggtggggtattgtatattaattattatcagcacgtctttgtatatagtcagcatcatgttggcgatgtacgtagctgattaacgatgaagatgcacacagattactcccacccaccgccgcgtttctctcactttaattaattgtagtatttgcaaaataaaaaagaagtgcaaaagagttgcattgctagctgtactattgataactacatgtacatttggctaggtaggatttatgtttgccatttacactgttataatattatcaatgctagctaatcatatgcatggaggcctgcagttgctccaaatttccattattcacaatatgcatgctatctagccatacaaaattcaacaagtccgaatgcatgcttgtcgttcccgccataaatattttatgcttaagataaaattgggtaaacttttaaaaattccgataatcaattttatatttaaataaatttgtaaaatctaataagtttataatattatgatagtacttttgaggcaaatacacatataccttttttaagctaagcatttgaaaatttactgatggtcaaaatttaaaaattttgatcgaatcttattctgagggttaattttttttgtatgtcctgccgtttcccccaaaacagagggcagcctgcgcactgttatatatatcaaatgctgaacatgcttgcaggctacagttcctccaaatttccattcacaaaaacagtctgcatgcatgcatgttgttctaggcgccatacaaaatgtcatcaacaggcttaatcaaaattcaaaagttatctccggtcattgacgcccaggataagatttgatcgcactttaaaatcccagtaatcaatttcatattagaaatgtttgaaaagtctaataggataatagtatttttcgagacagatacagcataccattttttaaattatgtatatgagagattttgttatttcaaaagtttgacaaaagagagtatggatgtgcttacatctaggggcgtaaagttttagcgtgtcacatcggatatactatacgggcatacatttaaagtattaaacgtagtctaataacaaaaaaaattacataatccacctataaaccgtgaaacggatttattaagcctaagtaattcgtcattagcaaatgtttactgtagcaccacattgtcaaaatcatggcgcaattaggcttgaaagattcgtctcgcaatttacacgcaatctgtgtaattagttattttttgtctatattttaatacgtcatgcatatatccaaacattcgatgtgacatagtgtaaatttttgtgaggggatctacacaaggcctatatacgcactggtgctaatttttcaggtatatagataaaattagagatggcggcttatgatatgatagatgaatgtgatttgcctcgatctgcatgggatgggcacaagggactgggtgttccaaccgatctgattggcacttgcagtattaattccatcgaccgaactaacactaggtttaagtagctacagagaaataatttaggtgaattaaatatattgttctggtctccagtagcaggtcaggccaccttttcgtcgagtgaaagtcacaggcttttagctgataataaattgggccacctttgataaccatccgaaaaactagtgttttaaaaaaaaaacccatcgcatgtgccaacatatggattatggcctatacatgttattttcatatttgatgatattttgcaactcacttgtctctaacatggcattttccatttttttctcaaataaatttcaatcatttttcgtcaagctttagtcgcgagaactgaaaaataaattcatcgatgtccaggtaatgctgcatatgcaccaatgtaaggatttcttttcccccaatgaatgtcaaattaattgaatgtactccctccgttttgaaacggaggaagtacattttaatttgcacacgtacttacacaagagtctctgaaaaaaacgtgatattaatttcaaataaatttatactattgtctagggcagaaactgaaaagagaggacaacaggaaggccacacatacttttcttgttacaggacacattgaagttgtattacaccggagcagcagaattgagacctaactacacgtggattttaaacatgacaaagtcagtcagaaaaataatcaataaaactcaccccttcccttaaaagaaaaagtcagtcaaggcaagcatcacccacgaaagagaaaaaactcaatccaatatttcccttcgccacaattttcttcttttttttttggcattgatatcgattaggctcatagtactgtaacttaagcaggcagtgcatgtcattggatgcaaatcagatggtacagattgcatgctgtactgtgcatagtactgtagcaaaatactgtagtgtgaagcactgtagctattactactgtagcgctcgctctgagccgttgatcgtaaaaatggatggccaaaattgtgtgcagttttatcttataattacaagtgtaactgagtgtaactgcacccgatctcaattctctaaggagtaacatgatatctttagggagaaattatatcctcacacggtgaacatgtcgatcatgtctgcacgtggataagcacgtaaccttaatcatgcaggcgtaaatgcaaattaggaacgcattaagagaaatgtttttgtattgtgtatgtattatctcgactcgatccatttctcaagttgtgataaaaattttccgatgcattcattgcaagcagcaaaaccacaatgacgaccaaaaaaaaaagatctgactggcgaacgaatttgcgatcatatgggaaatcaatgtcaaactacagttagttagtttcctttcatttatgcaaattaaacaggagagttagtttgcttatggtgaacagtgcctgtactaacaaacacgctgcaatggcataactgatgttagttaaaacataaccatagccttatggtgcacgagacgcctggaagaacatgacggtctctaggcacagcaaaatcaacagtacacacgaagatgacacctgaataacttgaccaaagtccaaaggtccactgcaagtactagaagtatcatcgtatcactgtataagaaaaaaaaaaaaaagcaacctccatcgacaccctactaaccactgatgcatcattgttttgaagtctctattggttgtgtcccggcatagtaatagattaatagacatgatttattgtttctaataagtacttgtataaagatacattgacgtgtgggtggacttaggtcatgtaggaacctgcgtgcttgcgtcgtggcgcttctggtctgaatcgatttacaggtggcgaaagaatggtggattggtggcctacagcttgaatatggctgctccactcgacggcttggacgcgaacacgtacaacccaagatccttctggttgatcactccccggtcgatccttgatttatagtacgtttcctgcaataaaatgtatatcttgtcagtgaggatcacctccaataaacagagttgggtgctgctgtttcacttgaaatatgtagactatagttgtctgcgtggattatgtatgtattatcatgcatatatgttgcttattggataaagacaagagcttacagatttaatttacctttaaattgagaataaactgcgggacaatgccttccttaaccaaagcgactgcacagccaccccaccctgctccagtaagacgtgctccgagtgctccgttgtctctacatacttttacaagctcttccaactcgggacagctgggcaatggaatatgtcagtatgctataactttttttctgaaagagaggactgttttcatgacatccgaagtgtcaatacgagttttaagtatcaatgtgtctgctcaggaacgatacccatcgtagttaaagtacactactaaaaatggtacctgcattcatataacacactgcagctatagtgactttcattcataagatcgcccagtttttgaagcatatcttccgcactgcagaaaaaagatagcaacagttagatctctcaatttagaaataaatgttcgtatacgggctgctaatcgtccatgacagctgtgaggataaatgtagtaagagaatagttgggaagaaacaaacaagaaaataaccagaatatgcatggtgactgcaattaatgaacgtacctgagttttgacaatacagtatctctgaaggcataaacccgccttgcttccgagtacacatgaaaggcacgctgaaagtaaacacacattagaaacttataaccaattggcatatcatcaaagggcacagtcaaacatattcctgagttacacaaaactaaagcgaacttcagcaaaaaataatgcaaaaaaaaaagtaccacgcaaaaacaaagagacatgtataatagaatgacaaaatatctttaaaaaacagattttccacagaagagttgttctactgagtaggactgcatcaaagggaaatcacctgaaataacttgaaatgctttgctgctcttagaacatccaaggaagtttgagagctctggaagatagatgtcaggctttgacctgtaattttctctatttcttctgttgtatatgattcttcatgtaatagtttctgcaaaattacacaataacacaatcagatgagtacatgataagacagaacaaaaagaactttccagcattacttttataaaaaaaattatatacacccaaacgctaattacaacatattgtaaccaagtgtcccatatgagtacaaaataatgaaacataacttgcctaacttgtaccgatcatctcttttctcgaataaatagatggaacgtacgtatatccttcatgagaggataatctaagttcctgataaaattttgtaccttcacggcaactccaggatcagaagaaccctcttttccagcaaaagagacacataacccctcaacatcagagagggtggtaacagaggagacagccttttttgtttccatccctagtttgatggcaagaacaatctgcaaaaatgcaaaacagcaatattaaatgaacaaatgaaaaagaaatatcattactttgttggtgatatagcagccagctcaaatccagttccaaagtaaaattttaaaattgccctagaagctgaataaacatgttaaggtcacttgcattgtgcagcagcacaacagaaaggaatctgggaacctttgaatattcttaaaatttcaattcaaaattaaagtcaatttacagctgccaagtcacacatgtgcaaaataaagatgtctgaaactagtgtttaaacatgttcagtccgaaataaatcacttactgcagccaggcgacattcaacaacacggttgttatagtttgttgcagctgtctctgctttcttggactctgccaggcaatgggcaatcacaaatgtaccgcctggaggtagttgcacatcagtggcatggattggattgaaatctatcaactcagcaaatccaggtttggccatgatagatatagcctgggaaaatataatgaaatgttaacagacaacagggtagttcaaaataaaaaggccaactaaaatatgttattcattatataaatagcattgcttgtacacacagtaataatatataaaaagttctgcaaaatttattgatggtcatcctgtcatgagttgattttgtaatcaatacttggaaccacgatggttttttgcacgtaagcatgattatattaacaaaaagtttcagaagaacacaaatagtcaaaggattatatgaacaataagcgatacaatttacgaagtagtatatttggatgtccatattacaaacatagtaatatctcgtccataagctaaccccaacaaatgacattttcctttagacagatgtactttgatttacatgacaggtggcataataataagttaaagtacaaaaagaactgagtattaccataatcagttagaaaactatgaactatttacctgatccatgcccccagattgtgttccaatgtggcgctcagattgacaggtgaattgtgcaacttctttctgcatgatttgaatggaaaaattagaaaaaaaaatctcttgaacttttctgaataatgaatgcaaaaaggaaactgaaattacagaagtttgaacttagactatgaggtgaacatgtcaggctccagtttaaacttagagccaccaggatcaattttatctctcaagtttgcactgttcaagttcttggtgtaccattttctataacaaatacatacccattatgtacaaaagagcagttcttttttccccaaattttatggtataaaatcacttcagcaaaactcaagattcatcattctatccatccatctcacccttatacagtgtttcagttgtttgcaatccttttcagaggagtttggtaggcttcatgcctcccatacgaattaaaaaattacttcactatcagtttaggcaattaatattattttgttttgtggacagtactggcaataagggagctatgtgaagataatggcaagggagttgttcgattcgtagcaagggatacctttgggaaatttttctcaagaactcccatgatagcaattgttgctgaacagacaaatgctgctgagcttgaaagtccagatcctacataagagtaacaacacgcaatcatgtcaaacttaacatgcttattatttggaagtgaaagaatcccaaaacaaaatatcaaaaatatacctgtaggaactgtgccatcaacaactacatcaaggccaacaggtccacccatatctatcccttttgacctacaatactcataaactcccttgtatctgcagatagagaattgaacagacaggatatgttcgttttctttttcttgtggccaatgaagtgtatgaaaaagtgaacaaatttcgctatttatgcaacattatacaatattataagaattaacttacccacacatgaaatagtggccccatttgtggttttttatgtcaatttcctgcatgaaaaatatttatcaacaaccaaatcaatatatcaaagaaataatcaaataactgaagctaagaaaaaacagcaacttcagacggatcatggcacaattccgaagccagagatagcattttccatttcatattattccaagtcaaatagaattaagaatgaagcaatagtactagtatatgaaaatccatttgcaactgcaacatgatggcccccatcgtttggcttattcggcatatttgaaaacgaaaaataatttataaataaaacttttatattagtgttcttagcgatttaaaagctaaggctgaaaaataaacttcaatgaaaaaacctcaaaatcaactccaaatttaagattaaaaattcaaattttggctgataaggctggatgaggctggatgcaatgcagtattaagcccccatcgaagggctgaatgggagtccacaaggaatgtttgcaatccatttgaaggccaccagcctaaaacaaaacaaaggggaagcatggacttccacaccattatctctgtgggccacaagcccgcggggacaacaaattaagctcacgggcagggcaacgaaactgtatcacgggcttcttgttatgataataaattaattaatggggtaataacgcaaccacccacccatcctaaaatagtaaggagattgtctctacctccaccgaaaaaaaatggaatccgatgcgctacagaaaactctctccctttttctctttagaatctcaactaaaaacattccccgcgataactgataaggacctacgttcttcaatcaatctcaaccaacgaacgaaaaagcaaaaaattaacaaaatccactcaaactgagcaggattaatctaggaacaggggcaaagcagagtagaatgctggcaaaattaaccttgtcggggtcggccgggtagacacagatggggtacttgtcgtcgacattggcgacgcgcacctccttcccctctgccctcctgatggcgacgatcatgtcctgccggatggccatgggcaacaccgagtacccctcgtagtcgatgtgctcccctatcagattcacccgccctgcacacacacacgcacacgcaatccatccttgtcagatcaaatcaaacgcatccaccgaaacctagagtggtacccatccatctatcaacctacccggagagcgggcgaagagcgcggggcgcgcggcgtagacggcgtggaacttgtcggcgaggcgggccaagcggaggcgcgcctcgtcgagcggagagccgtcgccgtagatcggctccagggaggagaacgtcgggacaacctccgcctccgccgccgcggcggcgcctcctcctccgggcacccgagccgccatcgctggtgctctctcgcctcctcctcttccgcttctcgcgctgtctagcgaatcagtcgtcgtcttcttcctcacgcctcgtctctatccgttacaagtcgtatcacactctatgtgattgcggggtggcaacttcgattgactactactaaccttaaccttaaccttaacctccctgggttatatagacgggggacgtgatgactcaccgtcgcagacaggtggtcccggacttatggctggcccacacgtcggtgaacgtgtagtttcggactcggaatggatagatgggaagtgggacccacttggcagtgagagagtgcagcgggcggttttgtggggcccaccggtcagtggcactggatgggcggtggggtggacacatggcgagggcgtgggccaactgccgattagttccactaactaattaattattatccgattatgggtgattggattttgcttatcggcgtcatcggtttatatcctatcggtatcaaaacgatttgccacagaacacgtaatacgattcggcgtccagataactttatttatcatcatcaaaagatcgtttagaattcgagtaagatttatcacgtcgttagaaatgtgggtccatatttgtgttctactagtagctctttagcttctcaattattctctctatttcacactataagtcgattgatttttttaaaattaaacttgcaatttgcagtaaaatataataatgtttttaataaaaataaatattacattaaaatatatttaaaattggatttaatataactaatttagtaccttagataatgttattttttataaatttagttaaacttaatactttaaaaaaaaacagacgggagtactaggagacacgtggactcggtagcaacccaacatggtgcgcatcgcgtcacggctgcgcgcatataggcacagtccactctccagtctccatagagggaggcaaattactacattatggtgtttagttatttaggtgtaaaattattaactatacagatacatatttatacatatttaaagtattaaacgtaaactaataacaaaacaaattacagatttcacctgtaaactgtgaaatgaatttattaagcctaattaatccgtcattagtaaatgtttactgtaacatcacattgtcaaattatggcataattaggcttaaaagattcgtctcacaatttacatgcaaactgtgcaattggttttttatatttaatgtctcgtgcatatgtataaacatttgatgtgatatttttgaccaaaaattttttatctaaacaaggccttagtcaaatcatattggtgcattatttaaaagtataaccagcgttcagtaactagtacggcatgtgtatcatcaagtcacaggcacctagcatgacttgtttttgttaatcccaccttccgtcagcttcaagcttaagcagctaagctgcactttccgtcgagatacggacctaagttttgttatcatactagtattatacaatcgctatttttaaatagatatattttaaaataacatttaaccattcatactattttaaataaaaatatgtaattatagtaaggtataaatcatatttaaagtttctttaatgataatacatgttataaaaaataaatattatttatataattttttaaatagaataaatagtcgaacataacatcaaaagttaatagcattatctatttacatctagctaagcaagttgcaatgtgtactatacagtcatcatgcgtacccctcagaatctttttgggacgaagagagtatatccgatcatctgctttcccgcgtcactaagtttctctagcttcaagtagagtgaatctagcagctgaaactataccaaacatgtcctaacactggatgggtcaaacatagaatatcaaacatagaatatagtacataattgaaaaagtttgaacttcctattcaaacgcatggaagaagtttgaggctttgagccgcatgtgtacaagctcattcgtgaacacaaaataaacgcatacgagacaatgttcacaaaaaccgctataacttacattgtttttttcttttcacttttcttttgttaccagatagctaattctgctggcaaattgtttttacttcctcacaattgacaaccgcgaaccacattacaggacagagatgcaggcgtgcatcatatgaacagaaaacacatcagcgagaaacactacaagatcatcgagtcagatacaaagatgctccattccattgctaatcctgaatagttttacgattgatataccataaacttattaatattgccgcctttcttcttctgcaatagctaccaaatccagctcaaggatctcactcgcatttttgggctcttgtgatctcccatactggaagaaatttctcgccttcaatatacgcttcaatccgctggctggtatttgcaatagcgaccgtaaaattctcattctgaagagtatagagatacattgctcgttcatcctggtaattcatcaccgggaatttttaataagaataggaacagaaacttagcaggcatagacaagtctagtaaagaaaaaaagaggctgatgctacatgatgcacaaaattacaggattagctataccgttttcgtgtgccgaaacatgtaagtatcaggacttgctacctatgagttcgcaggaatgagaccaatagtgactaagctgagactttggcagtgaaccaggtaagtttatatgcaaaaactatcaccacagaattgttccgtaaaatatcccaggcagtggcaagtgatgcgtattgaaaaggtgttctcgattattaggtacatgtgtaagaattttgttggttaatacctcagggagttccatatattcatcaggagatatttgaaggaactctacggctgtttgcccaatgcaccaggcaaaaaccttttcactgtcatctgcaatggtcaagtgaagctgaaagccatgtgtacatccactgatatggcatgcgcacttacagaaggaacactgaagtccgcctgattgatcactcacaacacacccacaaagattgtggaataataataccttcaaactgttgacatcgatgtggtcaagtcgaacatggcatatctgtttattaagatatcaaacacaatcaggatattaggaacgacaacacaaatgaagaatgcaaagttcttaaaacaaacaaaataggtaccagaaaatactttctaaaatgtcactgataactctgcgattccatctaaaagaactaaaatgtaaatgcttcagaagatgtcacaataataatgaagacttacatgtgttctattagttgaatggggaagatctgacaagagtgacaaattatgcaggcatgttgaattaagaagcgctggcagcaagcttatgttaacaaatagagaccctggttccttttcagtccacgcgacttcaagcctgtcacaccaaatagtccaccaaccagaatttttcaccatcaagcaattattgcgacatttaaattgtgagcatatgaaattaaaaggaatatagtgcttacttgtttgttgaactcaaggtacaagtcaaaccagacatgtacaccatatgaccaacacctaccctgcctagcgacctgcataaatatatctataaatggatcgaattgaagtatagtagaggcagatgagctggcataggaaatgacaattttgtaaaaaaaaaaaaggtaaccttatctgaagaacactaaacaaaaatgatcgaatttagaacactgaagagtcaatgccacacttttaaatggaccttaatctttaagaattcattacccacaggctgtcaggcagaacatggcatcaacataaaaaaaccagtgaacataacatcaaatctttgtataagaccatgcagacttgcatacagtgtacaatttaggtacctcatgaattttctaatcagaattcatcagttcatataacaacagctccaatcagaaaaaaaaaagatatggtatagacttcagaacatcgcgcgttcacaggaaatagataaagaggatgcacttggtttttcttatggcaggatgcaattgatttggtgcaatataaaatgaatatcaaaggctcagcattgatttgataacagaaacagaaaatgacaaaacaatcagttcttagatggaagaaacttgatgaattcctatttcaatgatatcctgctcagtgcaaaagcaaattggatatttatttgccaggctccaaactgtttgaaacttagtacgttgaccagctttctatatttaaacctagcacacattaactcatccaaactaccaaagcatatatgccaggatattgcaaatttgacactcaacactatgatcagtacaagaagaattttggtttgtatttcaagtcaaataatcccggtgatattttaagtcaaataagcaaatcattttcagacaaaatagggaatagacagtgggaaaactagatcattgcataagtacaaaaactgataccagagtccaatgaagttaagcttcatcaggacaactcctgttgcatcttctatctccaaataaaagtaagtgcctgatgtacttgctttgcaaacacttgttaccatgccaaacagactaactccaaccattttatcatgaagatcacttacgtatacctaaaaattagacatgttatagaagcacacagcaatgaatatatcacgggaactttactgcatgcatgataattgataaatacttttatatggtataaaagttgcattagactaaaaacaaacatgatccacagaccacggggcaagaaagacagcatgtgtgtgtgtgtgtgtatagctactatatggcaccttaaggtgctacctattaaacggcacctgacacagtgatttagacccaccaactgcgcacacccccaccccccatcctgaacccacctatgttgacgtaatagttaaattctgactaccatccacgtgtcttttttaccgtgtgtagtcttttctgcacctatgcttcattgtacactcatcagagtggagtaaaaaaattactactgacttttacctaaggaaatagattattctacgtgttggtgaatttttaccatccatacagggactaattgtactactgcactgcaaccttttgtttgtccctgaaaatgctaatagcaaaaacgaaaaatacaaaatactgcaacataaaatgaaaactgcagttaagtaaaaatataactaaaggatattggtacctaaaaatacaattaatagaaaaaaagaaaaatacaatactgcaacattcagttaagtaaaaatttaactatagaaaatacagttaacagaaagaaaatgaaaacacagttaagtaaaaatataactgaaggatgttggtgctagtttctgataactctagtacttgatagtaattttttcactaagttgatttgatggtgtgggacccatgggaaagtgacacatggtgagaggcagttatttttttactgtggttgagaaagagaacgggaaggtcgatcgggtggtgagaacggcaaaagaggaagcgaaggcgctgaactggaggcttgaggcccgagggcgctacctattcgatggcgcgctacgcactacgtagcatgaccgtgtatatatatatatatatatatatatatatatatatatatatatatatatatatatatatatatatatttcaatgatttccctttatttcaaggaatcaagaatttcaaatgctgctataatagtagatgatcatgaaaaagatgaaaacaacaaaatgatacgggaagcatgaaacatagatacttctgaaaacatatttctaccaagtaaaacagcagaccacacatatgtttatgttactagatatattacacctgcattactaagaagcccatggaatgagagcacaagatgcacttaaacaatattaccgcaaattatatactaataaattactacacatattagtcagtaataagggatcgagtgctagttttcagatgattcattcagcacgttaagataaacacaatagtattgctttgttgataatgaagatctgaacaatataactcgatgcagattaaaccatgaatagaatcagtcgttatatgctaaaccaataaaccttcagttcccaagcaagtaagcaacataataattggtacgtttatctgtaaaaataaactcagaaaaatgaagttcaggttacttactcgaaatggatatttgctgaaatcaactgaaccatgcaaatcacgtggtaatgttacttgtgaagccatatgatcacttggaacacatgacaatcgagacccttgactccttatttgagtaggtgtaagaagtacctagcacacaatcatttccatcttggtcaaaaggagtagtgcaaaaagatgtagcaccaagatattcataccaacctgttcctcctgctgagcaataggcaccaaataaacctgtgtagcactgccatattcaaggcaaagttcctgagactcctcatgattattgtgcacataatttgcaataaaaggtctgtgcagtgcaagcatgctccctacgctaaaatagaaagtttagtttacaataacttgaatgagacatttggtacttatattgagtggaataaacctgaaaagatttgcaagcaaaacctgctccccccataaaacaaattttatttttgcatcatcattgtcaacaagtacaatctgctttctttctgtagatccaaatggttctaaagactcgatcttttcgatcctacagggcaaagaaatagcagtgttacaaatcgttcaaggtcaagtgatttggttcattctattcaacttatattctcaactggatagataagctcttcttcttctttttaccagaaatcatagtgttggtaactgaatgtgttgtgctaatatagccacagcagtacacatagggtgtgttcagagggcatttttgcagcagcagctgcggcggcagaagttcaaaattgctgcggcttgaagagactatgtacagcagcagctgcagcagcgatagctgccgaacagggcgaatgtaaaaaatgtcaccattaaaaactaaaaagtacaatatatctaatatacctggcataaaacgaataggaaatattgtttctgttctcatctagcatcatagatgagaaagaatacatgcaaaactgtgcggcaagtaacatggcatcttcatcttcctcctgtataaattaaacatgagtcgaaactaaatagtgtgtgatatagtacgagaaaaaaaattgaaccagttgcatctagcactccacagcacaaatgcaaaattttaacttctactagcagcttaatactagtattgaatccttataagaagcaagaagttagcagctagtttactgagggctgagtaaagaacaatgaaattgtttagtgtttagaagatatttttgtaatctattatcactgtgaacgatgaagaaccatgagggatgaaagtgaattaaaagaaaaaagaaaattgacccaagaaatgacaagctgaaaacaaaaaacatgttgtgaactccacttccttataaacctaaatgtgtttcttaggtacctcatcaagtaacatcaccatatattctgttggcaaaatacgagcatggcctgatccctccatagctgtacgtaggcaacatcccgtgagcataacttctcgacccttcttcaagacatcatgctgtccaatgtagttgtagtacctaacatgaaaatttagagtcagtccagtaacaattttaccttcattcactgatggatttctaatgcattattaagtagcattatctaagcaataaatagtcatactcagatctaccttcggtgtagatatagatcgatagtcgatgtgctccacatgtctcccaaggtaagcatgtatatgtttgtacctacaagacagtttaggaggtaatcgaagaaaatgcaagttagcagccatatataaagtgcaagttcaagcgattaattttatcagtacatttattcaaggatcatgttggaaaaaatgataatccaatgatcaaggatattcataagatttaacttgtgcccttgttgaggaaaaatgacatagagaactaataggcattctgtttactactaaacatccctgcagaggacaaatattctgatacaatataaaaatagcttgtaacaccactcataatcttaatgaaatttggctggcccaggctaaaaaatataaaaatagctaacagatatagtttctttgtttgatagaagcaaagtataagcataccaggaatgacaaacacatcaatgacaacagcttcaaggacactcttaggagataggaagttcttctcatggatagaatcgattgtgatggtattaggaagccgccttcttctatttcttgtttttagaagattggtcaattcaactttcctctttgcggtcagagacttgctttgttctgtccaagactagcaaaagcagaaaatatttaaaggctaatccacatgtccaatgcgaaaagaaatggtgaaaaaaaatgcaatcatggatttgaaatgggtttgcatttgttagtctgtacacaagcaagaagcatggattgccaaattgtgttatccttggaaaaataatataagccacttgcttgagcggtgccagaatctatggggggtgattagtgaataattgcttatgtatgcccttttctgtttcgatatagagatcacattggttcgacattcttcgatatatccggaatcgcattcagaacaaatttgattctaacaacgagcacaaggcacaaatagaaactgtaacagcttggagaaagagttgcatcctcgagatgtagtttgaattcaagtaaaaatgtctaacctggaagaggtcggagagcaggatggcggcggtgacgccgctggaataagcgcagcacgacttgagcacttgcgccaccgcccacccccacggcggccgcgcaggcgctggcccggcgccgggggactcgtcgccgtttcccccggaggaggaggaggagagcatggagatggcgtagtcgacgaactcgaggaacgcgcccccatcggcggaggcggcggcagaatccatggaaccctagacaggaggaaggcgggggagacggcgaaggcgaaggagacgggcgcgaaaaagaaaaaaaaaaacgagatggagaggagagtgaaggaaggagcgcgggaaaagagagatcacggatacgcgcgcggaagatactgctgctattttacagcgagtttttgggtcttgcaacgttggacaccgaaatcaacgtcttaaaaacaaaaacaaaacaagaacagaaagtacgaaataattcggagcagtttcttataaccgtgtaatattcacaagcacaaaacttaattctctctctcagtattttttaagctaggttttcctacctacaaaaacccatggtccgtaattacaatcattttgtttttgtttgagataaatataaaattttaaaccatttcaattcaggtcctgtttggcacagttctagatctcaaatccgcagtaaatttgaagtttctatattgaattatagtggctcaaaactttaaatttcatacaaaatgagaataaaatgatttatcctaatgttatcaatgtaatctatggatttgtggagcaagaaaaaaatcttggatccagaactgtgtcaaaaaaggcctcaatttacggactccaaatccagtgtgaatctgctaaacagagccaacccatctatgcctcctcttgtttcaagttatccaagtctcaacttaaaaaattcaagccgaagaggactgaaactaaggcagtcacctatgcatatgattatgagtgaaatgcaccactaataccacaacctgtaaggtgggtgcaatttagtcatccatcttataaaatgctcaaacaagtcactcatcatgttttaggggtgcaaataatataaaacatgcgtcttgtgggttgttcgcaatgaaattatgtgctatgttaatttattttgtaaacatggtcacacgattcataaataagccaacatgcaatactaccaatagtaaaatccaattaaaaataaattttgttattgactgccaagcacaatatggtcgtgtatatacatgaaaaatatgagcgttaatttgtaattttaacgcttgccctgcccacatggctaaaaaatgcatgatgttaggacaatacgatctccaatttgaaaacaaataatccatgtgacaatgtatttggtaagatttacaccattgaaacaagatgagtgacttaattgagcaatttgctagatgagtgactaaactgcactcacctcgcaagttgtgataccaacggtatattttactctatgattattatcaagtagtacaaataatcactaaactaatgatcccagaaactgtccagtggataatcaagtagagatcagcagttttgtatgctgcagaatgtggtgtcgatatccgctcagaaaaaagaaaaagcaaatgtggtgtggatagacaaaccttttttcctcaatacaaaagaaactagcttatgtaaacgagaacaaatgaatcaattaaaaaatacatgataatccttaataaagctccctcaactctaggcaaagttccagcttcaggaatatgcacatttatccgattcgtttgaggggaaaactgacaatttagaaggtagtcagttttatgtgcaaaagccaaagggaaaaaagaaaaaaaaactgctgcaggaggttgtgggctgttcacaatggtatggttgatgaaaccatcagagtagcgattgttgcccacagaaactgatcattcatggtaggattagctcataatcaatgatctaaagcacatctgatggatagagattgcccttgtgaatgacctttagctaattggtcataatttatgaataagacgatgacagtgatatcgtcatggaaatgcctgcgaaccttcttgtcaatcttcataaggtctgaataacgcatctcacgtttccgtgctgcttcatggagagctgcctttatgagccttcttgcacttccctaaatttaaaaaagtgttaccatcaaatagaataaattattatcctattttaagtcgttaggcaacaaccatgaaaataattaccatgctagtaggttgaagcgcatactgaaccaaattttctacagttattactagtacaagaaaaccagtgtatcaaattgtcaacagcaccaattatcttaatactagctaggttagggcatagcaggaaatgcaagcatgtgaatcatcaggagcaaccatatagaaaacaaatatatagccaggaagacaagtaatagactgcagtcattacactgcagcaagtaatatgtccccagtacttatcagaaaactggagctccttacatataagcagtaacaattcattattggtatggacctacaataaccctgtccagtatacatcatcagacaatggttatcatgaccagactgttcctgccagcagcccagcactacaggagagcaatgatccattgagaatggtatttttggcccattgctgatacagtcacaagtcacgacacatgattaaataaatggaaaagatcacagtaataggatgatcctattcctaactgcaaagcattcaaggaaacagccggcgatgtcaatatttttttccagcttgcaggttgtaacccagtggataactgtggacactggacatggattgcatgatagtaaatacttgcatccaaagccgcacccatcaccaaacaaaataactgaaaatttcacggcgcatggcaactagattttatgcagactatgctcatttagttaatcaccaatcaagtatatcagcttaatactttctgaatttgttgttttagaggatacacatagcacccaataagtgtctagtctaaatattgcaatgcttggacaatgctacccaaaatactaatgtctagatgcaaaacagaacttgaattatactgtcaccctgtggaacaaaactagcaatacagaggttcaagatctgaaactttaatgcatacatttgattgtaaatattatagcaaaatacatcaaggcattatttccaggtgaaataaggttccaaggttcaccgttcatgtcctgaagccttaacaaaaaattcagtgggaaaaactccggtcataaaatattgcaaattgtttaagatcacttgggccttgctcgtttaatcctcaagaggagggaattggagagtattgaggggcaataattccacaccacaatatgtgtggaataaattccctccaaatccccctcaatccccttgtgagagggattaactgaacaagcccttaggcaacagcagagaccagaatgtgaagcagtagataaacaagttaaatgtgcagaatcttacagctcgttgatggttgtgcacaatctcaacagcctgctgattactcaggtgttcccacaaaccatcggaggcaaatatgatgaagcaatcacttggttgaaggcaacgtgcgatgatagatgggttggcactcaatataggcctgctgaatggttcagggagcctgaactttggtttgatctgttccgtgttatactgactatgctttagatatgcatcgcctaatgatctggacacctgcattgcccaatacatttactgagaagtgaaaaatatatatattacagatacaatatcctgtttcagcaacaggaaactgaacaatgcgataaaaaccaacctgtatgatgcccttgactctccaaaccccatgtttaagagcaacaatctgaggatcatctgggtgctgagccatgagctcctgcctgacatcctcttcattggcgttatgctcactggacagttgctcggcggtaatctgaccagcgcgaccaaccttcttcccaagaacggccctggaatccccgaggttggcgacgaagagcgtcctctggtgcacgactccgacgaggcagcacgtcccgacggtggccatgtccggctgcgcctcccacatccgcgagacgaccgcgaggaagccttcctccgtggccaggaacgcgtccctgatggcgtcggccgtgacgccctccggcccggacgcggcctctgcacggatcaaccctaagtcgcgcgtttccggcggggcggcggcgggtaggaagggcgagggggggcggtgctcacctcggaggttggggaggaggtggtcgcaggcgaagcgggcggcgtcggggccggcgtggccgtcgaagacgccgatgcaggtggcggcgaggggcggcgggcccgactcgacgcggcactggtcctcgagcacgtggttcccctgcacgacggcgacggacagctccccggcgtggcaccgcgcgaggtcccgccaccacagcaggccatccctgccctcagcagcggcctggtccgccgcggccgccgccgacgaagacgacgacgaccgcgcgggcggcgccggtgacgtgggccagaccccgccgcacgcggagagcatcctaaggagcgcg

SEQ ID NO: 41682 - DNA, 69964 bp, Oryza sativa
  unsure (1)..(69964): unsure at all n locations
gtgtgcgatgcgagtcgagtgcgacgcggaggtcgcaatcggtgtacgagaagggggaaaaaaatagaaaaaaaggaaaaggtgaggtctcgggtcgggttcggtgcgacgcggtgtttgtgcgcgcctgcctgctgctgactcctccgctccgctcttgagggaattggacggccgtcgtttttcttttttttttccttttttttttgtcgatgagtagtgtaaagtattgggagtggcctccacccgtatatgatacgatgatggcggggtcagcgtattgtacgtcgttgtacctatgcgctcacctgtctcttctgcagctcattaacaaattgtgatcttatttttattttagcattggcttctgtcgacatctggaatttattttagatattaggtccatcttttttctactcttgaataggatagtatgctgacagagttttagttcgtccccttctagatacaaaatcggaattcttatcattcaaagataagaaacagaaaaggtgatgcatatcgtttatctgatgaacttacgcacgttcctataaaaaaacaaattgtatgcataaaaatacaattagtattgcttgatatctttatttatttagtgagtgaattacactttaggcatgtcgaaattttactttagactacctttatatcatttttttctttttgtcagtttttagttgtttagccttcctcgcagcaaaaatatttgccttcgcatagatggagaagttcggcagtatgccgaagccaatatgcttacaatcattgatgtgcagtgaaaaaatgttcgcggtagcaataacaaaaatatctgatccaaagaaaaatattggtaaaatggtggtccaaaataaaatgttaccagcaaaagatgacctacattccaattcactcttacttatttaaacttttattatggattattgttgcatgcttacactagggtgaatttgagagaagaggaaaatagaaatttgagaagatatgcaagacgaaatagagtataaactattttaaacttaaaaaatggattaatatgattttttaagcaactttcgtatataaattttttttaaaaaatacacggtttagtagttcgagaagcgtgcgcgcagaaaataagacaaactttctcacaatctacttgggccgtacgctgctaagataatttgtgattgatgtcatagtagtagagaaaaccattaacatatgtcgcatgtgcactgaaattaatattaggtgcaagtaattccattctcgacatgaacaaactgtaatatataaagtgttatgttgatcgttgttgatgtttaaccatgctttgctatgacactaatcattttattccactaaaatttcatttcaattttcaaattattatatctaatcgacatgctatttagcctccttcaaaattcacagattacaaaatttgtattaagttcaattccatctgaaaatacaaagacccttcacgccctcgcacgaatctcaaagccgaagaagggtaacataccaacccacacactgccccgccgttcccagatcttctcctccgttggattgcgcacggcagaagggaatttctagggtttaggcagcgagcgtggtgggagcgatggctgcggcgggcgacgagtcggcggctgccgctgcggctgcggcggcggcggcgggcggtgccgccgcgggggaggcggcggttgactccaaggacctgcagcagcagagcaaggcgctggacaagctcaccgaccgcgtcgaggaccgccagctcgattcctcccgcgtccaatccgtacgtttggttcatctccaacctcaatcccttctagattactcatattagcggcctcatcagcgtggaacatgtatagattgattgtcaatccgttcagtggcaagcaacggagtgaagagcagagctggataatttagatgtttggtagactcatgatggttcactaatgtctattggtagactcacctcgtaatagccttgcctagaggaatttcgtgcattttattttttaggtccttgtatttcagttgtcacctaagtattgatccaataattacacatttcacgtgcatctttaacctgagtaagaacagtgtggcattttcagtacaaaagcctctaatcccgtgtcattgctattgtcttcatgcacctactacaagcactgccatcatcacaagacgccaaactgtagcctgtagagcgatgagcttaagacttcaaattctgtttgtgtagaaaagatcctgtaatttgtccatccctgttacagggtatgttctgcacataaaaatcaagacacacggcagatgatcttgaggccagaatgatgaaatcctttttgcacggtggtgtgtgtgagcctgatttttttttcaagttcttggtgggtgataatgttagatagattaatgggtattttgcaggacaaatcaggctgatttgtttttttcatggtttttagctataatttagtcatgcttggcttaaacatgagcttattttgaatctgactattttattggaatgccaataattttccagatataaaggtcctcataaatttctaattatggtatcagtaatccgtgtttagcccttgacacatgatctgcttacaaatatttaagggattatgttgacaccaacttgccaattaagaaaggtgtttgtgcttaatcgtctctttcttttgcaggctatggcagctcttgcttcttccaaagaagctgattggaatgccatgagattgaggtcagtgtacaaaacacccattatttctccattctgacgattaatacattccctaggaattacctattcctctaagcaggttttatggtgattgcagtttttttcctgagtagatgatgttaggttgccctttattatggtgaaaatatactattaagacttaatgtaagctaaacgactagaaactgtgtgtggaggaaagcaaacatgaagtttaatttgaacagtagctttgcttgccaaaaattttagcttcatctaaaagcgttatgataaagccctggggaaggaaaaccagacgacttgcaccagttgcagtcttgatacctcaatggggtagtcttttaacctgatgaaagaacaagcaaacgaaaaaaagaatcccaaacagtataagcgcaacaagaaggaacaactcatgcatgttctaagtggatatctcccttttatttcttgcaaatcttttgatttagcctgattctgcatgatagtatgatgctatttcttcaagttatataaaccctcttgtgaaatgaaggcgatgcccttgaataggtttgtgagctttctcatcattggataaatgggctgaccctggtttactgaaaacatagtttgcatgtcgtatacggtatattgttattagttacatgtgggaatgtctttgctcttcaccagggaaaaagaattagctgccatcaagatcaaccctgctgatgttgaaattatcgctaacgagcttgaggtgaccaccttaaatcctcatcagatgattgttttataatgttttcaaatcctgttctaatatatatttgaacacacagttggacaagaagattgcagagagaacactacgggagcacaaaggcgatgctgtagctgcagtccggttcttgcttcgctgattcttacacattttgcaagatctatacaccatatgaagcagctgtagtttgctattgcttgctgctgagaggaatttctgtatccacaatgaaacgatcatatttggcatctatgtagaactttttttccatgatgttgcaaactggtctctgttgtcttcttgtaaaacttggttcactcaggagtttattgccgtttatccaaggtctttctataccttctcaagatgttctgattttttttggatatcctaagctctggttctgaatgactggaatgaccatagagcaaaagaatagctgatagattatccaagatgaagagaagatgacatttaattgtttcgtacttgtatgcttttattacaacaaaggtgaagtgccttcaaaggtaagaaacattcatctgtaccacatgccaaattgtatccatttgattgccctgcatcattggcacctgcctgtttgctaccacattgttgtgtactgacagcttcttgagtttggggctgcaactttgcaattcaatttctggaagactgtctgaaacgaagcattgagatatccaattctctatactctttgtattgcctagttgtcttctgtggaaatttgtgagttaactcatactcccttcgtttcgaaatgtttgacgccgttgactttttaatacatgtttgaccattcgtcttattcaaaaaatttaagtaattattaattatttttctatcatttgattcattgttaaatatatttttatgtaggcatataattttacatatttcacaaaagtttttgaataaaacgaacggtcaaacatgtgctaaaaagtcaacggtgtcaaatatttcgaaatggagggagtatataagtttagagagctgtttacgctcatctcggagagatcacctgatcaacaaatacttacgttgctctgacagttcaattttatcaagatgaccttaactcgaatttctgattaagattctttcctgacatgcgggcccaactcatggaccccttggcccttgtgcagcgagaccttcaccggccgtacgtggagggggataactccacgggagcatccacgtggcacgaggcttctgcctcccctgaccaaaaacacgtcgctttatacacgcgtcgccctcctattggccacgctcccgtatcccagtgcactattggacagcggccgtgggccatgccatcccacgtgtacacgcgcggctcgtcactccccgtgggccaggtttgtcagtgaaacatcctcccgtgcgggtaaccacaccgctccgccctttattaagcgcggtgcatttcgcgctcgctacccatctcattttctcaggtggttttctggttcagtggagaaaaaaaaaggttagaattagacttctttggaaggttctagaggtttctagataccgccgtcccggggggtgatggcgatccccagaaggtcggcggccgccgtcgctgccgtggtggcgctcgcgtccgtggccgctgtcgccggcgaggtcttcttccaggagaagttcgacggtgagtcgccggatctaacaacctgtgtcgtcgtgtaatgtggatccagtagactggtaatgcgtttgaatttttttcgttggttcgttggatgatgacgttgatctggtcagtttcttagcctgttcatgatgcatgatcccgttgtttccgtggaattcatcagtggcatttgcgacgaagcgagtctgaggaattctggagttcatgtgccatctcgtaaccgttactgttttggcctcgcgatccacagctttaggatgttcccgtttgcggtttcaaaaaaaagatgttcccgtttgcgtggcgcaccgtttttgcttcgcatgaatggatccatttagttttttttttttaacggaaggatccatttagtttcagtagtctcagtagcgatcgcgtgctttctacgcgttcatttctcagatctccggagaattcgaagggaaaataggatttcctttcgtgaaaaattaaggccggggttcagggtttattacttgattttttgagagattatttttttcctcttttccctgatcctgttggtggatatgtagaatattaaaattggttggtttctgaattctgaattgtgtgtgaaaacagatggatgggaggatcggtgggtcaaatctgagtggaagaaggatgacaacagggccggcgaatggaaccacacctccggcaagtggtacggcgacgccgacgacaagggtgaggatcgatgcacacaccacgctgctgatttcgttttttcttctttttttttttctgttcaggcatgtgcgaagttactctgcttctctgtgcaggtatccagacgtcagaggactacagattctacgccatttcggccaagtaccctgagttcagcagcaaggacaagaccctcgtgctgcagttctcggtgaagcacgagcagaagctcgactgcggcggcggctacgtgaaattgctcggtggcgacgttgaccagaagaagtttggtggcgagacgccgtacaggtgatggtttaatttgatcacttcgcattcccctctgtgtgctcatttcagagcgcaacatctttgattgatcagtttcttttgaaattgcagcatcatgtttggaccagatatctgcgggtatgccaccaagaaggttcacgctatccttacaaagaacggcaagaaccatctaatcaagaaggacgtgccatgcaagaccgatcaactgacgcacgtctacaccttgatcatccgtcctgacgccaaatacagcattctgatcgataacactgagaagcaaactggaagcatctatgatgattggaacattattcctccaaagaataagagggatcctgaagccaagaaggtaacttagagataattcactggttgttctgacttctgaataggctgtctatgctcttctatttttacagaggtcataacttatatggtaatatgttactgtttgcagccagaagactgggacgacaatgaatacattcctgatcctgaggacaagaagcctgaggttgctttcctttgtttgtgcaactttagatgatatttctgtctgaagattaattgagtttttactaataccactctactgagattctgcatgaaaatgggtggcaatactgcactgtatgttgtgagcttgctgctactcagatagcagcagagtacattgcactacccattttattttgagtaaatctaaccacactaccacagcacagcattataaatttctaaactgaactatatatactgttattttcccttgatgcttctctctgatggtttcttttacttatgaataattgtcgtttgaagggctatgatgatatccctaaggaaattactgacccagaagcaactaaggtatgtgttgccatttttattttaaatggacattttccattcttctcatacaagttcgatgagatgcatcaaccagtatgcgatttcacatcattttgtccaacatgcaacttcacattatgcaatctgtacagcctgaggactgggatgatgaggaagatggagaatggacagctccaaccattccaaaccctgagtacaagggaccatggaaccaaaaggtatgagtgtgactgaatagttcatttactctagacaagctaggttcagcatcacgattactcactaattgcatgaaattttgtgtgtttagaaacttaagaaccctaattacaagggcaaatggaaggcaccattgatccccaacccaggtatacaccaaacatattttttctagaaagaaacaaggtaatccagcgatttgtatatgcttttatcgctcatgtgaattcctttcttgtttgtgcagattacaaggatgatccttacatctacgcttttgatagtttgaaccacattggcattgagctgtggcaggttagtgctgaattccatgaaactgaaattaatttctgtagttctgttgaaacattaataattcaatgtattggtaacaggttaagtcgggaactttgtttgacaacattcttatcactgatgaccctgagtatgccaagaaatttgcagaagaaacctgggccaagcataaagatgtgtgttgtcttatctttggtgcacattactgttttattttgtttcagtttctagttgtgaagaattaaatcgtgatttgtctgtgtaggctgagaaagccgcctttgatgaagctgagaagaagaggcttgaggaggtaggcaggaaattttctttttctgagccatatcttgctgttgcttcttgtttgaactatagatgcagaaaataacctgtaatacatgacagaactaacaaaagcatttttcagctctaacttttaattgttccttcttgctaggaatctgcaaactctaaaatcgacgacagcgacgacgacgctagtgtaagctccagaccgcgctagatacagtatacactaaccttgtgctaaacaccatgccataatttgtatgtcaggatgatgaggatgaggcggacgatgacaaggctgatgtcgttgctgagcagaccaaggacaagggtgatgagaaaccgcaggacatcaaggtctctgctgatgagaagccaaagagcagcaaggatgattcttccgctgcgaagaaggacgagctttagatattttattattattagatgataatatgtcatgacgaagaggcaactgaatcaggtgttggtgctaaatatttcctaagcaggggatcagagaagaggagcagagaagcttgtgctagttttaactggtttctttacttgcttgcttgagggctgaacagtacacttgcttgtacgttgggcagcacaccatcatcagtctatacacatgcactggctttctatttataggcttgataaaccgatatgtaagaagcttcaggacctagctagagacttgtagtactactacattgtcaaacttcactggtactagtactactgtaaaatcacatcatgcatgtctacacactacactgttctagaaaatttatagagcaaggacttcaaccttgactttagtttcacgagtagtagagagggttagagagtaggctggtatgttctagaaataaattaactccaacaaactcccccttaatttatttcttgcaaactccgatgagctctctgtcgcggacaaatttttctttggataaagccttggtaaatatatctgccaactgctcatcagttcggcaaaattccaatttaacttcctggcgatcaactgcttcccggatataatgatacttgatagcaatatgtttcgtcctgtcatgactgactggattttcgctgatcgcaattgcagacttactgtcgcaataaattgtagtaggctgatattgcttctcgcccagatcttccataattctcctcaaccaaacaacttgtgaaacagcttttgatgctgctacatattctgcttcggctgaagataaagcgacaatattttgtttttttgtagaccaggagcacatacctgaaccaagtgagaaagcgtagcctgatgtgctcttcatatcgtcaagacatccagcccagtcactgtccgtgtagccaattaattttgattctttaactggcttataccatataccataatctgcggtccctttgatataccgcaaaactctctttgcagcggtaaaatttaattgacttgggctagacatatatcttgataataaacttgccgcaaacataatatccggtcgtgttgcggtcaaatataataaacttccaactaagcttctgtaaattgttggatctgccttatcagctccatctctagccttttgcttttcatttggcaacaagggggttgtaactgacttgcagttatccatcttaaatttcttcagaatattttcagcatatttcctttgtgatataaatattccttcatcactttgatgcacttccataccgagaaaatagtggagcaagcccagatcactcatttcatatgtatgcatcatatcttttttaaagtcttgcatcatcttctcactattgccagtatatatcaaatcgtcaacatagagtgagacgattaggatatccgtacctgttttgttgacatatagagtaggctcacttatgctcttggcaaatcctttctgaataaagtacttgtcaatttgactataccacgctctaggcgcttgctttaatccatataaagccttcttgagtctgaataccttattttctcccccttggactgaaaacccttcaggttgttcaacatagatttcttcatcaagataaccatttaagaaagccgatttaacatcaagttgatatatcttccacctcttttgagctgctagagcaattatggtacgaattgtctctagcctggcaacaggagcatatgtctcataataatcaatcccaggcttttgcttaaagccttttgccacaagtcttgccttgtatttctgaactgagccatctggatttaattttgtcttataaacccacttaactccaataacttctctgtccctaggacgatcaaccaactcccatgtattatttttctcaatcatatgaatctcatcttccatggcctttatccaattatcatgtttttctgcttcttggaaactttgtggctcaacaactgaataattgcaaaattcatgttgttctgaccctctttgttgagaagtagattctaataattcaaccatacttcttacccgtcttggagctgattccggtgtagaaatttgctcttcactgctcgggcttgaatctgaactagcacttgagcttgacattggacttgatggctgtggacttggagtatgatcttccacttcatgagtgccatgcatatgtggttggcctagtgtgatggtagtggttggcaataatggagtactagaggcttctggagacttccagttccatgtagcactctcatcaaaaatcgcatctctgctaatgataattttctttttctccaaattataaagtctatagcctttgataccatcagcatagccaacaaatatgcaccgatcacttttattatcaaattttactctcttttgtgctggcacttgagcatagcaaatgcaaccaaatactctcatatgaccaatgacaggctttttaccataccaagcttcaaaaggtgtacggtttgttactgccttggtaggacttctatttaaaatataaactgcagtattaactgcttcagcccagaaagatttaggcatacctttgtcttggagcatagaattggccatatcattgatcgtccgatttttccgttctgcaactccattttgttgagcactatagcctgccgttagctgtcttcggatgccagcattttcacaatatttctcaaattcttttgagatatattctcttccttgatcgctgcgcaatactttaatttttcgattactctgattttccaccatggccttgaattttttgaatatctccaaggctgcagatttttcttttagaaaatatacccagatcattcttgtataatcatcgataaatgtgataaagtaccaatttcctccttctgaaattgttggcactttaccaactatatcagcgtgcactagttccaatggtgcacttgctctccaagctccactgtggggaaaagaagcccggatttgttttccaaatacacaaccttcacatgggtcagacttgagagtaataaatggaaggccttgaaccataccttttgtcctgagtagcttcaatgctctgtaattaagatgacccattcttttgtgccataaatcggaaatatcaacttcacttctgagagccatttgagttgtatgattcatccttaatagaaaatttctattcttctccatatttattttagcgaccagacgattatttttacggtccaatattttgcaagaaaaatcttcaaaataaaccgcgtacccgtgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttgcatgatacgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatattttgcaatatggccctttcttttgcacttgttgcaggtcattttcttccagcacatatctgtagtatgactagatttttggcaaatgtcacaccacaaatttgaactggacgtacctttttctcttctctcttgaccatcttccttctgcctggaaaagccatttttctgaaaataaccacggtctcgcattggaaatccatttttttgaaaatttccgcgaaaccttgagttttgaggcctgaagctcaactttgactgaaatgcattttcaatagagctcccttcgcgctgaagctttctttcttcatgagattccaacgagtctttcgacaagtctttcgactcctcagtagcagcaacaatgtactcgtatttttcaggcagactgattaaaattttctccacaaccttctggtcgtttatatcttcaccatagaggcgcatctgattaacgatctcaataactcttgagaaatagtcttttaccttctctgactccttcattagcaaattctgaaattgtcttctcaaggtttgaagcttcaccgcaagtaccttctgagatccttgaaactcctccttcaacttgtcccatgcttccttggatttcttggcgccaataatacgtggaaatagactttccgcaactccttgttggatcaagaacaaggccttggcgtccgacatccgatcctctgccaaagactttttctgttccgccgtaagagtttctccagcggaatactcttgatagccattctcaacaatatcccacaatccttgagatagcagcagcgtccgcatcttgatgctccatatatcataattttctcctgcaaatacaggaaccatagactgcgccattgtggcgcccgaacttgaagccatacttgtagcttcaattgacaataccgatacgccgtgctactctgtcacgccctactcgaacctgggcgctctgataccagttgttggtgctaaatatttcctaagcaggggatcagagaagaggagcagagaagcttgtgctagttttaactggtttctttacttgcttgcttgaggactgaacagtacacttgcttgtacgttgggcagcacaccatcatcagtctatacacatgcactggctttctatttataggcttgataaactgatatgtaggaagcttcaggacctagctagagacttgtagtactactacattgtcaaacttcactggtactagtactactgtaaaatcacatcatgcatgtctacacactacactgttctagaaaatttatagagcaaggacttcaaccttgactttagtttcacgagtagtagagagggttagagagtaggctggtatgttctagaaataaattaactccaacatcaggaagttgccatttcttcctttgtgtgtgtgtttggtcagagtgattagaggaaagtccatgaatttttagcactactagagacattgctgagaggaaaaggagtaacgcaatctcttttttatctgataaatggaatatccaaaagtcattgagcagctagcgagttcgtctcataactctgcatccgggcggcatacctgaatcttaatgggacttacaaaatttcctactactattgagcaatcctttttattctgatctagtgaattcaattagacgcacagaaataatcaatctgtctgactaaacaacacatcgaggattagtgacagtaattacgagagttctgtacttctgttcatcgcaatgggaatctttacatctcgaggaccaaagctaggtagctagctactccctccgtttcacaatgtaaaatgtgggaaatgctagaatgacttacattatgaaacggagtaagtacgaataaacatctaacaagtcccatgaagttagtgttggacagctcgtcggaggaattctcagaggctcatccagccacagcggcgccgccttgttggtcaccggagaagatgatgtcatagaactccttgtccgagaggttcaccagctcagccgtggcactgtcgtaagcatggctggacgcagcagtagtggcagtgtcatcgtgttcctcgtactccgggcaagggccaggctcaacggcggcgacggcgacggcggcggcgtcggtttctggcgccggcccgaactcctccaacgccgacaagaagaagttggtccagcattgcggatccgagcgctcgtcgaacccgaggctcttgcagaactcctcgtccccctcgtgttcttgcacgaacgcctcgtgttcttgcacgaacgccgcgacgctgtccagctggtcagtgctcaggtagccgccctgatccggctcggatgctgcagcggcgtcgacgtcgacgtgttgctccgacgccggcagagttcgccgcggcgcgctgctcgctggcgcctcggggtggtcggactcctcctctgccttgcgcttgcgccggacgtcgacgacacgggcggcggcgcggccctcgacggtgacgacgcggcggaggacggcggcgagggcgcgccgtagcgcgacgtgcggggcgagcggtagaccttgcagagcgcgaggtggtcggagccggggaacgagaactccaccatgagccacccgggcttgacgacggcgcccaacgccgtcttgatcttgtacgagaacttctgcagcttgccgccggcggcgctgcccttgacgtccttggggcctccctccgcgtgccagcactcgccgcagccgccgccgacggtgcgagccttcctcgcgccgcggctgccgagaacgcgcactggggtgaacacgtaccacacccggccatcgccgtcgccggtgccgggcgccggggcgaggccggcgacgagctgatcgggtggggcggagtacacgtcggcgacgtggaagtaggaggtggcggcggagggcaggtcgtcgaggctggtccggacaaggtagctccggaggtagccgtcggtgagctggtcgtcgctgggggagaacaccaagcccttgccgatctcagccatggcgcgcggcgagagttggcacggacgtgaggaagaagaggtgaaggtgaagaaccctagctagggtttgacttcaggtgaagcgggtgtgtggatggccttcatatttataaggcgttgattttggtttctccaaaaggtttggaactcggtgttacactcggagtcggactcggatttgtgaaaatatggcgggaaacaaagggtggacgtaacgtggggaataaggaacacacaagctgttaattaacaaggttaaggcaaaggctgggctaccctctctccaccccgtggcagctggttttagaactagtggccatcttccaggtcttgcttgcctaagcatcttcgcgttggtttcgactccctggtactcctggtctcttggcagctgtggaagtaacggaactttaaggtttttgactataagctctctttggtctcaatggtgctagagtccatccactcatagggtcatctatggtctttagttggcgttgccgcttttaggaacttgttgggagtgtaacgtggctcggccccttcccgctgcctacttgcttagagtctatgttttagccaccgtagtttttctaagcttcatcttttcattttgttttttctcccttcctctggcataagctggtctggctgattgcgttgtgtaactataactattttcttctaatatattgacgtgttgcgcattcgtgaaaaaggttaaggcaaagaggtctcttacatgatgtaattgtttaagacaaggttaaggcaattaatacggagtggatgaggaagaggatgtacgcgtacaccaaagagtaagtataagtagttaagagaaaaagggaaaaaaagttatttacatcaagagtcatattattgtaaatttttactattgtcgatttgtaaattaggcgggaagagctgctgatctgttttgatcaaattagcaagtttatgaacttgtgcagatggctttgttcgctttgcgagtgaagactgaaagagtatcagcttaccatcattgacagtcgcaactgagtttaactaaagagtattagtttattattatttcaataactgaagtaaatctattagtacacccgttcacttatgcttgtacattgcaatctgactaccacgaacgcaatggcatacacaatttggtgccagaaacctgagttaattcgaaagttcagagtaattttaacacttcagaaatcattcacataagcgagaatcgaattacagcaaggtcaccattcactcttggataccgaaatacacagattaaacttgtttcgacatctcatgcatccttacagataaaatactatctggtagcgattacaaaagttattttcaatcacttccacgcagctttggatcaagaggtgcacaaaactcttgtcctggttccttagaaacaaatatatattgtaatccaggtgcatatactcttcgacctgaaagaaaccacaggtcacaaaaaaaggccgccatggatcattcatttctttgaggaacggaagcctccgaaacccatcatggcagcaacatcagggtctatgtcctcctcaggttcattctgggcagccagctctttctgaaaccatttgacatccagtttattatgaattctactgattttcacagccaacagaactgtaaattaaggaaagcagaaaatatcatgaattctactgaatttcacagccaacagaactgtgaactaaggaaatgtcagccatctgcatgcatggttgcaattacctttttctctttcttcttttctttgcgttggcgcttcctctcctcatcctcttgctgctgtttcaatattctctcatccaaatctgaaggtgtagaacacaaaaggagaatgtttagataatacttcctcataaggctccctttgcagctattccacataacagtttccttctcaagggcaaagataggggaaaataaatcttaaggacaaagatagaacaaaataaatttgatatttatttttgttgctttttctcaccttgttcactaaagctacctgggtctttcctcttcttaagtgactcaaaccttttctgaacctgcagccagaaagttacttaaggaaaaaaaaaacaggagaaaaagagtactgactacatatttcaagttcccgataggaatatcgagaagctaaatatgcaaccattggctcacttgtctcacatgaacaaatccataatgtagtacacatatgagtgagcaagacttgtaaacaattggaacaggattgttaattttcaattgcagatctgacaaataggctcagatattatacctgttcaagtgatgctctctcaacacgcatagacatgcccaatgctctctgatctgtcaaacattcaaaccacgaaacattattattaaaaggtttgatataccaactcagcctaaaccagaggtctcagaaagtcagaatacttacgtttcttgccatttatatggtccaaatagttagctgaatctttaacgacacattcacaaactttacaatagtaaccagcctgtcaggaagtagagttaaaagcaaaattttaggtgataaatttaacatgaaaaacatttaggcaatttctagaatcattgaaattgaaactagaattgttaataatgcagctatcgagaacagacatcatggacagatgaatcacaggctgaattctaaattttttttttctgataaaaactctgtttcaaaagcaaaatgaatgacagtaagtgaattccagagggcatgtaaataaataattaaagctcaatgaaaatactataacatgtcctgtgggatttctggacgaacctgttgactcaaaggtgcaattggagttaccacctggagaaaaacaacaaacataatcggttatgagctcaatcagaagggcattcatatttgtaaaaacagcttgttgatcataaaagaaaataatggtaagactacaagaacaaaaaatcgggagacataatcatgcagcatgaggaagcatggaaaatctatgctaaagcaacagaagaagacttattagaaagcaaagatgatctagcaaacctgagtcttgccaagacgggactcaaggtcaacttcatagtccctatgcttcaaaggttgcctttgcacaggagggcccttttctgtcatgtatagttgaaattaatttagctttacaagaaataaaatgcatccatccaaatctaactgaattgaagtacatagcactacatacccttgcctttccgcgcttcttcctgcatcagcaagagaaaaagaaagaacaaagttaacaacaggttgggcgaaggaagtattaagtatatatttttttagcttcgaaaatgattgtggaatgtaaaatgaggaccttctcctcccgctccctctgccgagctcgttccaagtactcctccttgtcaaatttcctccggaaagtgttatcgacaccaaccggctatgcatcaaaacaagcaaaaggtcagctcaaatgcaccacactgccttattttatgagtctctttgaagcatatataagtaacttacattgctagacatgttgctctgcccactgccaagcagctgctacctaagaagcacaagcagaagcagcaatgagaaacaggtataataacagaaaaaaaatctctccccctaaataactaggcgaagcggacccagggaatcacgacgacgagtgtgcctaggttgtgaaatcaagctgatctgagcattcgaatcatagaaaacatgcactgcatctttgaattgtgaaatcaacttgatctaggcctacaaatcacaaaaacaagcctgatctctgaaccctcactgacttcgatttcaatctatccatcagggagaggattagaggtagttacccgagtaaaaatgtgataacaaaaaactaacctggttggattcttggagagacggagaggattagaggagagcccttcctccttgctggtcgtggtcgcggccgccgcccccgctgccgcctagcgccacagcccgcttgccgagtcgcctctgggtgtaggccgtcggcgttagggggcggggggctcaggcctcacggtggccggtgggtgcggagctgcgccttctcgccgccggtagcccggtcgccggaaccctactttttttttccctttccttttttcctttttttctgtttttcttttgcaaagcgttagagactaaactgggcatgagctttgggcctttatgggctgtgcaagtgttagtgggcttctcagacctttctcagagtagcatttaggcccaaaaataatcgggatcctatgtgctcatgtgaattccgttggatcagaatcggacgactgctgttgaggttggcgtttttttttttctgaagagacctcaaaatattagagaaatccttctcatatttcaagagtgaggcaccatgggataagaaattgctttattcaactatgtcaaagcgcaaggaagaaactagactataatcgtctcatagatgtctgatgtctcatttgacagtactaagaaaccaccattgcaccagtaaattacaggtctaaacagacacagcacaactctgttcaggtaagaacaacatccatccaaagatgatgatgataacaagtgagaatttgagtatctatcagtacactcgtggattccattgctactagaaacatgtatctgactgaatctgatatgagatgcaaactgcaggccacagccgaggcttcctatggctccaccttggtcaccttctcccactgaccatctgatgcctccttccacagtgtgatatcgccggagccggccgccacggacagtatgtttccggtcagtgaccaggacaccctccatgccggagcctcgaagtcatgcatcaccttcccttcccatttgtcgccctctttccccttggtccagatgacaaccttaccgtcttcagaggcactggcgattgtaaactttgcgaggcccaaaacaggtgcccaggatacatctctaacgcagtccgtgtgcatgtcggagggcagaacgctatccagcttccagctgccattgacaaaagcccacaccttgacaacacagtcgaagccaccagagacgagcttctggacaagttcccctgagccaacaatggaaccgagtgcggttgctggagcccatgagactgccatcaccccaacagggtgtgcttgctcaattgttgtggagtcccatcctccatccgggcgcatggtcatgacagagatgctcccgtcggaagagccacaggcaaggcaaaggccaagctcatacggagcccaagcaatggagttgagtgaagacttgtggttgtcgaatacgtgagcctgagaccattgcccagctgcaccctccttccaaactacgacacggccatcgtagccgcaggatgcaagaatcgaaccaaacttgggatgggcccatgcaacacgccacacaggtccatagtgtccgctgagggttgcaagcagctgggatggcgcggatgcacctccaatgctgctgatctgcacggtggagtctgaggaggctgtggcaaggctcttcccgtagtagtcgatggcagaatcatggaccatgtccttgtggtcaagctctatcttgtttgacgacatgctgccaacttaatccagactcaaacttgaatccctcctttgtagtcctgattgtgattaaaatgaagtgacaagtcaattcaccaacacagaccagatggaacaatttaattgcagagaaatgaagtgacaagtcaattcaccaatacagaccagatggaacaatttaattgcagagaaatgaagtgactaagtcaattcaccaacacagaccagatggaacaatttaattgcagagaaaagcatccatctaagaaggaccttgcacaacagcacggacaatagaacatagaggcatcaatgccatcgtattagttcaattcattacacattagcttcccaatgattgttttcagccaacacctactgcaatataatcaacagaaggaacaaaactggcataaaaacgtatcaggctcactacatatatggggtaagacggttttgatatgtccatggatcacaactggtaattgcacattgcagccttagcttgctgcctgcagcttgcaggatcacaagaagagagattcacaggggcggatccaacttgggacatgagggttcagccaaacttttgggtgaacaaacaaactgttactttgtattaaggttaataaggctctgaaattaagaagaagaagaagagcttcttccagatctagaagagaagctagggttaacgaacgcaagcagagagatgaatcagaaagaggatgcggggatgctcacctcaccaggatcccctcccctgctcttctcgccagatggagatcggcgccccctcccctgttcggccgcgagatggctcaaggagcggaggagacgacgagatgggtgattttcttctacgccaagggaagggaagggggagatagtatactcgaggttttcactttaaaaatctttatgatgactccaccttttatctcaaaattttcacttaaaaaatatttatgatgaccccaccttttatctcaattttttttcaccctaaaactagctatactaccttttttttttatggacgtaactacacagctagtggtagctggttccactccatctataagagacaccatttacctatacttcaaatacaattttctattaaactactcatctgatctacgatctaattacaccgttgtgttcgtaataattaaatctttacaacaagatctcacatgattatattttgatgaaaaatcacaaattacttttatgatatgtctaaattatttttagatttcactaagttacttcttaaatatataaaagtaaattcagtgaagcctaaaagtaatttacatatattatagaagtaacttagaacaaaaacaaaggtaactttggcatgtcatttgaagtaaatacgttatagagataaaaacatgactctatgtagaaattaaattaatcagtacaaattatgaaattaactaaaaataataataaaagtaatcacctcggagcattataaatgtataggaagtattttaatcaaatctaaaagtaacttatatatatgataatttgttcaataaaaaaggcattaattaaagttactttccttttgttataagttacttctataatatatctaaattacttttagactttactgaatttacttttatatgtctaagaagtaacttagtgaaatctaaaagtaatttatacatatcataaaagtaatttgtgatttttcatcaaaatataatcatgtgaaatcttgttgtaaagatttaattattacgaatacaacggtgtaatcggattgtaaatcggatgagtaatttaagagaaaattttatttgtagcttagacgataggaatatttcccctacttgcttaatggattagtactatagtaaagtaagattcttcaagttaatacacatctggatagagttcgcttgttatgactaaatcgagagtactctcgatttagattttgcgtttttttttgtgtgtgatgacatgtcaacggtactcatagaaaaaaaatcaacaaactcggaactactcagaccaccggcaaccactatagctgccgcttcatgcaccaccactctttctccatgagacatgttttttcttctccccatcgtcatgcacgctattatcatggtcgtcattgaggctggggtgtcgggcttgaagaggctcagggaggctaaccactatagttgccgcttcacgcaccaccactctttctccatgagacatgttttttcttctcccccgccgtcatgcacgctattatcatggtcatcattaaggctaggggtgtcgagcttgaagaggctcagggaggcaggaacttacccggcgaagagcgaagatgctagatccaggctcctccttggattccccaactatcaaagaaaaaaagaaaaaacgagagagaagtgtggagagtgattgcataatcactggacttgaaggtggagcgatggtagagtcactagacttaacgtcattcttgcggtcacggccgagcccgtgctgcccccgatgctaatgcatatgagatctacactctcatcatctgtactctcatcatctatgataccccaccagattatttattaaccctaaatagaagcaagaaactgaaaggagaagctaaagatgcagtggaagttacttcaattgaccatggggtgaatggagaatggggacaatgtttttgcaaggattaacatgttacaggagggacagcatcacacagcagatggtagtaattattttatccccacaggtgctccaatcaaatggcacatgaacagttcaagaatggttcatcatgacagacatcgacggtcaatcatcagataaacaatgggcaggttagtagcaacattatcaatctttcgtgacaaaacatgcacagttgcatgaccgaactactaccaatttacaatttgtgagaccaacatatggaacaaaaaccttgtttgtggctgtcaaactggtatcattagtgggaaaagaacacctgctacaaagaagtgtcagacactagaagtagatcagcaaccatttcatcgatcaaggaaccaagcaactctgttgtaatgtcaatgccagattcgtatgactccaacttgaaatctacccagctccccagaggactactcatttctttgtacacgagttcatccaccatccactcctcagcaaccttcagatcagtcatctccgcatagatttcttcagctgtgagcttcttcagaattgccatccccaagaaccatgagccgtagccggcattgaaatagtatgcacatctcacactcagtatctcgtttacacattcgaagagcagcctccgattcattcggagtgttttgccctctgctacacccaccgccagccgaatatcgccatttaagtcttccagtagttgtagatccaggatatctgagttaatgaatcgctccaagcccgagcaaatttgaccattaagaggactggtgtttaatatttctcttatgaaatcaatctcctgtctgcaatccattcggcttgaactgctgctatctgatggggggatatccgtcgtagtcacagtgattgatgaggctgtgtcagaatactccgagaaagcgtcagcttccaggaatttactgaagcatgcagaattagacgttgttgcaccttccgttgagctaaatactttggttcctataaagagggaaaatatataagattttgaggaagacatacagctaatgctccagcaacaaccaagcacctgtatatttaccatttgcgcttctccagctctctgttgagctaccggtttcagttgaaacagaagcatcccatgttgaaaggggactgaggtgaaggcgctctatctccatttgatccatggcatcattatcatacttcacagattgagatgactggtgaaagagagggaatgttagcacaatgaccaattctcaaccagtcattgataaatttactcttttatatatttagacgcagtaatcattgtttaggagttacaataagtgtcccacttcagtatagcagcgagaagcttcaggtgtttcccttgattcatccgtgcattccaagtatgccagtttccaaaaggtaaaaaggcatatggaacaaaataaactaggaactacccaattatgcatgtaagaataatcaaaggcacaaaatgttgggtatacagccagggatttcctaacagaacacaatattataacctttaagaacaacatagaatccctaaactaattgttaataaaaatctagattattaacatcccaaaatatcaacaatatacacttttacaccaaaggtcatgcaggaaaagcatatggggtaaagacgtacagttggagctgatgtaatttacaaacattagcatggtggtcaaaatcattaatatgccaaatatgatagggttatgatatcaatctattgctcttatttctgaattctgatggacaacatattctttggacaaactttttgatgttatcaactgagaatcaaagtattctctgacttgaaaataaaagataaattaaccatatcagtttctgcatttatcgcagctacatgaagaaaagataatatgcctaattaactactccctccgttccaaaataagttcatttttcacctatcccacatataccaatacaacatcgaaaagactagaatagccctactttatcaaatcccaatacaattattccccactttatctactcccaatacatttatcccctactttcacaaactccgatgcaatgattattcaaaaataaacttattttgggacaaatgggggaggccaaaaatgaacttattatgggacggagggagtggttaatattttttccatgctcccaacaggtgaaacacagaatctgaataaccttttcaggtatttatcatatgctcacagcaatggaaatgacatgcataggagaaaaaggtgggcatgatagcaacagaattgcctgtgattccatacctgaccactctttgatgcaagatctgtctgggtgaaactgccttttccatccttataggattggacggactccctatcataatcagtagatgcaatgctcgatgtttcacatgctgattgtgaatcttccagaactgatgatggggcatatatccgaacatctttggctggcttacagtagggtgacctaaccccagaagtaagttctctcaacttctgctctaaaaggagacccaaataatcaccatcaattgaatcaaatttagcactcgatgtctcgcttgaatttggtactgagctcgcgtttttcataaactgtttttccactaaatgattgggtaggcgataaccagataatggtttatcaactggtgcggtgaatgtgaatgaaacaatatcagtgctaattttcttcttgttcatggaaaaaggtgattgctcatctattacaatattgtgccgaacacgcctttggcttctgtcagcaatatctttatcacttggacgggttttcactgaatgtatcctcccatctggtaatcttcctggcttggggattgatttggctgtagaattttgccttctatttgcatggccagttgaccgcaattccacgtttctgttaccttgagtattgttttcagacggtgtgccggcagtcccaacctttctcatagtgccatttattgaatgtgtgttgcttctttgccggttgggtgttggtggcttggaattcaccttgtgcttaaccatagcattttgctttctgttattttgcacaagcacattggacgaacttgccatgcccacttgattgttattcttcccttggttaatcccatttctctcaaccattctccgctcaggatcccgagttgcaagttttctgctaatcttgcttatatcttcccttccttgaacattagttgctctagaatctggtgatgatcgactgctggccttgacctttgggccaactggagcacctccatttgactgtgagaccacagaagcagaggtgttccctgaacttttcagacttccatccaaaggctttccagttggtagcctataagatgtcaagccatcatgcttcttcagtgcttcattcattcttggtggcctttgttggactatcgcaatctctctttggctgtatacacgaacagtatttgcatatccaacatcacgaactctgtaagggctaataacctcaactccagcccctataatcctagacgccgcctccattatatcagcagcatttctgctagatatatgattaggattcttcatgggggacaacttgttttgcgcaaccgacagtgtccttttggcaaatcttggtggcaatgcttccatcctaaaccggtcaataggactaccaggcatcttatgaggactaccgggcatcttatgaggactgccaacatagcttctgccaatgaactcatcatggatagtactgttctggggggactgctgcacagttaatggcatcgtataggatccagatgagcttgctgcgggcatggaatccagacccataagccttgctacaacagtggggcccctcctcacaagagcttcatcgtcaaccactgaagatgagcaactgtgctcactgctttccttcaaactcggtgcatcttcaaggaactgccaacaattatgcatacacaattacacataaataacacaaaaaaaactaaaaaactaataagattgctcgcatgaacacgcaccgaatttggtcgagtgcttggtgtgccaccatcagattccctgaaattttcagaaacccctgcaaaggaagtatcagtatgcaatcctaattcctccatccatttgagaaaaaaaggatgtatcgagtttatagcaatgactggactcctgtgccacattgacttacttggagccggagaatcgctcccatttccactgaccagccgcttcttggacttcttgccccaatcaaacaggctaaagaagccatgtccctttgaagtaggcttctccacatccatttccctttactcccctaaacctgcaaacaaaatagctcgcgtaaacacaacgaatgaaccaaagtaatacttagcttaatgcagctaaactagtaatcaagaaagagcccagtgatgagtcccccaaaacccaatctttacccccccaaatgtgacctagaaaacaaaacccaagaaacaatactactcaaactcagagaacaacgcctgcaatatacagcagcattccatcaatttacccgaaatgcaggtaatccccaactaagaacaccccccaagaaaccacaaggcagccctcgcccgtgtagaacaccgcaaagatccggccttctcctcccagctggagtcaacgccgccggattcaccaaagcagcgcccaaccggagccaaatcgccgcgaacaccactccggatcgagccgcattgagccgtagctcgtcgccctcgccggtaagctcccaaaccagcgactttttctcgtgcacaacacaacaaaaccacacctcttggacccagccgccgccgttgagggatccgcgccgccgtcacattaggtccggcgaggtggagaggtggcggaggtgggaggaggaggaggaggaggccgcggccgcggaatccattaatgcggctgcctgaggtgggcgaggaggaggagaagagagagagagagagagagattggagagaaaagaagccttttttttctctcacttgtcctctcttcttctcttgctgctcttctcctctctctctctctctctcgtctttatgacgaaaggtttattaaaaaggaaggaaatttggggaattttggggatcggtttggtcgttttcgtgatgtaacgagatttggcggttgggtttggatcatttgctcacaaattttggctctttgtgtgtgggggtgtttcgcctggtaaaataaaataaatgggttttttcggtgtgttggatccgctgaaacagatcatgtttaagagtaggacacgatgagcccagtggccagtacagttaacagatcatatatgtaccaaaaaatttatttcaaccagatggtcatgtccacggcatagaggagatggacagtgataaaagtacacctaacaatgaaatggaaggtcttgccaacacacgaattataaaaacaattatataaattggttttgggctattattgcagtgcacgaatttaatagtacaaatttcagtagatattgagttcgcgaaaaatcagtagatattggttcaattcccacaaaaaaaattctgaaaaatcatcctctcaaagaagaccttgattctcataaaaatcttctaaatatctatatgttccaaaaaagaccttactggtatatcattttactttattcagtttttttaatgaataactaaatagttgaatgattttgtaataattatttgagagtacaaatgaatgaagtaagcattaaaaagttgaaaaataaataaaaattgttttctaaaagtttgtataaaaagcatttttataaaaaaagcgtacaccgtttagaagcttggaaaattggccgttgttacattacacactttactaaagttttaaatgcttttaaaagggtaaaacgtagacacaccacggcatgtcgcttgcaccctaaaatgacaaggttgtttcacgaaatgggcgccgccggcgacggccacggccacggcggcggcggcggtgcaccgtagacgtcagtagttggtggtagtgtacaatcatgcgtacgcattatcgacggtcgccggctaaaaaagacgattcccgtcgccgtcttcatcattttcgtcgatttccgttgatgttgcagcttatcatcctgtccaaaccagttttttttttttacactctctttagttttactgcaaatccttcgtaggatacccacaagtacacaatcaccccaaccaacaatccgcatgaactgggctacggtttcagtcaaagtttggagtaaggtgctatctataaaacatgtacacctcaacaatagactagattaatagtaaaccacttcaatggtatatctacatgggtatctatagctctctaatccattgcctagtttttctctatagactatctccatgttagtagatagctttgctctctctcttcatttaatctcttccaagtaggaaaatatgctgacatggatctcttgtagagagcttatagataaccattgtgggtgccctaaaagggaaaaaaatatgtggttaagacgtacactttaacctgactgaacatttcaccaaccaacgaaagtgtagtactactctactacgtatggagagcatccaatccaatccatcctgctcttgttgtcttttgtcttctccacaagccaagcatccatacgagctagtgctggtacaggtcgcaattatgcaaagtgacaggagagattaatgcaaactaatcacactagcagcagtggtttcctttgcaagcagggcagagttaatgcgaggaggagttagctgctctgctcgagtttaagggtactgcaactctgcaagtcagcagctgcaagaacatcaccaagttcagctaagctcgtttggagatcagcatcagcttacactgacagagcttatgctgacaagtagtgacggattcgtctgcgttgatgtctcaacaacctgtaggccatcaattaccggtttttgcttaatctgcttgcgattttgtgagtgcttggatagaatagaatccaatgtaggacacgaatactttggcagtgtgtttgcttcgattcccttatctgacagacaacctgcaagattgtgcatatgtgtaggtgcttggtcgccattgcagatgcttttcttttcccccgggcaagcaaaggtccaagatttttatcttattattatcattttttaacaaaaaataatctgcaaagaggactgtactacatatatatcttcattgaaagaaataggagagaaatgagctaatttttgttttagagtgcactaaacagacattccaggatgagaaaattgtaccatttttgtttgttttgtgttacaattcctgaagtatactgaatattttggcacagcatcagcttcagtcagaagttgagattatcagatgtggtgggggaagttgttgtagctgaaaagcatacatagcagtggggtgattgtgtttttcactcttcccagtactttacaccagtagtacatcttttcatgaaaaataaacggaaaaattcgagcttttttgcagatttgagatctacagaacagaacataaccttttcacgttaacgaagtaacgcgaggtttagggggtgtttgggagagaggggctaacacccccttagtgcatatgcagtgcagcactctgaaaaaagatggcaggtagggtagtagtgctccttaagccgcgagagcacgcaacgagaaaactgacagcctcccatgtgattttacctgccaaacctcactttgatcagctatcagatgagatgaggaaagcctttgctgctgtgtgcttgtgtctggctcaagcgagtagcaaattcagattctatagtttttttttctctctctgaaacttttcttttagatggactgaatgctctgaaagactcaaaactattgcacgtttacatgaccaatggcatggtttttaaggccctgtaatctgaaactagtacacgttgacatagagacgattaagttgggaacacgttggtcagaagtacggagttgcaaacactactcctatgctgcataatatagcaacttgtaccatttaaaatctatcttaaaatataacaacctcgcgtctcaactaattagagcaggatcttattttagctattcctttactatctcatctcaatcaatcacgactatttctcatttaatttcacatatcttcttaatctccacgaaaaaaaactccagaaacatttacacgagtattttgggaatagtatgtactaatcgagacactttaccgatttgaagggcgcaaaactgaagatgagatttgcaaaatgcaatgggtcaacaccacctgttcttgtaccaggaggctactatgagggacgcatcagcaacgagatctgaaccgtggctgtcccattgtctgcctgcttgaggcaaagcaatcagagattcagagaggcaggctgcccctccactctgcttgcagtaaacgataaatgcaacagaggcccactcatccaagatcagatcgtcttgggccacctctctctgcggcccaaactaaaagagaacggtggccaaacatcttgctgggcctcacgcggtggaataagaaataagttcatctgaggtcccttaacttgttaacgaatctgattttcgtccttcaaccggaaaaccagatacgacaggtcccttaactatcaaaactggtgtagatgaggtccctcggcggttttgatgacagttttagctgacgtgacgcctatgtggctaatttgactcggtatttgtcccacgtggcattgacgtggcgcttacatggcaattccatccctgaaaaataataaaaaccatgggcccacatgtcagttaaaaaaaagtgggcccccacaagtcagtgctctctctctctctctctcactcttcttatctggacccttgccgtcgacttcactccgaggcgttcgggctgccgccgctcgtcccagccctcgacccggccgtcaacatgagcagccttgccgccggcgcatgcttcgcctccgccggcgccggctacgacaatgccacctctgatcttttcgttagccttccattagagcaaaacgatagctagcttagctacattttcatggtgttcttgggtgacatcacacatgacatccatggagtaattttgtgaggtcgcgtcgtgcagtcggtgctgccgatgtggaaggagctggactacttcaaggagtacgcggcgaggcttcaaagcttccggggggacgacgacgcggcggcggcggcgacgctgtcggaggcgctctacatcgtcagcatgggcaccaaagacttcctcgagaactactacgccatggcgcgcgcccaagcggcggagtactccacggcggtggcgtacggcgactacctcctcggcatcggcgcatcgccgagtcgtactcgttcgtccgcgagctgcacgcgctcggtgcccgcaaggtcgaccttaacggcctcccgcccatgggctgcctcccgctggagcgcgccacggggagcggcggcgcgtgtaccgacgagaaaaacaccgtcgtcgagcgcttcaacgccggcctccaggacatgatcgcgaggctcaacgatgagctcggcgacggcgagatgatcgtgtatggcgacgtgtacaggtcggtggccgccggcggcgtacggggtggagaacgtaggcaacaacaccgtgcccacgcgggtcaaccggcggcggctcacctgtgccatctgcttcgacatgttcgcccccggtaggatgaggtcggcggggtgctcccatagtcccactacaactgcatcgcttcggtgcccggacctgtcctgctcggtcgccggcggaggcgagcgcagcgaccgttcctgaggagggcgcgggggcggaaggcggtgctggagaacggccaccggaggccgaggcaagggggaagcggcggcggcggcgggaacatgcggaggcggcggaggcaggcacggcaggcgacaaggagagggcagcggcagccggcggtaggcccatgggggcgggagtggaggaggccgcgcctacgctatccgcatctccgccggtgagaggagagaggaaaggggagagttgtgaagataggtgagatggggagagaggaggaagaagaggaggggattgagatgagaagagtgagtgagagagagctgatatgtgggacccacttggggcccaccagtttttttaactgacatgtgggcccatggttttttattattttcagtgatagaattgacacgtaagcgccacgtcaaatgccacgtaggtgccacgtcagccaaaaccaccatcaaactgccgagggacctcatctgcaccggttttaatagttgagggaccattgtatctggtttttcggttgaaggatgaaaatcggattcattgacaagttaagggaactcagataagcttattccgtggaataactaatccacgggcttgctctcttactgggccggtcttatcggatcatcagatcaaacgagcactaatacttagattagatggaaatcgaatgatatggatttggtctcccgtctcactgccgtgtgggccccaccgcccactaaccaccccgaggcatctgcgccgctgtcgtttcgccggtaatctcgctgcgttttggtcatcaaaagccctaacaaaaacctccccacctgcggccgccgctcgcgtcccatctctccctctctcctcccacccatggccgccgccgccgaccgcctcctccacctcctccgcgccgcgcctgcttccccggcccccgccgccgtcccgtcgtcccgcacccgagccaccttctaccaccagccgcggagcctccgcctggcggcaggggcatccggtatgcgccgcgttgccgtggcctgcagctccgcgggcgcgggcgggagcggggtcgagggcgatgaggaggggatgacgtacaagggcgccggcgtggatatcgacgccgggacggagctcgtccgccgcatcggcaggttggctccagcgataggcggcttcggtggcctcttccccttcggtactatactactacccatctccttgtttgtattaagtagattggttttttttttttttgcggggaagtagattggggtttagtttgctcgtcattaatgggtgtgtgtttgggagggttctgtgatatgtattggtagttcttaccccaggtgaccaatttcttgttgctggaaccgatggagtcgggacgaagctcaagcttgcgtttgaaactggtatccatgacacaattgggattgatctggtatgtgttcactttgctagatgagtattttatttcatccctttgagtttgattgactcaaatgatttttaattctcatgttaggtggctatgagtgttaatgacattgtgacttcgggtgcaaaaccactgttcttcctagactactatgctacgagcaagctcgacgttgatctagcagagaaggtattgttgacgctattttgtttgctgaaaacagttatgccggctaatcctctcttatctacatctgcttataaagtcataattattctgttcaaaacttttattttctcaactacataggttatcaaggggattgtcgatggatgccggcaatcagattgtgctctgctaggaggagaggtgaagttccctaactagaacccatgttttagcagtggaatacttcaatctttgtaccaatgaatacagaatatatgtatcataattgttcatctgtcttgcaatggtttgtgactactttacttcatacgaataaattttcaattatgcttacagactgatcattagaccattttctaactagcaagcactagcttcaacaagtgaatctttgtaaatgttgatatggtattcagcttagttcacatggtggatcttgtttttcatcatactttggtttgtaaatgctttgagaatacttaactatgatatatgagcataagtacaaagttaacataatgttttgactctgttatgtgcagcaacatactaataaaaaacaattgcatttatcattgatccatttgtcatgcagacagcagaaatgcctgatttctataaagaaggtgaatatgatctaagtggctttgctgtgggtgctgttaagaaggataaggtcatcgatggtaaaaatatcatggagggagatatcatcattggtcttccttctagtggggttcattctaacgggttctcccttgctagaaggtattgcatctatccaattcgagttgttttgatccaaatagatggttgacgcatgctcttttcttttgatgttgatacttgacaacccgtcctcctgttgaattatgtgtcattaatggtacctacaaaatttcatatttttttagagtactggagaaaagtggactttcgttgaatgaccagctccccagaaatgatggcatgataactactgttggtgaagctctcatggcaccaactgttatctatgttaagcaggtagctttgctgatatatgtttcatatttagcatatatgtatatgcaagtttctaattaaattgttgaaaatgaaaaggtgctcgagattattaacaagggtggtgtaaaaggaatagcccatattactggtggtggcttcaccgataatatcccaagagtatttccttctggacttggggcaaagatttttactgcagcatgggaagtgccacctgtattcaggtggattcaagaggtaagggttaacagtccacgagcatgtcatgtgtattcttgtaaccccagtgaagttattcgactgtgttgtactgaaaatcattatagtattgtgtatctgttctgaattcctctggtggaagttatatatataatcagccatatttgaactcggtagaaactttaaagattatgataggaagccctaattagagactgggtttttcttttggtccccagttttcatgcactgtgctgcgctgcctatttggtccttatcattttctccgggtgtttgtaggttggaaaaattgaagatgcagagatgaggcgcacgttcaacatgggaattggaatggtccttgtggtaagcaaagaagcagctgatggaattctcgaaggtacccatggaccgaaccacgcatatcgcattggagaggtgatcagtggtgaaggagtccactacgtctgatctaattaatgatctttataatgctttgagtagtttgaggtttgttcatccgacaggcaaaccagcctaatttttgtaatcgcataacataaagggggccaagtcctggagcaacagtgagtttagtcctgtaagataagaaaacatggggcgtactccttttagttccacatgagaacttgcccccaaacggcagaacctattatttggacttgcatctacgagaggtgtcatcttattaaaatgttcttgcataccaactctagatatcctgatgtgtctcaccatcgaggcgttgcatttctatactcgttataagcatccagaaaaatcgcattaatgcaaaaaaaaaaactttttacgtaattacctgctacatgatctcagcaacaatactcaagcatacatgttattattcgaagttcttgcatccattaccacaagaaaacactcaaaaaaacgtaaagcaaaaaaaaaaaagaatctggatcgaaaaccttggctttacaagcgtcaaaatggcataggataggataggatcaccggttgatatcgccgtcgccgccgtaaggtgtccggccgccgtccggcgagtcaccagcggcggacgaagcggtccttgatccaccggaacccccggcggagcgacgccttgaccctggcctcgacggcgtaggccttgtacgccgccaccctccgccggcgcttcgcctccgggtcgccggaccaccacggcgtcgacgacgacgaggccaccgtcctctcgtcgccgtcgcgcggcggcgccgacccgccccggaactcctcgagatccctcatgcgttccgtctctctctttgagtgcgcgtttgccggcaacgacgacgagcgaggagaggagcttttggcagctcgcatatataggggagaaaatcagggagagtttgaggccggccatgacggcctcaacgcaatactctccccgtctcccagattagccctgaaattgtcgtcgtcgactagtgcttggcacagctcgtggaattattagcctttgcaaccctcaaaaaaacaatggttgacaaattgattaggatttgcattgcatggagatttctatgtgtttcttctcaggtagtagatggcacgccgtcacgttggttttcatacgtgcaacatgttgcagttaggagttttgacagttaaattcacatggtgcttctggtaatctgcttgaaatatggcaaagttgcagacttgcagctcaaatatatttttttttcttttggtgtgtgattgccagtagtggaggagcagtcagcaagcgcgccgtcccggccgtagctgtgatttggtgggcatttccgtgtgctcggctcttggctggatggaacaagtcgccctccatccaattacaaccagatatcagtttgtttccgcagcatatgtaacactcagaaagtgagaacctcttttttttttcttggaatgtacaaggcacaggtgcaaactgatctatcatctcactatgttgatcaaaagtaaccgagataaaaaaaacaatttacatgcaaacacatgatgttgtctaattctaacaaaaaaatctttttttttttgctctttctctttttttccccctcttaagttctacaagtctccaattttcctttccatctttactctcccacaaagggttacctacaccgctacaccagacaacttattggagacaggaaaaaagttagcatgtaggctgatacaacccccgtacaagagggcattcatcatcatatcatcatactctatgtgccataggcagatgtgctcaaggcagctgaaaattcagacggcaatgtttcactaacaaacatttacagtcatctccacgtaccggaacgggagacgaaaaaacggaaatctggatgctctacttgtacgcagctgagccagttgccagcctcctccatcagcgaggtgacacgctgtccttgggtcccatcggatgcccaaatggagctgcgaagtttgtaagatgccagtccaaaggcaggcaaagatagcttgccagttgcatttgcgcaagggctgatgccaccaaaaccagggcatgctggtgtagtgctatcgctatctgcaagaatgggaatgttaagcaatctatgcagtatgtaacatataagttgcatctaggtacaaactatttacaccttcataattcattaggcattagaaggtatttacccttagaaggtgttgctaggcaatggaatgtcaagaaacaggcatcaaggtcttccaacgtcggccctgttggaattctatatatggggtacctgcaatgggaagcacgaggatgaaaccagtaatgtatagaatcatagcaacaccatattagcagtgatgctcttctacacagattgtatgtcgtgctgaatttcagcacagtaggcatgcctgttgttaggcattgcaactggtaggcatcctctgcgcgggccagcacagttggcaaatgtcattattctcaccgttgcaacaacatcattctagtacttataaaacaaaaacgatgtccacagaaaaggaagtgcaatattgtggcactaaaactagaagctatcagacaataagacatgaggtgagctcatggcggatagtctaatatagtaatatgaccattttttaagcggaaacaacatgaaaacattgacttcaaaatacttcttgaatcccaacagtttgacaacaagggacacatcttatcaactgaatgaggacatctcacaattggaacatggaagtagaacttgaagaaataaaataaccataccatgcaacagacatccaactggatggcagcagatcacagcttttgaatgccttcagagctggaaatctactagcaagaattgatacctgaagttcatgcagagtatgattatgtggctatgtgcataaatgtttgtaataagcatgggtgtaaacaaaaactcaccttgtctgtcagaggttctctacaaaacgggggatccctctccatatactgaaagattggagaacttgcagatgcataaccatcagcatcatcagttcgcaaactaccatttgccatcccatgtgtagcttccacggatgagactcttaatcggtcaacatcagtttcactgctactctcgctgctagcatccaggtattccccatcactttcatccccaaggcgccttaagtaagcgagaaaaataagtagagaaagttatatgctatcaaggaatcaccaagataatgaaagcaacactactgaacaggtaagctgttcctaactatcttcatggtggtcactatgcctaagtagaggtcatctaatgataaagccataaattcacagctcgccactctttcagtttaacacagatttatttatttttcttcatttatacatatgtttgtccaccaagacttattgcaaaagcaagttcctgaaacttcaggaaggcatgagataattccatctattagaacccaggaaaaccaaccgaagaaataaagttgaggaattctgtgtctaccctgtgcttgtctaataacatccaatgcataaattatttatttacatataatttggcacggctgtaacaaactgatatactggagtaatttcttattagcccagtagaatttgataagtcctgcaaacatatgaacactaaaaagcctaaataaactgaagtgaaaccaaagatacaaacaaagtgaccagctagacatgttgccatattgatggtttttctttcacaatggttgacctagtgaaggtttttcttccaaaaaggagaaattctaaaaatcaaaacttggcattggagataaagattgctacctggttcttgaaacagatcttgatggatctgcatacaactggatagcagacagatatggcacgtaatactgtgttacagagtcactgccatttagcaacaggggaacgccagctccataagcactccactccctgaaagattcccaaagatcttcaaggcagaaatatggtgatgtatttgtacaatcaccagtcctccacattttcaagcttgtctgcagaagaacaaaggtattacaaccaaaaacagcgtaactagaaccacggcaagatagctcgttacttcaataaaaagctgtttatctcatcagaacattgtacaaacatcactgcacgactcaataatctctcacaaaactgattctaatgttgttacatcctaaatctgattggcatgaacacaaaaccacagggtatgaattgtttatagatgaaaattatagctactgcagtaattaggaagttaggagctcaagaaagacacaattttccatctaggattatcctgcaaaaaatatgcaaagccccccgatagtgcttagagcatagatatagcaacaagcagtgggcaaccacagttttattgagttttaggtgacacctccatgtgttcagaaaaaaaaatcataatataaaaatccttcacttctcaaggcaacaacacttgaaaatagtttgcaccaaacaaaacaaggatcctcttcctaatttaaagaaaacttgctactacacatccacgattactatcatcaagcgtcttaaatggctggtgactatcaatcagatcttaaaatcagcagtcaagcgcaaattcagaaacatgagcccttctgttgatcaccactagaatgctcaacaagaatagttgattttcccctgaactacagtatcgaactatttcatcgatcctacaccaatgagtagcattttccctttgtagtcacgacgcactagctacacttaaaaacatattaattaaaaatggaaacagaagtatagatatcaaaattcgctcgttcttcctcatatcacccaacataacatgtctaagtttccgaaattcgcatgctgcactcctaaaataccttgggcaggtattggaagggcacggagggagtggtggaggtgagaaacctctccaaattcccactctcctccaccgccgtcacattcacgtcagccgcggtggtcgtggcagtcgctgtggatgccacggaaggcttggacgacgtcgacgaggagtcgtccgaatccaccctgctatccccgtccgtcagcacacccgcgcccaccgccgccgcagccaccaccgccggtggcgccgcggcggccgccttgtgcctccccgaccgcggggacggcgacggggacagtgaaggggacgtggggctccgcagccgctgctgctgctggcggcgggaatggggaggcaggtagaatcgttcgacgctgttgcgggaggaggaggaggtggcgccgccggaggaccccgccatggcggcggcgggaggggaagggggatccggttagggttttcggggggatttggggattgggatgcttagggttagggttttggtggctttttcccctttttttagaggagggtttggatctgaagcgaggagcggaggggaggaggaaggaggcgcaacgcaagagcggagcggacgcacgcagccacactcctctccactgtgctgtctgcctgtcttgtgtttgcttcttcgcctcccgtcgctggccctacttccattttccgggagcattgtttctcccgttttttttttctctataccgtgtgatagtgtcgaaatcaaaggaatttctaatgcgttcttcctagtggtttggttcttgggatttttcgtagcatgtcacaaaacatagggaaaaatatcttttaaataaaagcaacggcaatacagagctctaccatggatgaataaagaatggtgttataaacgctcttctgattacggtgatagaaatgagagaatcatattaggagttagcatagaaattcctatgagacgaaacgaggatgtggcagcaaggataatatcatggtaccttatggagtcatagcttcctctcttttgatttcgttagcagacctgaatatcgagtaatggctacctaacaagacggtatcgagattgaagatgggtgcgatgaggaagacgactgttaccgatttgtgggacccatataaataagaagagagatatttaaaagtggtggctaagttatttcaaagcggtatagcccggaaaataaggagttgacaaaagcgacgtagccatcaattgaacatttggcttgattgtcttgccgcgtggatggtgtaacgtgctcaattgtcatagattttaccgtatttatgtgacatcaaacatacgtacatgtgccactgctatctagacatcagcacttgtattttttttgcgtcttgttcacaaacccatcttcttcgacaatggtaatcgcaaccaaagcaagtttttgtcaaataatagaagaggaataacacaacaatactagggagtagggataagaaaaagtctgtggtaagagctgtgacatcatcgaagccattggctagataatatgtaggacatgataaagacattagaatgacacatatcttttttgaaaaatcccagcaacaaaaatcagaatagtaaagtcatacaaggcggcaaccaacggtaataaagaacaaagatagcatagatagatgttggaggtacaataagcatcttgtgtagcatagccaatgccagacgttaagaactaaggcatgtcattaggataggagcaacagtgatgaaacatgagcagagtggtcatgtggggaagcactataaagtgtaatatgttagtcacattcacatctctcgtagaatagtaataatcaccacttaagtagtacgaaagtatggatttcactgggagtagaaaaatattttgcgaactaacatatcataaaaagttagtcgtagaaaaaaatttaatcctaacttataaggtggaaacatcaattgaaatcgatggtcccatacatactacttaaatatggtttagattttgaataatcagattcctacgaaaaagaattctatatagttaagtggaacgaagaaacaactctccttattgtaatacataagaatcgcattcacttgttaaaattttgaaggatttttaacatgagattcaacatgttaaaagatatcttttgtttttccgtgctccaattaaacagttattcctgtattttttatgctttttttcattcacgggattcaagatgctaaggcactgaaattttacaatttttccatattcatgatttcctatgttccaaaaattccgtgtctccaagaaacggctaacgcatacttgtaatcagtagcaaatccttaacaatagttacataatttagctatattttgatactacccaaaaaaatcgatgaggatcacccgataccacaatgttagacatttacccaaaggtaaaagtatgttgtcaacataaatagtactccctccatcacataatgtttgacgcagttaactttttaaaacatgtttgaccgttcgtcttattaaaaaattaagtaattattaattcttttcctatcatttgatttattgttaaatatacttttatgtatacatatagttttacacatttcacaaaagtttttgaataagacgaacggtcaaacatattttaaaaagtcaacggcgtcaaacatttagggaaagagggagtattacaataccattatgtttttttttacattacaataccagtgtgttgtcaacataagagcaagtttaatagaatagctaactattagctctaattcatctatagccaatctaatagtttattcaaacaatatttatctataaacatatactaaaccattaacatatgatctcacttttcatacacaccttgtgttggagtccatagtagtatgttttccttctctcttttttttctctcctctacatatgtttaatagttgacttatagcctgctattgcacttgttctaattcaagtcttcatatactgccatgatttaccagaagcagggggagctttcgggaaaaagaaaagagatgatcacagccagcaagttccaagcaccagtgcacgaccacacgaccatcggagaccgtgagcagtaaaaacagatttcacccaccgcacggggagtgccgccgtcaaagtggctgtccatcgccccatcgccagcggtaaaaaaagccgcgaatacgggcgacccatgccaatggcacacacagacacagtcactcacacggatggacggcgacacgttcatgtggccggccacctctcgcatgcatcgccttgcctctcacttgcccatcctttcacctcgttcctttccaaatccatgcaaaatctcacccggagaaagcaacggtctccgcctcccccctgcttcacagtttgtttccatatttggtactcctactcctaccaggagattcttcgatggatgcatcatcatcacttggaatgtagcactaacaacaatgccactcactccctcacttgtcaccatctcggacacagcaaaggggtgtgtgtgagttgtttttcttcttattcttccacaaataatgaggtatccacaacatcagcaaaaatcatgagctcttgctgtcttgcatgacaacaaaatggaacaaaccaaccaccaggatcacaaagatgctcacaaaaacataatcagcaccactgttattagtattagtgacaccaatccatatcatttcttcaacaagacaaggaaagtactaagcagcaatcaaagaatgatccatccattattgtggcaaccctctcctctcaaaggagaaaacacaccaaacacctcttgtcaaagcctagaacatcacaacaccatcccatccattcctagtaaaagctactactgctgctagtacggagtagaggatagtagtaacagcacaacagcgaagaccctgatcacgcctgatggagaaacacaggaacacctgggtgcttgacttttccccttccaggaaattgcacggatgttgacctgactatttgggctcacaacacctgaaaatagaatgatctactagttgccatatcattgctcaaaaccaagagctaaacatagcaaaacccaacagatctactagtatacaaagcaataaacggaaacaaaccatccatgatcacatcattaacaacagatcaatcaacagatacaacaccagcacatcatagatccgagcagcacaacagccacgggagaacaaaccacaagttgagctgaataatcaaccatgctgtcatcatcagcggtaagtaaatcagtcaacactgtgtgcagatcatgcaataagagacacctgggaggcaaagattcttcagctgaaaaactgcattacttggtgcagatccaggagctaatctcttgcaaagaacaagagaaagaagatggatcataagctctttcttacattgcaacgttacacgctctactaaaaacactactagtaacattacagctaggcaagaacaagtaacagtaacaggaagaacagcagctactacatcatcatcatcattattaacttggcttccactttgatcgaactaattagctggaaaaactaagcaggggagaagaaaaaaaagggtagagatctgtctagtctctcccggttgagatcatgcatgttaagcaagcaaatcactctttcccatggctgcctcctttcctctgcttctctctctcttgctgttgctaggtgggtaggtaggtagggtggtggttcaggcgtagatgactccggaggagagggccatgaggaggatggccgccttctcctcctcgccgaggcgtctcctccgccgcatccgccgccgctgcttcaggaccacctccttcccgaaccccaccatgcggagctccatggtcacctcctcccctctctccctcttgctcttcttcttctcctgccgctccgcgccgccctcgccggcgtcgagccccagcgcctcccgtctcttcttccggtaccggatcccgcacgcgttgcacagcgactggatcaaagcaaaaaaaaaaacacagatcgggcggatcaaccaccgaaaacccaggcgaaaaaaatgcacagatcgagaaagggaagagcaggaggagcagatcggatctcatctcaccttggggccggaggggccgccgcgccagagcggagtcttggtggtgtggcagtcggtgcacgccttgggctcgccggaggccgtgcgctcgtccggatctatcgacccactcccctgcaacccacagatcgagcgtcaaaaaaccacccagccaaggcgccattccagccacagatcgagccccccaagaacccacggatcggaagcttcaccttctcgaccgacgaggaatccatctccggcgccaggatcggcggatctaacaccccggaagccgcagcactccccctcctcccacacctccgctcagccgccgctccgcaacacccgcgcacaccgcgccgcagacacggctggtgctctgccgccgccgctcgatccgcgggcagatctccactccacggatctactactaccagagagagcaatctagctagcaagctagggttagcaccggctactgggagggagcagtaggggttaaggggcgggagaagcaaggaggaggagaagaagagggaatggtggtggtggaggatgaggtggtgagggtgagaagaaaaagggggagggatttggatttagatctcaaaatggaggagggaagaggggagcgagtggagggaaacagaaaaccatggagggaaagctggtgaaattgggcgcgtttatgtatgcactacacacacactctactctagggttgtttctgttctgtctgaggggtttgtttggtttggttgagtgatgatgatctatggaaggttttagaacaaccaggatcatcgtccatcacctgaaggccacgtgtgttagtgtgtctaataattttcacttgtgctagcacatggtttatttgataggctcgtgttttactatgctgttgtagtgttttatttgaagatatttgttgggcctataaacgatagtgaagttgttaatattgatatagattatttaacggctagcgacatgatatgaacagaaataagctacttataaatttatacatatacagatatgatttacaagcgtctatttaaaatatacttaatatagtacaaacaatagaaatatgcatataacttttttctaaaatcaacataaatcaatcaaattcatcatgaacttttttatggacaatggtcacagtaaaaaacaaatgccatctactggagtagtagtatgagagttactctgacgattctttttcttcttcttcttcggctatgtttagttccacgctaaaattagaagtttaaagagattgaaacgatgtgagaaaaattaaaacatagtatagaaaaatttgatgtgagaggttaaaagtttgaaaacagatccttcttcttcttcttgtgtcgcaagcaagcaagacaagccatctatagctcgtacgaggctataccaggcctaaccaggccgcggcggcggcagttctcatctcgtctcggcgagtccactccaacactccacttcactcccctccaggcgtggcgcgcgcgtgtgcggcgtaaaggcgtcgaccgttgccgctggcacgcccacacacgcgcgcggccgcaccgcatcaggccgacactagaacccaaaaaggcggcagcagcagcagcaaagcctccatccgctgcgcggctccgcgcaccggacacccaaccgccccggcgcctcgcgccgtcacgcgcgcccacgtggtccccccacccccgcgccgctgtttgctgctttgcgaaaatttacgagcccgacccggacgcatccgcgggaattccccccgcctctgcgcgcgtcgtctgcattgccgcgggaggtgaaatgaccgctttgccctcaccctctttgaccggtcagaacggcccggccaatctctgctcgggctcggcccagtgagaccttctagaaagtctctctctttgatgggcctaactaggagcacatggtactaggcccagcccatgggcagcaagaacatctcgggggtataaaccctagccgctcgtgccaccgaattcctccggctccgagcaaaaaccctcgtcttcctactccgatcgagaccgcgtcgccgtctccgagatcgccatggccggcggcggcgacctccagagcccgaagaagcggaagcgtgatgcggcggggaagcccaagacgctggcgaaggggggagacgacgggaagaagcggaagaggccctcagatgccaacatggcgcaaggcggcggcggcggcgaggtcaaggtgaagaaggagccggttactgccaaggagaagcgcctggctgctaaggtatcgttgttgctcgtccgctcggtaaattttaatcatctctggagctggagcatgggttcgaggcattagcgctgaacttggtgtggtgtggattggtcaggaaatggcagagtcaaggaagaagaagaggaaacggaattacagcctcgagaaggtaaatttggtccctgtacgatctatttcaacatgccgggaaattcatgcctattgacttatgagccagagtatgattccaggaccaactctcataatgctaggcaattggaacaatggtgtgttcagggttttattttttttaagatatattctcaccaatatattctcacatatagagcttatatgttcacgaatttcattagaagagtttaattttcgctgcattagttgaacattgaataaggggaacctactattttcatggtcatgtgttatatccaatcttgatcttcactcttggaactatatgacatgaatgcaaaactgtaatttgattctggtacccttgtcactggtggggatacttagcttcacgagaatagctacattgtcatatttctctctactaacagtaagcattgggtgtcaaatttatgttggtttcattcgaatctagtttactgattgcatttaaatattgtcaggagcttactgtactatgggaaaagatgcgatgccacaatgtgagcagcacggagagatctaagtatgcattacatcattgtcatgactcgtatctttgagatcttacagtgacaaatcaatttattatattgatttttttctcaaaatatccaggctggtaagtgaggctctccgtaaaatggatgggaaatattcagaaattgctggttcccacgtaactgcacgtgttttacaagtaagatgatcaatcgatcatattcatttgtatatcaacatgttacatggttttgatgttctttttcctggtgttgatgagcattgtttcttttggcagacatgcgtgaagttgtgctcacaatcagaaagggatgcgatttttgaagccctacagccagatttgctaactctctctctcaagaaatatgctgttttccttgtaaagaagctcattaagcgaggtaaaagctctgttgggttcatacatgataatatttctttatggttggatatgccattggctccattaacatgcctgtatttgtgattgcagccactaaaaagcagtttgaatggttcatctcttctcttcacggtcgtgttgctaaacttcttcgtcatactataggagcttcaggtatatattacttgttattgtaagagatggcataaaacttgctattttattatcatttgttaggaaccttaagagttgatagttgtgtgcaattcatgtgaatttgtttgtattttatctgtacatgataaagtaaatgataatttaatgttatgccaattctttttctttcagtcgttgactttgcatatcaactggcaacaccgcctcagaaaagaaggttgctattggaattgtattctactgagctccagctgttcactgacctgactggacagaaaacccacaggtcattgcactaaactaactcatgtttctgttttcaaatttccttgctcttttgattgttctatatgctttctgaaaaaaagattcgttttcactatagatcaaacaactgtctgcggtaacaggctactgcaatttgctaacttaaactccctttttcagtttgttagagacaatttccaaccttggattacaaaaatcatctgtactgcagcatatgactaccgtgatttatccgatcttggagaaaggtatcgttgaatatcctatagtgcacacggctgtattggagtattttacaatcgctgacaaggtaatgctatccatttattgtgtagcctatctacagtctaaacatgcctttgttggcatatcctttccttttggtttgtctttatcacactgtcctataatgcttgattttgcagacctcggccactgatgtgattcgacaatttatcccccttcttacacaaggatcatctgccattgatggagatgagccatcggttgcccctgaattacaaaagaaactgaaagctaagaaaaaaaggttgacagagccacttcttgttcggattatgaacaccagagaaggattaaaaataggagttagttgcctcaagcatggaagtgcaaaggtaggttatatttttttttctctgagactattattttatgttgactccataccttttcttatgggacactgaagtagcatgccaaatgactacccattacatagtccttcctctgtttttttcttagtgtggagattatcctcataattaaaatgtattcggcttccatgtaagattccgttaactttgtgttgaacttcaggataggaagaagatcattaaaagtttgaaggggcacattatgaagcttgctcttagtgattatggatgcattgtaagtatgccagtgtttacatttgcagttaccgcttggtgaaaacaacattatgaataaaattgttatatgtgaaagaacttttttgctaccgaagatttcagtttattttgtgctcaaatgatttatactctactgatatgtcatcttttccctttcagttacttgttgccattctttccgttgttgatgacacaaagcttgttaccaaggttagctagctccagtcttctatgcacctgttctgagtattgtgctgtgataaatatcgtatggagcatttatataacacttttgtttgatttgatagatcgtaattcaagagctcgccaaacatttgaagcaacttatttttgacaaggtgaaaaggaaaactgagcttctgatatttttcaaaataaatccacaatgcactaatagtaatgaagcttcttgttggtacagaatggaagacgtccattgctgcaactacttcaccctaattgttcacgctatctgcctccagctgatctggcttgtctgaactatcgtgtgccttctcttatttcaaaggcaagctagctattctgtttagtattttaaggagaacatagtgaagtgctgtgttataaatattccacttttggttaggatgaagcttccgagagtgctgcagaagatatcccagagaataaggtggatgttgcaactaataaggagcaagatggttcagaaagcatgcagagtgcgtctgacagcaaaaaggacccatttcaacggcgacatgaattgttgatcaaaagtgaacttgccgaggtgacatttattcagtgctatgtttattcaaatacagtgttaaaaggatgcaccttttcacattgattactgcagtagggtacaatatgatttctttggtgctcgtttagtcgcaagcagtagccagtcacagtatgtatagctacatgcccaccatgtcctaaaccccataataccaacatgcacagcattttgtgtgctcacgaatattattatataaatgatggcaaaatggtccattagggattttcctatgcaaggtttcaagtatgtaactggaaaacaacacttacaataagggtctactgtattttcttgtgtgcccactattttgcccaattagtgctgacgtgacaactaacataagttaatcgtgatgaatttactagccttgctcataggcctttctttttgtgattattagatataatatctagatgccatcgtggcagcatagagttacttgtgactcaaagtattgaatatgctttatgtggatttaatataatgcagaccttcctgatcttttctcaggtgctcatccagactctcattgagaatgtcggggagttacttcgaacaaattttggcaaagatgtattgcatgaggtgaactacttttgtccttgcagatggtgaaacctgctttttattatatgctaacaatttttcatgtcataacctcattggcatggcatgatctttggctggtactcttctttccgtgaatatcggtcacttgtttactgaatcatgtatcagggaaatcatgatttgaataagttgcaccaagaataccctttcgtagtatatcaggcacaaacgagttagtgaaatacgatacacagtcataatctggaatattgaagcaacgtgtctttgccaatctgcggtgcttgattgttgtcattgtataaataatgtttcataagtgccactggtgtcactctgatatgttgacatttgcaaatctgaaggttgcggttggtggagaagataatattctggagggcatcactgacaggatccacagcttgcacaatgcaatagcttctgatgcagcacgtccaaaggcagaagatactgaacatgcctttgataactatcattccagccgtctaatcagaagacttatacttgaatctccagcatttgctgccatcctatggaaaaaagctcttgaaggcaaatgcaagacatgggctgatgggcacaggtacctcgatttttattgatatgaccctctcgcctcttctcatgttttccaggagtcacatatagatatgttctattcatcggatatttataaaattcaatcgttgattggaatttgacaccagtccctttaggtcatattccggtggcattgtctaatttatcatgcatactgtaaatttctgatattctctcagcttgcttgttctgcctgatgaacattttggttttgatttcttgatatttttattcagttccaaggtggtcgcagcattccttgaatcgcccgattccaaggtaagggatcttgcaaaagctgagctgcagccgctggttgatcgtggcattctgaaaatctcagaccataaagcagtcgaaaaatgagttttgcacctgacttccaagcatctacagcaatacgagaaatcgacagacgaacatccgtgcttctgtgttggatgttttttttgtaacatgagtatgttctgcggagcaattttgtcacctgttaaaagagtgtagctactgctgtcaccagtgagtgagtattaactctccgtaatgttatgtacctttacagtaaaattgcatttattttggtatgactgcaagatacgaattctccggccgtgtttgttctgcataggaatgcgattgataattttattgacaactgacctgaacaaatcttggagaaaacggatgccttaatcatagagttgtcatttttaatactagaaaacgatttttgcaaaacacttacaaatgcttcaaaacctgggcagtatttagagcagtatttagagcaggtacaatagtaaactattagccagctataaacatattttaatgagataaaaaagataagagataagagcagcggactgtagatatgtagctagctgcagcacgaacttcaagacgcagtgtgtatatgataggtgggatcgtatattaatagtatagttagctattagattgactatagatgaattggagctagcagtggacagtggactatattattaaacttcttttagtgaatttcactgttttcctcttcttgttgccgtaaaatgaactaaagaaagctaagcaatctgaaaatgtaaacgattctttgagagagaatggaagctaataaatctgcaatgtcactagcaggagttcgtccgtcaccaatgacgctttgttcttgcggcgcgctccggcgcggttctgatctgatacaccggcgactcgccggcgccgctgccgcaccatctctggttccgatcggcggcgaggttctcctcgaaccggcagaactccgcggcgaacgccggcggcgggggcgggcgggtgtccgggtagccggggaaccgcagccggtcggaggggtcgaagagcgggaacgactggcgccgccgggcgccaccgccggcgttggccttgaggcagctgtcgatgacgcggcactcgtcccggagccggttntgcacctcccgcagcgcctgcgccgcaacgggaatcctcctcccccagcagcagccgccgcggtgcttcccgtgctgcgcgccgccggtggccgtcgccgccgccggcgtcctcctctccgcgcggtgcctgaacctgtcgtggcacgcggcgcagtagctcgcgcccgctcgtcgtcgaaggctcgccggcgagccccgtcagtgaggcacgcgtgcgcctgcacacgttacacgatttgatcgtcgcatcaaaagcagaaaccgcaacgaaacgaaacggtttttgcagaattagtatactattacgaggcagtaaaaactgtagcaaatcaccacgtttaatcactgttacgttaaccacgaggattcaaagtttcaaatcgatttgaaaacgccgctctgtgggcgaccaccgctgcagtaaccgatggtggcggcgatcgaaaattgaccatatctccaagaagaggagcccaatgcaatgcaaccacccactaaattgaaagcaagaaaaaaggcaaagattccaagccatcattaggaagaagaagcatgcggaggcagagattaccaacctcggagacgatcttgaatgcgacctccgcctttgcgtgcgtgttcttgtccgggtgaagctgcagcgctgcatgcaaaccaaaccaaatcaaatcgaaccaaatcaaaatcaggtaatccgattcagggcattgcattgcgtcgcacgcaccgagctggcggtagcggcgcctgacggcgtcctcggtggcggcgtcggcgacggcgaggacgaggtaccagtcgacgaagggcggggatcgctgccggcgccggtgcgtgcacgcggagaacgccgccgacgccgcgcacacctccctcaccgcctgcgccttgctaccgccgccgccgtccgccattgccattgcccccaccgcgtcactcgatccgcttcacctccacggccatgcacattcgatcgatcgatcgatcggccgcagtgagagccgagccgagcagtgcaggcgtcgcggcgagatgctaccagttatagtaaccgtgtccacttcgtctctgcgtgtgaggagtggagtggcgagacggtaccgttcaaagcagcgatgagaggagatctcgaggggggaattcaacagcgcaaattgcggccaagcgacaaaaatcagaatagggaaataaaaaaaacaaaatgatttgatttaacacggatcaattaaattcatcacatactactagagaaatatttatcctgttttttaataatatatcttattatcatattactctctctaataataagtatttgataattatgataagatttggtgaaacttctacaattccgatcatcgataatttctttctcatattgttggttcaaagattaaataaattatgtacgtatatttgacttaaaaaagactatcgtaatttaataggtccatttatggatctatatgctttgattggaaccaaaagatctagaaattacagtcttaatagattttgaaaatttattctaataaaaacttcaccaaattttctactccttccgtttcatattataagttgtttgacttttttcttaacaattttttttagatttgactaagtttatagaaaaaaaatagcaatattaatgatatcaaattagctccattatatttaactttgaatatattttgataccatgtttgttttgtattgaaaatgttattatattttactacaaacttaatcaaacttttttaaaaaagatttaaaaaaaagtcaaacgacttataatatgaaacgaagggaatacttaacatctcatttatgggagtatcttttatggtaccacatgttagtctctctatattatcttccgatgctctccttgctcgaatgagtacatgttgtatggacagagggttgcagggatcaaacaagtgcagctcgccgacgagatttggtgtttgtcctgttgctgtaaacgtccaatgttttaggttggccatggcgatcaaagtcctgatgacaccgaatactgatctggaaatggaaatgcagagctgtgatcattcagatttcagagtttcgcatctctgatgatcgtcatctgaatggaaccagtccctgtttcttggactaaacttctcacataatccagttgcgccaaacattcagctggatgattggctttcaggttccgattgttcacactgtcactacgattggaagtactcgtagtataataatcaacaaacaataacagtatattatggtcttacagtttcagataataaactccggttgtcagtcagtcgccatttcaacgagactgaaccagaaggttcatactgaaccaaacatttctcaataatctgaactgtatttctgtaacatttgtcagccaggcaggattagtttttccttgagccgtgagaccctgacaccagtggctatgtcgaattctcgatcgattggcaaggctagtactctactgctacttgacaaatgaattcagtcaaaagagagagttgcttcgagactttcaaccagaagcactgtatcaagttaggctgctaatgcatcggttgccgatgcaagaattttgtccagtatacttggatcaccacagaatgccaataaaagaataatattttcaatgagcaatgaaatactattttcattttgcaaagacctgaagaacgactgaacacactagctaaacacgaaccctatcttttcaacgttccaatttgcgacgccaaacacaagcaacaaagaatccaaagctgatcttggaacagtgtaaaaattttacacacccaaccaattgctaatatgagagagcctttggagtaattgtggctgttcacagctaaactcaaatctgatgctagaataataaagaagacatattgattattgaagcgtagctcgcctgcagcagcaatcagacagagctaaactgctataaacagtttggtggctgcagaatgcggctaagattttcgagcttcatgttgcgatgatactcgaaagatcatacggatatcctcccagcaccatctggccgtccgtagcttgatccaacggctcggagagaaggagatcttcttcttggaaaaaaaaaacattcacgtgccactgcatgtgggccccacagctcagggctccaaactctcggcatcttcccacgagggtgccagcatcatcactcaccagtcaccacggagtaaaacccacggcctcattgtccttggcgccctcttacatgtgggcccagtggtagaagcgggcccacatgtcggtgtgtgtggggagtaatgggtgagaaaaaacccgtggtttttttttcttcttggcagcaatcatttcggtggggccatgtcgagctgaccaattggcgcttccatgtgatccacgctgtcatcccgggcccaccagctctcccttgtcgataagcatccggagctcgctgctgttcttgtttctaattgctggtttctaccagggccttttagcaaaaggggacaaataattaatcctactagcattttgtgatcttgagatccactgttttgtttggatgattgaccgagcacgaacgtaaaaaagactgtgaggaaagcaaattgtactgtacttatattcaataaatccatttttagagatcgttttacaatgcgaaattgcgaaccgagagccagaacattccttgaaaattagtagacctatgaaacttagggaaaatgcttccctttttttgtttggggaaaagaaaatggatcaatccggtaaataacatcgcgcctgcaatggataatttatcgtggtgatgtcaaataaaaatggaatagcgtttggggttatgtcgaatttcctttcattcaatctctatcgtaattggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttcgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaagtagtattaaatggaaaaaaaaccaatcacacagtctgcatatagattacgagacgaatcatttaagcctaatttgtgctatgatttgacaatgtggtgctacaaacctacagtaaacatttgctaatgacagattaattagacttaataaattcgtctcgcagtttcttagcagaatctgtaatttgttttgttattaggctaagtttaatatttcaaacgtttatccatgtatccaatgtgataactaaacctaaaatttttcccaaactaaaccgtgccttattttaaaaaccacctcacttcacttggggggcaagttgcaagtctcaagtttacaaatccacccctttcacaaacaaaccgaagcttcttctccacttcgtcccacacttcaacgcctcgcgatcgatcgccccaaatccccgccgccgccgccgccgccgcgaatcgccggatgcccgccgccgtcgccgccgcgggggcggcggcagcctcgggcaccgcgctgctcgcctacatactcctcgcatgctgccggccgcagccggcgccggaggccggcgaggaggaggaggaggagtcgcggctgttgtcgtccggggcggaggcgcgggggagggaggcgggggatggcggcgaggaggaggaggagtggccgtacaggccgccgtcaacgtgctgcgaggcggcggcggtggccgcgcgcacggcgcggcgcacgtgggacctcaccgtcgggcgctggggcctccacggcatcgccttcgggatcaagcgccacatgaagcgccaggtccgcgagatttttcgcatttcacctcgtgattcctcgctcttgtgcgcgattactgcgatgctgccagtattcagttcttctgttcgtttctgtgtctgcgctttgcgtttcttacttgcaaattgaggatcatttcgctcgatggctttaacgatagcgactgatcacgatgttctaactgcgctcaaatcgcactgagcggcggaacgtgtagttgctttgcttcgagtggactttttcttcgttttagttttactcttgctgaaaattttggtgtaaaaggcaggatttatgactatttcaaggtttgacttgatttgacttgcaagtaagactgcttttgcctttttatttgggaaataaaggctcaatgttgggtcagtggcttacaatagcttcacctctaccactaattcaatacattcctcgtacttgcaatgtcagatcatacttaaattctgtgcgggacttaagatcgttgatgtaaatatgggtaaatctcatggatccgtaaggtcggattcatggattttttcagagtcaagctggtcatggtggtcaaggtctcctctagatgttgatctgaagtgagaaacgtttccaactgttctgaacttctgataaccaatcgatatgcgttttatacagagctggttattttgttgcgcatgtgtgaatttgctagaagaacaactaataaaattggaccagaattctgttgtcttgctaaaactaaaatggttgctcaaagaagaggaaacaggacgcactcaacattcagttcaatataatgtactctgtttatctgcagatgttctttgcaaagctattcaatgcatcaaaactcaataagatgtacttcccgtgagtgaagagaagctggctatccgatgttctgatgaatcagcataactagcattttgttctttaagacgtaaattcggcggtagtagattgtttgctgaagcaattcagttatgcagattataatcagcttggttctgtatagctgtcttgaacatattacatagtcaatggtgtggaatcatattgtgactgtattttttcctgtttgtgtgctctagggtgatttgcagcatgagtatagtggaaatgattgccttcaactaaaaggtcacgacgcacacactgaagtagcttatctacttgagcacttgaagatttgcatgttctactcaaagaaaacattttcagcgtttcttcagtttggtgggtacaatcaagaagacattcttattcacaaggctagggcgagggtgagtaagtatcactgtattcctcttatctcatgcttaaggtactcacatttacaatttgtatttgttcctccacattttgactcactcttaactatcaacttgatgcagcttatgcaaccttctttcgcgcttgtgtgtgacaaaaaatccaagtgctttctgcttttcattcggggtgctatcagtactaaggagcgcctaacagccgcaactgctgctgaggttccttttcaccatatagttttaagtgaaggacaaatcagcaacgtggttttaggatatgcacattgtgggatgcttgctgcagctcgttggattgctaaccttgccaagccccatcttcacaaggcagtacaagaattccctgattatcaaataaaggtatttcttattagtgctatgcatggatgaagtgactacaatttataggtgtagccgctgcagtgcgctgtgatctatatacatgaccttatttgaaataatttgtttttgataaatatcactgagacagttaagaagcgtaatcagatctctccttttgtcttttatgtcatgtttatttttgtgaagatttctgacccaaattatgtctccttatttgtcatttgtactaggtcattgggcattcaatgggagcaggtatcggagcaattctgacatacattcttcatgagcatcatgagttctcatcgtgcacgtgtctggcatttgctcctcgtaagtgacttattcatgatttacatctttaaagccacactttgcttagtttttgcattgtgccttcgagatattatatggctttatgattatcaggtgttttcttatattattttcctgagttgtaactttgttctgtttcagtacttaatgggtgacaaaagttgttttggcactatgttctcatgatctcatccatgccaactgtttggttgaacgttcttgtgtacaatttgcattattggacagtgatggagaattagccattgttttatacagatatgatagaattgcattgacttgcaagatttattttattaggctacaagttaatccaggaactgagacagttatactattttctagatttaagagaggaaatgctttcagatttttaaagggttcctgttttgtatagctgcctgtatgtcatgggagctggcggagtcgggcaaagaatttgtcacttctctcatcaacagaaatgatgtggtcccggccttttcaaaagtttctgctgagaacctgcgagctgaggtactctgaatttctgatggccagtgtcttatgtgtcagcataataaaatcagaccttcactagtatgaacttcttttgtaattaacaaggaaacattttaagaacttagcaaagtgttaatacattaatttcttgtgatatttcaagaaatatgtgatgcaatggagatcttagcttcaaacttgaaatgttaacctcattggcatactggacagtggccatataaaatttctgataaattgtgaaaacgaccatatacctgattcccaacagtgttctatcatcactgatttttttgtctctactgcaggtaatggtatcatcaaagctagatgatgagcaggatcaagctcactttagcttatttacggcaataagtaagcgtgtagctttcataaagtctcatatgctgtcagtatctcatccaacagagaagaacacagatcctgattctagcatatctgaggtaatacctcttaggcactttaatttctactatttaaatgattgcttctgtcacttgtcactggatcctaaactagcacaatgataattttgcgtccttaagccacatgtgaacccagcacgagtattaatttgattacccagcggttttaatgactgttaacagctgatccagcgatcctttctagcatccaatcccaatcaacaccgataacactgtggcgggcatgctaatattatctgttagtatactaggtagtaggcatatctttggtacggatgattttccttccattggccatacaagcatcacatctattacaaaagggcaaaatgagaatttccatcatgcacagttcctgcttctccgtgcagtgtaccttccaaaaatttacagaagcaaagtaactcttgggtttactgattagtgccaacgtgagtacagaagcaaagcaacgagaggattgacgattttctgacaccctatttattctgtcaatgcagcccttgctcaaacatgtccccgaaatcacgcagcctgtaacaaatgggctaagcacagactgcaaccagcatcaaacggacctcgttgctaatacagagcaggacttttcagctgtatcagttgttacctctgaagaaaagattgtactatctagcaacgataatgttatcagtacaaagtctgttgctggatcaggctttgcagcacaaggggatgtgaacatcaatggatcactggacactgaacaagaacaatcatccttgacagggcaggaggaaccagaatcactgaagcagaactgtgatatcaaagacaagctgaaagaaccgctaccaacctgcagttcgcgccagtttttccctcctggaagaattattcacatggttgcaatggcctcacctgacccaaatcctggtgagggatccagcagcaatgagatcattagcatttatgaaacgccaagagatttgtatgggaaaataaggctagctccaaacatgataaaggagcattacatgcctagttacataagcacaatggaatcattattggaacagctgctcaaagacgataatgtagatacaataacaaatgatttgtaaattatgtaaaaactcaataaattattaatccaattctttgcaaattgcattgttctaaaacaatttccatatgcctgcatgttatttctgtcccaatgctactctgtatatataccactaaagctaaatttgcatggtcaaagttggaaccattccgttgaccggatgacgtggacatcctccgtacggttggtctctcatgcatgcagctgtaaatcctctcggcctcacgctctatatcatcactttcaagtgttttcatgaaaacgaaaatttagctcgccatcacgcagatcgacatggctgctgcttctctccgtctggtcgtcgtcgccgccgccgtcgcgatctccctccggggcgccgccgccacggcggtgaccgtggaggacgcgtgccggcacacgaggcacgaggcgtactgcgtgaaggcgctgtcggcgaggccggagagcagggcggcggcgttggacatgccggcgctggcggaggcggcgctgtcgatggcggcggagagcggggcggcggcgacgtcgttcgtgaggaacctggcgaagatgcccggcggcatgccgccggagtgcctggaagggtgcgtggcgaagttccaggaggcggtggcggagctgaggcggtccgaggcggcgatggaggtgcgccatgacgccgccggcgccaaggcgtgggtgacggaggccagggcggacggcgagacgtgcatggacgagtgccggatgacggagggcggcgccgccccggagatcgccgacaggatcgacgagctcgccaagctctgctccatcgccctcgccctcaccaatgcgtccatgagcaaacatccgtagcaaatcatcgtgtataacaaaaacgagatttggagggggagacctctatccaaacatttattaaaaagaaattatgagcgtgttaaagattgaacacgagatctcggaatcgggattgaaaccatataccctttaccactgtactatcatgtgcatttcatgtatcctcgtgtatatatacgaccaccaaattctctcttgttatattcatgacttgagcacgtctcattgcaacgtttcaaatttccaacaaaatttatgttggacacatcaggctatgtaaatctgccaaatttcaatttcaagagtaaatattgtatttatcatgcattagcttgtgaaatagatggtatcacctatcacgtaacagaccaaacgggctaaaaccggtgacgaatgtggtacgattcgattggtttggaattttggatgctgagtgagattcacaaaaggccagaaagggctgagtacttagaatcatcatttttacagttttcacacaaaatcaatttaaatcctacaaaaactatcccaaaatcctataatccagatgagccgaatattcttggatgggccgtggagactattgcagcccacagtcgcccgtcccactttcggaataagttcatctgaggtccataaacttgtcaacgaatccgattttagtccttaaccccaaaaccagatacaacgggtccctcaactatcaaaactggtacagataaggtccttctgtggtttagatggcagttttggctgacaaggcgcctgcgtggctattttgactcggtcttcatcggacatggcactgacgtgacgcttatgtggcaattcgatatagaaaaataataaaacccgtgggacccacatgtcagttacacaaaaaataattaaaaaatagtggggcccacgtgagccccacatgtcatcctcaccctacccttcttcctcatctctccctatctcccctctcctctctttccacgcgccattggacggggaggttcggcggccggtggcggcggcagcgacgcaagagaaggggcggccggctgggttcctcaagggcgacgacaacctggacgacgacgacgacgactgcggtggcgggagcgttgggtgaagggggcggagcggggcggccggcgcacgcctattaacagtgaaatttggtaatcggcaaagacgtcatcggcttagaatcattatctgctgcagcatctcggaatcagccgatgggagttatcaagtcgccaatagtcggattcctgctatattcggttaaggaaatcaatctactaaaggatacttatccctaagtgaccgagtttaaagaggatgcggcatggcagtttatctattaattaggaatagtttgttagtttccttttatctttaggaaagtgtgtccgataaggactttatattttccttttatctttaggttagtttctttcttgtccgacaagggcttgtatcaacccatgggtataaatatgtacacccggggtctatgtaatctatctccacgatcgatacaattcggcgcatcgccaccccttttaccttttctactttattttatcgtctggcgggacttggcacccgacgcggggctgcatcggtgttcgatctccggcttcgatctccggcgaaggggtaagtccaatgtttcgccggtccaggcaattgtatcatttatgtcggcgtcgttcaaggctgcactagtacattcgacctcttggattgctctggtttggatgatatatttgcctacctatttatcatatgtctctgttaatctagtcttagcatatcaatttagctctatcggctgcttctcgttttagggtttttgccggtattagctaaatcgtgtttctagattagattagcttagacatctaccaccctgaaaactcagtcaacggcttgattgtctagatataatgtttcttttcatacttagtgctgcatcagttaagtttgatctactaagtcgtgcttagaaccataatctctagcctgcttcttgattgccaataagggtatcatcggggttttagccggtgagttatctggacgttgcatcggctcataaggattgtatatacatataagttggatttagcgatgacaacaaaggtttcactgtttaatctaatcttgtggatttcatgacatcggacctccagccgatgtgtgctttaaacctcggatcgatgcttatttatcatatcattgctagccgattggtttataccggattatattgcaatattatattatcatcagccgattgcctttatatcatcatctacattggacatatagccgatttatcaaaaccctatcgctatcggctggtatcggcatcggctattatcgactatcggctggaactactctatcggcttgtcagccgatcggttgttttgatctactatttgcatatcttgtcagttgcaggatcaaactgactggcacgcccgcatctcaccaacctttggacctgcacaggagttaagcagatctcctaggccggtgtgttcgattttttcgtcaacaacgccggattcctcaagggtggcgacgacctggacgacgacgacgacaactgcggcggcatggaagcccacgtgatcctcccatgaggaacccgcgcgtgcgccggccgccccttctcttgcgccctccccttctcttgtgccgccgccaccgctgtgccgccggccgccgaacctccccgttccgtggcacttggagagacaggagaggggagagagatgaagagcggggagatagggagagatgaggaagaaggatagggtgaggatgacacgtgggccccaccattttctaattatttttttgtgtaactaacatgtgggtcccacaggttttattatttttctggatcgaattgccacgtaagcgccacgtcagtgccacatccgatgaagatcgagtcaaaaatagctacgtaggcgccacgttagtcaaaaccgccatctaaaccgccgatggaccttatctgcaccggtttttatagtcgagggacccgttgtatctggttttggggttcaaggacgaaaattggattcgttgacaagttcagggacctcagatgaacttattcccccactttttcgatccccctggcatattcggcccaagataacccgatacaaaaaaagcccaagagtgtgtgtgtgtgtgagagagagagtgagtctgatttgcttcctccgcgaaccggtcgtcttctccagcgagacagccgccgcagaaatgggtgggagtcagctcagcctcaactcacttccgctaattcgctgcatgcaagctctcccacgtccatggcggatcccgcccgcgcatctctcgccatggcagcattagcacgcctcgctcacaaaacgctcccgaccacacgaacccaactcccgctccccaccaccatatatcgctcgccgcggtgcctccacccatgatcctccatcgacgacaatggcggcgacacgcggctccgtgcggctcctcctcctgatcctcctcctccgccccgccgcggcggggagcccactgatgatgacgtgcgccaagacgccgcacccggacgtgtgcatcaccgtgctgggcgccatcccggagtgcaggaacaccggcgacccgcgcgtcctcgccgagaacgccgtccgctccgccgccaccatcggcgcggcggcgggcacgttcgcgcgcgcggagctcgacatcgtgaaggacaccgacatgtggcagtgcctggacgagtgcgcgcaggacatcgaggaggccgtctcccacctcgacgacaccgagggcggcgtcgtcgacctcgacgccaagttcaaggacgtgcggctgttcatggacgtcgccgagagggacacgtggtcgtgcgaggagagctgccgggacgcgccggactccaccgtcaaggccaccctgctcgacaagaacgaggcgttcgagaagttcatgcgggtcaccggcgcgctcatcgagatggtcatcggaacggccggcgagccggcgccggagccgtcagctgatgaacactcggacgaactaataccggatgtccagttatgatcaattcataatgtactaatcgctcatgtgacttctcatctccatttttgatcgatcgtgttcaggtattttgattaggttaattaagggcccgttcaatttgacgtcattttcaaccataccattttttttaaagttgtcaaaaaaatgtctacgtttagtttgctactaaatttgataaatatataagaaatcctgccaaaatttggacaacattatcatcttgccaaaattttgatattgccaaaatttggtaagatttattttggctacaatctgaacaggcactaattaattaattagctcttctaattcgttgaatgttttgtttaaccatcaataaagtggttgattcgttcattagctaactaataaatcatcagattataatctttctttgtcatatatgcatctctctctctcccctctctaagcttgagtattctatagtgtcacct

SEQ ID NO: 41683 - DNA, 12269 bp, Oryza sativa
  unsure (1)..(12269): unsure at all n locations
nnnnnnnnnnnnnnnnnnnnnnnnnnnnnnnnnnnnnnnnnnnnnnnnnnnnnnnnnnnnnnnnnnnnnnnnngcatatcattagctcaagtaaccaagcaacaccatataatggagtagttaaaagagatgctgcaaagttcagagaatatgaaaatccatggacctgaagctgtcgactgataatgtgaccaaaattcagaaactggttagctaactgaactgcaagcaaatgcgttcagcacagtggtggaccaaaattcacgatgatcgaccaatttttacatatatcagccttcaatcatgagttcgatcgctgttcacctacctgaattttcaccgattatcatgcttggttttgcatcctgaaaccagaggctgcaaaaagaatgtaatgcacatcagttagcagtagctgtcccattccagatacacgagcagtcaacagcaacagatttcggtgtcaggtctcacgttcagacccacggcgtctacacgatttcaagaatggctgcaatggcatgtcaggttgggtggtgaaagcgagataaagagatgccattacatgcatgatcaacaagatgattatgatgcccctgcttacagaatgattacaaagttgtgaaggagaatcactgggtcgtacgatgctttgagagccctgtgatcttcctctttctggtgcaggaaaggaacttgtgttgttcatagacacatcattttcgtgatatactctgcaatttgcagcatgtgacatttttgcatacatgtggacatggttcctgctgaaaaatggaaaaatgccaaaccatttggttatcagtttgagatttttttttttcatcgatgtgaattgtgaactactaattgagagttgctgcttcaggctcaacctcaacaaccagcagccatgaggattgacgctggcaacctaaacgagatttggagggagagacatccctcaaaacatttttaagaagaaattatgagtgtattggggattgaacacgggatctcggggttaaaactatacacctcttgctactacactatcaggtacatctcttatcctggcaacctcaggaactgttgctaacaatcataaactagctgcagattggcgccgttaattttcatctccaaattccatttgagctggccgaaatagcatataaacaaggtgttgcaccacatgtaatgagtaattgtgtaattgcacttgcaacctcgtatggaaccatgtactggagattaattgcatgttatcgccaacggattgttaaacgtaaattaatgtcgatcaaaatgcagtatgcttttctcagtctatatataacagttaaagtatggccttaagagttggaattgttgtgtataaatacaccttgaggcagatctggctgggttgattagttagcatggtaattagccaccggacttcgcattggctagtcatatccttgaatggcgtatactctatgttgatatacagacactcgatctgtgtgagatgccgggtttgtgacagcctatgaaacgccaaaggatgaaaaatataagtcaaagtggttatcatgccaagtgagccagaacttatagacgaccaaagcattaatctttacttttcaaacggttgctgttcttcaattaggccggtaagaataaatagattagtttgacctttggtaagacacattgaggcatggatcgtttgttcttgcccaatgaaaggaaccaacgattttgataattgtcacatggatcatggatgcagggcgccggtcttggttgaattttgcaactggaaatcctcctcattctgctgagatcttatacatttaaaaataataccgtggacctgctgaaaagttgttgtttgcctatgtatcctactacaactctagaacacaaccgttaaatttccgtataattaatttcgattaatcatttggcgggacctttttgtccgacaaccgtattccgtttcccacgtcgacactgaataagagttcatttaaacccaatcatagagaacaccccaaagaccccaagcatataaaacttagaggacaaaattcccctctaaaaactctcatcggccaaataatgcactacgagtgtcatgtgccaaacgcactagaccactagcggagtgtcatatggtaaaaacatgctttcaaatatcctaccacaagtgccacataaatatatgctccctccgtcctaaaatataggaatttagaatcagatgagatgtttgtccatatatattgtactagcaaacgtgttccaggttcttatattttgggacggaggtggtatatcacaggccatgtcaatcacataagagtttcttccatataggccctgttcttttctccaacaagagttggataaagattaagattttctccaacaagagttggataaaaattaagattttcgtggcacgttttttaaactgctaaacggtatgtttcgtgcgaaaactttctatatgaaagttgctctaaaatatcatattaatctatttttcaagtttttaataattaaaactcaataaatcatacgttaataccacctcattttacgtaaaatacttaatctttatcttcatcttcatcttcaagagaaaagaacaccaccatgttcttacactggactacgtataccatcaaatctttcaggagggctcttgcagcgatcatacggtaaagtactcagctgcgaggggcttaattaagcttctcttgtgatgaccaatagatctgcacattagataaacataagatttttcattcacgtacggtgttaagtttgcacagatatataagtcatgaaataataagctcacctgcagtgtgccggtgatcagcaaacatactgatcatctctgcgtctatctccctcgtcttcgtacatgcgcctgcgtcttaaaagcaaatgagtatacttcgaaacagggttcaaattgtcgttttcaggttatactggaattaaatttcggcctgaaataatttaaaatttgatcaaaatttagtcaaatctgaacaaatacacaaaaaaaaattgaaaagaaatccaaaaattccgggcgaaatcatttcatatctatagacccgaaattctgaaccctgtttagaactccatcctatagatcgatcaaggtagttaagctagcttgcacagcgatgaggcggcgatcgaggagagaacgggacgtcggtcaccagcagcggtggaggagcttgcacgctggtgctgctgctccggggagtagaggccgtagcggcgagtgtcgccggcgtgggggcggcggcggcgcgggtgggaggtcggggacgaacatggcggtctagggttttaattttgttttggaatggggaatcgagaggttgacgacgtggggtggttggagttggagtaggagggggaacgcgaggtcgcgaaatatgggccgggccgggcccatctcctcctcctatatggattccgaatgggccttccagaatacaaatggatctggtggaaggcccagcacagcaccaaaatagaacacattgaccttttttttctctctttttggcaaaaacattgactttgttggagttatggagtactatcatgttttgtcagattttaaattgggctcaaaatatttcaacttcgctcaaaaagaaaacggaacaggctataggcataggatggagcgtagtttgggccacaccgcaactcccctctttaagttagatttaggagttaaaactctactaaatgcactcttaaattagactttaatcgcacatatacgtactagcatatagtgcctagctagctactcgaggtttggtttattttgggacgaatggcgtatatctagatttataatactattatgtgtcacatttcgtacgaggttgatttattttaaaaccatgggtgtaatatgcccagtaaagccaccacggctcgcccataactccatattctttatgaccggcctctgctatgataaacataatctagaggttcacctcaagatttggcttcatacagcatatccgggcatttgagatactctcttcggtttttaatagatgacactattaacttttgaacacatgtttgattattcgttttatttaaaaattttatacaaatatataagatactctctccgttttagattataagttgttttaactttggtaaaggcaaattagtttaaatttgaccaagtttgtagaaaaagttaattaaattttcatctcaagaaaaaatattatgaaaacatatttaataaaactaatttagtgttgtaaatattactatatttgtctacaaacttgatcaaacatgaagtagtttaagtttaaccaaagtcaaaataacttataatatgaaataaagggagcataaatcatgcttaaattactttgaatgataaaacaactcacaacaaaaaaaatataattacgtaaattttcttaaataaaacgaatagtcaaacatgtgacaaaataacaacgacatcatctattaaaaaaaatacttcagtacctttatataattatacaaaagttttaaattagtaaatgatcaaatgatttacaaaaaatctaacatcaacgtttattttaaaaggagtagtactctatagtagagcaagttcgatagtatagctaactgctaagtctaaattatctatagttaatttaatagttaatatatatagtagttacctacaaatatatacttatagtgtactgatacatggtctgatacttggggctcatagctagcgcgtgcgcgcggctagcaagcacctccccttaagactttaactacatctattaatttattagttaatatttaacactaatgatactagtagtaattagaaaagattctgaagatttttaagagatttttttactaacagattgaaaatttaattttttaagttagatttgaaaacttttgatttaagtttcaaattttaaagtcaaattttgaaaactttcaaaatccagatttgaaaaatttgaaaacttttaacttgagatttaaaaattttcaactcgagatttaaaaactttcaacttaagattcgaaaactttcaagtctagatttgaaaattttgaaaactttcaacttgagatttgaaaattttcaactcgagatttgaaaactttcaactcgatattcgaaaactttcaagtccagatttgaaaattttgaaaactttcaactaagattcgaaaattttcactcgagaattgaaattttcaaggctagatttgaaaattttcaagtcaatatttaaaaactttcaactcaaaacatttgaaaaaagcacatttgctattggctaggaaatagtggggatggtggatgcatcgagtttgttgctagagtaaatatagtatgagagagttattagcttttcttggtcttagtgtacctatgaaatatatagatcaatttggaatggagggagtacttaggtgcagaaggaaatgatataacttttccccccagattttctgttacttcatgttttaggtataccaatatttttgtgtacttggttgatctgtgcactagcatataacaattatccggccatcaaaatggatgaattttccatttcatcatgtgaaagacataataactggaaccttatcaaagacatatacttattagttattgcatgaggtagttaacagaattgattgctttcattccccagctttcactggtgatgaacttcaacttcttgtatataatctttttgatgctgcagttcatgtgatgtactgatttccttctggtcattgaattactatcatattgtattgttttctttaacggggaacagaaagggataccctttctgaaatcatgctgctgttattgaaccctgtgttccttattacaggtaaaagacagcatgtcatgaggactttccaaggtcataaccccaacactatgaaagttcattctcgcaagtctcaaccttcaaaaaagaagcctcgcgagttctatgacactgttgaggtacacattattgatgatgacagtgatggtgatgcgaatatccacaaggattactcaatggaagacacatcaaagcaccttgtcatgtacaatcctgagatcacgtatgacaaacaaggggaagttgaagttactgagcctatagataactatacttcgctgaaccaaagatacatgaagccaagacacggatataacactgttttaccatctatcggtgcttacaccgtgcaatgtgctcactgcttcaaatggaggatcatcccaacaaaagagaaatatgaagagatacgtgagaatatttgtcaggatgtgtttgtatgtgaaagagctcgtgaatggaaccgtgttatatcttgcgttgatcctgaagatatatcacaggatggaagtagggtgtgggcgattgacaaggcaagcatttcccagactcctcctggctgggatagagaggtcagaatcagaggagagggttgcagcaagtttgcagatgtgtatgtcactgtttcctttcctggatttgcagtagtacgtgatatttggtaccatatttttggccgtttccatattcggatatcaaacttctttctttatgtgcctaatagcatcttcatgttaatcgtggcacactggtcctgtttatttatgccttgactagctgctaactgctaagattagttaacactttctaaataattagtgcgatctcaagtttattcatactagtaccacctatgatcatgaaacttctacagttttcagttaatactttgtaacaccatagcaaatatctcactaattccttatgatatgcctgcttgaataatgcaaacagccattattatgtttgccagtttcctcaggaactttttcattatatgatatttcgaacagcaacattgcttgtaggacacacaagatactcgaggttgacatatgtgaaatacttttcttttttccttcaggtactacacttctccaactgggaagaagttgaggtcattggtagaagttgggaggtgggattcatccatttgtgctctttttgttgcatattttgtgtggctagtgtattacttggggtacctagttctagttggtctggtacaacaaaacgaagctctggaaaagctctggaaagttcttgaaatatttcccaggaaatgatgtaattattatgtccatattctaggtacttggcagagaacccacactacattaggcaaggggttaacttaacccagttctctttcgccacccccaagcctctgcaagaagactatgtcaggaagcatacatatgcagcaactcctgaattaccagagcttcttgagactgcgcaaggtgtgttatcagtcctaggtttgttacatctattctacttttttttcatttttaacttcttgttccccacattgttggaaaggaggcgtgcttcaaacaaggtaagttgctgcgcaaatggcacagttggaggtatctttgcaatgcaagcatgtctagttattttcagtcaaatgagctgtgagaagtcatgtactcatgatgcccttgcattttgctactttacatcctttcttgatcttagcaccatctaaatatcatttagtgttgtgatattaactgaatatattttcccccagtttcatcccatagctatatcctgtcaaaactacctgttcttgggagcttttgctgatatatttgttattgagtatacattgttatttttcagtggatccactctgctgggcagcaccccctacacgcagcgaactgcttggtgagcttggtgcttcaacctcaagatctgttgatgtcagccagtctgaggtgtcataccctgtagacttgcaccagcccgaggagtctgcgccactacctccacgcacaaagaagaaaactatgaaacgagggcgagtgtcagcaacggggtctcaatcgactccacctggttcatccaaagatcagtctggaggatgcgtaagcgacgtcgagtttgtttcgctgtgaactctggatgcagtgcctttgtctctgtcagtctgccttttggttcgtctcattgtctatacctctcaagaaacataaacttcgacctatatgcccaatgttttgggtttgatcagatgcgctaagcatcgaattttggtaatctaactacgtcttaacatggccatgacataggctgtagcatccacataactaggtagccagcactagtctgatagacttggcagaatatgttagccagcattagtctgatagacttggcagaatattttccatggacagcctgctacatatgttgatatggtagttgtactggtattgtaacatggaagtctggagtagacagacagtgttatcagtgtaccagatgttttatgcttcgtttttctgtctcttgtctttggatgctttgtgttgatgctcgattaaccagtcagatacttaaggattcatattcaggaaatcctgacactgaaaatctgcttatccagaaaactgaaagaagagctacgcatgagtatgtgccaagaacattttgtatttgcaagggcctgtgaatggaaccatgttttatcatgtgattacccagaagaaaatgtcaaaagatgaaagcagtgaagttcctccgacaatgtcactaggcttacactgaaatgccatgtttgaaaatttagcatcatcaggtccaattaacccaaattctagaatcaggcaaatggttcactgaagacagcagagtgaacccaatggcgtgcctcagtcacaatcgatgccgggagaagctcctcaacaacaccatcaaccagattgtgtgcatatacatttgtgatggatttctctatcaaacctcgtggattgaaaggagccatcttcctcttctttccgtttccaagatcgatcgttctgctctcaccccacagccggtcagggcagaacgtgtacactttcctcccacctttctcctcccttaaacgggaggatctaccacggcagaggaaccagctgaacccatccagatcgccggcgtccaatggcgacggcgccattgctatatccagcttgaagaacttgaactcgcagaactgatcatcgtgacggcgacatgagactaggatgacctcctcttcttcctcttcctcgccaccgccttcgccagaggcggtgacgaggaagtgatcctcttgccagttccaccccggcgagggcaccggcgtcctccaggccgtctccgtcatgtcgaacacggagatcctcccacggtagtcggcgcagaccacctgcttcccgcgcaacgccgcgtccacgatgaatgtgaacgcggcgcggcgccgcccgtggcgagcttgctgcgggggggaggtgttcgtgttcttgtaggttgtccagtacacgtcgccggggcaggatggtgggataatcggaggccgtctcgacgcaggccaccaccagtggctccccatgggagttgatgtggaagacgaagaggccaccggcgacggagcggaacaccggcaggtccacccgccggccgttgccggcgtggacaggaagacggttcgcagtgttttctctcgccgggggctatggcggtagttctggaccatgagcagccacccgcggttctcgaacgccaatgtcgcggcgtccaggaagaaggcggccatgtcggttgctccacgggtctgcttggtggatggatcgaacaggaaacatttgttgctgttgcattccagagttaacaatgccaatggtagcttggattgcttggaacaagaagtggtacttgttggagaagcatctggctccatggtgaatcttaattggtactagctagttcctccagatctgagataagcaaagggcagaggttgatcatttggtacaatgaaaactctacttatattacatacagtgtaatactatatccaaatctgtgagatataagcaaagaacaaagattgataatttggtacaattagagtagtgcttatattatacaaatgtaatactacatggcacactatctagcatctaccatcctgtgcagccaagttgtagcatgctaatagatagagtccagaataatgtaatttaaccattggtttacataacttgcaatgcaatgctattatggtcacaaatagtgagtggtgaataggtttctttaacaatgggttcgaatcctactaatgcttcctaattccaaaatacttactattagctaccaaatcccacttatgttcagagcgaaagggcacgtagagtagcactccaaagtcctaagtgcaaatctccataggagtaaattttagattggattatttgaggggctaagttttcgatttaaaaatatcacatatatctggttggatatagataccgggtaaaaaacagacaaaagaatatcacgcgccctaactacatcaccaatcatgggggatcgaggccaagaggacaattaattaatctacacagcgcatgcagagcaaataatcgaccaccggatcaagagagagacctaaccctaatactcgcgcttggcacaagggatcgatcgagggaagttcacctcggagaagagaagcgaggcgaagcgaatgaggattccggcgggggcgcggcgccggcggcaaggcggagggagcgatgaggatcggaggagtcgctctcgctcgccgattcggtgatgcttcccgtggaagtagggatgcaaattgggaagaagaagaagaagagaccgaggcggactggtttcgtttgggccgggccgaaagtgacgcgaccatgtccgtattccaaagttttttaatggacctgacctgactggcttggattagaatttggaaacttttgtttgcctagtaccctatcctttcatattattagttgttttgattttttttattttaagtttgatcaagtttattagcagcatttaaaacaccaaattagtttcattaaatgtaataaggattatatttttaatacgactaaaaaaatattcgtatgttgcaacaggtaaatgctattttgatattataattgttatacggtttaggtaagctaaaattcactgtgttaattcgcttgaatatttttttaaggaaatcatgagctgcaattaggagtctgtatttcatctcaagttagcatgagtttttttaaagagatttcttatacgactccttttatatttctaactcaaacacggatttgtatttccaaaagcgaatgaacttaaaaaccgactcaaacacgaataacgtaccaaaataccggcaaaaatatcttcaatttttataatagtagagatagagatttattttatgttgaaaatgctgctatgtttatctataagtttgaccaaacttaaataagtttgattaaaaaataattaaaatgacttgtaatatgaaacggagggagtgctagacatgggggtgacaaatttgcctctaatatgtattggactacgaattcagccaaacacggattttttttttgaatcaagtcagatatgaatggcttggatttctttttgtctgttatttgaataaggatagcgtatgcggacatattttggatgtattcacaatatagatcaactaacaaaaacatcagacattctaaagaaaaggtcttcatgtacttctactgttactccatcaatgcataaaacttcaaaattaaattcatttcattttagcggtaataaaaaaggaaaaatcagaaattgcaaaatcttctattgcctgctgctctttgtgtaatgaatccaaacttgaaattttttacttaaatggaggatgagtacatgtagattttttttttaaaaaaaaactgtgatattgtttagctactgtgtaccaatggacaataatcttgtgtgcacaagatatattcccaaagaatagataaaatatgcatgtggcagccagctaacatgggtttgaattaccagcaattcttacccaactgataaatccattttggatggcatcaagatgaattgtcatagttactctgataagtcggaggacatatccggtgaaaagagctaagtgttgaaaactcatgaaaatcatacctaaaagtttcgtaaattcatgaaaaaaatactagagagaggtgcagatataaaatacattctcaccaaatctcaactccaaactcaacttcgtttaagaggaaaaaa

SEQ ID NO: 41684 - DNA, 2069 bp, Oryza sativa
tatgtccctaataagtcggggcatttgcaattggaaagagggaaagaaacaatatgaagagaggaccccagcagttgagtgaaatccgacaggccatcccaaaatcttagttaattttctcaagataattatatttataagagaatatccctaaaatatacgctatactactcagtcatggttgagctagattaccaaggtcgaccttaatcaagctcgaacgaagcctactcaaaagctcgggggtgaaatagactcgtgtcgagtttcaacaaacgagctcgctcaagctcggctcgttaacgtccctaaattcagccatattttaaggtttgacatttaaaggttcacactaacattctagtaagagagaggattagagccgaatgggcctaaatgaaccgagcaagccagcaaagactttaggaataagttcactttgactcccttaaaagtgacccaaatctaatccgtgaccctcaaccacaaaactagatatctttgaccccctaaattgttaaaaccggtgcaagttgactccctgggtggttttggagagtggtttcactgacgtggcgattatgtggtggtgttgacttcgtcttcttccaacgtggtgttgactagcacttatatggcattagaattaaaaaaatatatgcgggacccatttttcattcaccaaaataaatattatgggccccactaacatgtggaccccacatgttagtctctctttgaccccttcttcctccctctctccccctctctcctcgggagggacgcgccgtcgcagccgtgggcggtgaaggcagctgcagactcaacgctggcactcacggtgagggggcagttgaggcggagccgcaccatcctgctgcggcaccagtgggatgacgacagggagcggcgctgatgaggctgccgacggcaagcttcgtggctagtgagttgggaggaggaaggagagcctagagcagggggcggcatcctcctcgctcgtcgctccgccccacttcggtcgatgggagaggagtcggaggcgacgacttcggcggagaggtcgtcagcgacgctgacgtagccttaggagcagcaggtgcactagcctacccctagtcaccgtcgtccccatcacagccggcctcgccgccctagagctccctcaccaagcttcatcgcgctgccgcctctgtctctctctctctctttctctctctctctcaccacccctccatctcttccccccgatccccaatcctgcggcggcggcggatacccctacctgccggcgcgctgagaggggagctacacgaggtggtgttggaggaggaggagaaggaggagagctccaccgccttcgtcgagtcccgttttgtcctgccgacgaagctgggtccgagcctcggcgtgcccgtcgcctccttgggattctctgtcagcacgggcgacgtcgactccgacaatggagagaaccggagcagcagcagcagcagccagcaggccctccaccgccgcgagcgctccgtgccgccatgactcctcacccttcgtcgcggcgacaggcggtgatgcggtccaaggggagagaaagagtcagagagagaagtgagagagtgagaaggaaggagtgaggataggatgacaagtgggtcccatgtgttagtgggcccacattttctttgtgtgtgtgtggatgacaaatggacccacattatgtttttaactctaatgccacctaagcgccacatcaacgccacagacaagtcaacactgccacgtagacgccacgtgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaaatcactaaagtgcaattgttaattccagggaaaatcctttttccttttctttttcttttt

SEQ ID NO: 41685 - DNA, 9365 bp, Oryza sativa
cgatgtttgccaacgagtgaaagcagagcaccaaagaccagcaggtttactccaacctcttcaaatcccggaatggaaatgggaggagattggaatggactttataacaggactgccccggacatcatcgggtcacgattcaatttgggtagtcgtggatcgactcactaaggttgctcacttcataccagtacataccacgtatacgggcaaaaggttggcggagctctacctctcgagaatcatgtgtctacatggggtacccaaaaagattgtatctgatcgagggagtcagttcacttcaaagttctggcagaaactacaagaagaattggggacccgtttaaatttcagcacggcctatcacccgcaaactgatggtcagacagagcgagtcaatcaaatcttggaagatatgttgagagcttgcgctcttgattttggtggagcttgggacaaaagcttaccatatgcggaattctcgtataacaacagctaccaggccagtctacagatggcaccgtttgaagctctatacggccggaagtgccgcacacctctcttctgggatcagacaggcgaacgtcagctgttcggaacagaagtattagcggaagcagaagagaaagtcagaatcatcagggagagattgaggattgctcagtctcgacagaagagctacgcggataaccgtcgaagggagctaacttttgaggccggagattacgtgtatcttcgtgtcaccccgctccggggagtacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcggaagaggaagcgacctgggaaagggaagatgagttgaaagccgcccatccgtacctcttcaccagctccaccgaatctcggggccgagattccgtttaaggggggtaggtttgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggttcccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatagatcccgatcgccatggtccatctctctctctctaatctctatcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctctagccgccgctctccgccgccgtcggtcgtcgctttgcgccgctgccgcatgtgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggtccggtcgccacgtggcgccgccgcccaaccttttcccgtgccgctgaccggtgggccgcgcgccgccaccctctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgaaatagtcgccgaggtacctccagcagcagagcaaggcaagtcatgcttgtcacttgaacatgttgatcctatattgcaaatgctccattgttttctttcaaatattgcattgttttataatatcactatgggatggatacctactgctacagccatgcttttggatatcatgctcctttgttagcttgggttataacatgattagactttggactaggacttgcttagccatgcttagttcaactagcacacattggggatctcatttaaaacctagactataggtttatatgataatgttggtttaataccaccgctctggtgttggttaaataaaatgaaccacatggtgggctgtgggtgcacggttttgctagtcgcacccatggcagttaaggaccggttcgcaggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttctccgaggagtaggcttcgtccgtgccgtcgaggatgcctgtggagtggtgttcccgctgccgttcaagtcaaggcttagctccagtttcttttgtttttccgctgcatttctgtcagacctttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaaaacctaagagccctctgaatcctttttcattgcatatgttcttcgcaattggatttgttccgggaaaatggggatctgttcttgtggttcaagggaaaaatcttggtcgctcgtttaaagtgagtttttcaaaacgagtcagtctagggttttagtaaattattgggatttattcgtcagtcagttgggatttgatgggtgaaatgcattcggtcctagctcggtatcatgggttgcaaggtatttatgctttgttcgttattattattatgtatctaatttcccattattttatcgttatgtgagtctgtcttatttattcgcgctcatgtaaaatgatctatgcataaaattttgctcttatttgattcctttatttgagtcctttattgctttatttaaatttggatttgagcatgcattgatcctactcctttgtcttctctagatggccggtcacccacccaaccaccgcggagaaggcatgatcgacttcgtggcagagctggcacgcatgacactggtagtgggctaccccgacgcgccggaatacacgaccattccgccgctcagtggcgagcttccttaccgtgtccgcttggaggtccatggctacgtggggacttgcctcgctaacatggcggtggaggcgtcaggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagcaccaggaggagtccggatccgcactacgccccgtaagaggacgactgcacccgtgcgcatccagcttgcgcccaggaacccacctccaccagcagctcccgcagcacctccagttccgcccgcagttcctgcagctccagcttcagctccagctccagctcccgcgttcactctttccttcgctccagcatcagccgccagaggtccagccagtggtaccggaggttggttgtccgctactcccagtggcagcggcgagactgatctgtcaggctccaggagtcgttcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagtcgacggtcgatatcatgtgcctatgatatggctgtcttaataaggatttttgcttgcctttttaagtgttttaattcagatcagaacaattgcagttttaattcctatataataaagcttagttcttgagcatctgtttttcttcttctcccccgtctgctttcccctccagatggtctacaccaggactggcaaccgcacgacaggcgagggcagcaacggtgaagaacgcgctgatggtgtgcaccccaacagtgattccggcaatggtccgccaccacttcccgagaatccgacccttgcccaagttatggcacatcaaactcagatgatggcagccatgatgcagcagatgcagcagcagcaccagcagatgcaccagaggatgatgcagcacgccgaacagcagcaccagcagtttggtccccctccccctcagtccaagttgccagaatttctacgcgtcaggccacccaccttctccagcaccaccaaccccatggaggcgaatgactggctccatgcaatagagaagaagctgaacctcctgcagtgtaatgatcaggagaaggtcgcttttgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaagagggaattccgggagctccatcagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgccaggaggatcaacgcaacaagatggataggaagaggaaggccgctcagttcagggcacatcagggaagtcaccagaggctgcgcttcactcccgggcagcagggtggacctaccaccatgatcgtccgtcagcaccgcccgttcaaccccagcaacttccaccagggctccagtggcagccagaatcaccatggaagtcagcccaaccgcggtacagctccacgcccaccgatggcaccggcacagtcaggcccgcccgcacaagccaagaaggagacgggagcaaagccagggtcctgcttcaactgtggcgagcttggccacttcgctgacaaatgcccgaagcccaggcgtgccgggccaaggtttatccaggctcgtgtcaaccacgcatctgcggaggaggcacaagcagcaccagaggttgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcaccgtttctagccaacctcatccttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacatcgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcccttaccgcgaatcgacgatttatttgatcaactgaaaggagctaaagtgttctctaagatagacctgcgatcaggctaccaccagttgagaacccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacattcttatctattcaaagtccgaggaagaacatgaacaacatctccgtctggtactcgagaagttgaaggagcaccagctatacgccaagttcagcaagtgtgacttctggttgacggaagtaaaatttctgggtcatgtcattacagctcagggtgtggcagtcgacccatcgaacgtggagtcagttaccaaatggaccccacctaagaccgtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggtgttgatcctgcccgaccagacgaaagacttccaagtctattgcgatgcctcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaagtacatcttcacccaaccggacctaaatctccgacaacgaagatggttggaactaatcaaagactacgacatgagtattcactaccacccgggtaaagccaatgtggtggcagacgctttaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtatcaagacctcaaagagaagttttggtgggtcagcatgaggagagaaatagctgaattcgtcgcactctgcgatgtttgccaa

SEQ ID NO: 41686 - DNA, 7373 bp, Oryza sativa
  unsure (1)..(7373): unsure at all n locations
tccaacttcttaaagtctgactaaatttatagaaaagatttagcaacatctacaacactgaattagttttattaaaactaatatttaatagagtttgataatatgtttgttttgggttagaaatgttgtaatgtttttctatatacttagtcaaacttaaaaatgtttgatcaaagaaaaaaaattcaaaatgacttaaagtatgaagtacaatattacaatttatttacactttttaaaccaaaagattacaagtgtcaagggaaatcggctacagagatcgtctcagtgatttcagtcagcagtactcccccaatctatttttgatggacatatttccaaatctaaaaaaattatttttgataagcatatttcaatccaacaatctatactcttaatgattttttcggatttaatgcgtgactctccattcttccacacaatattagctacatggacatcgagaaatgtaaatattaatgtcacttgtttacgagtagcacatttaaatagatgataattagaattacttattcttgatatgtgtgtaaagataaaatataactattaaaagtatatggagggagtagtacatcagcagagactaacacggtcaactgatcaaggcggtacaggcacacgtataaacgtctttctgacacggtggggtcggggtggggcccacgggtcagtgactcctggggttttcaaagtttcgcgaagccctctcggttccctctctttttatcctcttcgccgttgcgagctcgcccccctcctccgcctctcctcgccgccgcgttccacctctctctctctctctctctctctctctctcggagtcgagggttagggtttcagccatctgcggcgtctccggcgagcgagcgcgagggaggccggagcagaagccggccggggcgcgcgtcctggtcctccccgaggacgcggcggtttcgatcccctctctctcggggttgtccgcttcgccgtcgggagagaatccggccggagcgcgagcgtgaggtgcgcctcctccgccggcccgaggaagcatgctctcgatccctcgggttgttggaggaagcgcgcggcggcggcgctttcgatccatcgggttctcgatctcctttcgcagccgggcgggcgcggtgaatctgcgggtgagttgccttctttgcccccaactaatggagatgaaactctttcgcgatcaaattcctcttctttttcctggttcttgcgcgattgtgcgttcttgacaccttcttcttggatggatttttttgctcatgcgtatgcgttgcagggacggggaacgaacgagatcctacttccttgtagtgcgatggcgacggaaaattcttcccctgcttttacggacttcttgccccgtgcgctcagcccgattccgtttggtcggcgccattcgtgtgcgcgacatgtacgtgttctaattcacctcatcctctgcttctagttcttcccccaattgacggtttacctctgaatcttgtgattaggcatcatattttttttccgcccgatcaactgttagaaactattggattcctgactcctgaggtttattcctctagttactgatcaaataaatcgcactagtggttctttgatccatataatgccgtattttaacgaatttgtgtcattttgtcccaatacaaaagttagctctcatgtttaatggacttcgtccttctcaaaaaaatgtttaacgaacttcgtgcgtacttatcttttgtgttcttttcgttctgatgtatatgctgtatacttcagttgataaagtaagtcactatacaggaagtcaggaacatccttgtgtcaatgtagtttggatggctgtgttcttatcattttcaattatttacattaaatggttgctcagtaagatatttcaagcttggaatttaagtgcaattgtgatcccggccattattcacaaaggaaatcccgcatttagattgcagcctttctgtttcattatggatgcttgtcttacatgatttcttcatgttattggtcatgtactcatgtcgtctttcacatttagtcatgcattctttcacacaagagcagatgctttctctcaaactggaaaatgattcctagtgtcaatattgttctagttgaaaatttactcctcaacaaaactagggagcaggttcaaatataatggtgtgtccatactggattgatttacacagtagtgaatattcacatgaagtacaacaacatgatcaacatcatttgagtaaaagaatggcaaatattccctttccatttggcacttactagttatcacatggcatgcagtttaaatcatttttaccttccggttatgtacattaggctaatttgcatctttatggagaaattatttgcacacagttgatcttagttgttaacaaaactggttctgatatttctctcttttttatttgaatgatttatattctatgtgaattgggaggtatattctttcaaatgtctttgcttctttactgttatgcgcatatttggcactttctaaactctggtgtcatgtttaacggttggattcctggatgcaacagggggacataatgatgaatattgatcaagctgaggattcatgcagtaacattagtggtgcttcgagatcttctcagtctcatactgatcaaactgaggattcaaaaggttagtctacgcaatgtaaatcaccaatgctttagttgtatgccttgcagcacatactgatgcactctattaggattagagatggaaggactgaaaatatgttattatgctaattgtgctatgcttctgataggtatagcttcgtttggtcaagttcttagtttcttcatgttggtcttccgtatttatgtttaatgcatattgtcatccatgtttttgaagggccccctccttttcggagttcttgctatggttattccatgagttacattcagtgctctcacatataaattactgcatactgtgtatatattcaggaaatgaactatgtactcgtgtcaaggctgttacggatgtatcatgtggtagtgaattacaagatacttgtgaagaagaaggcatcatattatggccaggtctcaagatgagctttcctcaagcccctctagtcaggatccaggacaatgaacttgattacgcgtacgtcgatgtttctgaaacttctattggcaattcatttttcattacacagttcaaccttcctttgtcacttcctgtttatgttgtcctctgtctatcatttcctgtgtatgctgtttagcatagatatgtcatgtactcaccttaagtattatatttgttgcaaaatttcaggccctctcgaaatgcatgcaaacaactggcagctaatcctgaggcccctctgtttcgcctgcctcctttaggatcctatgaaaaagaaatgtgcggacctgtattgcttatatgcaacgtccattctcctggaatgagttgtttctctccatataccaagagcaccttctacagggagaatatggagattgatattgacgatgtgttgtactccaatggtagctggttcttactaagggaggcaaatataatcagcctttggaatgttaacacagagaagcgatggtttgttggcgaagctgaggagattattcatcagggatattttatcgggaacccaccattcgatgtgacaatagctcttgcgcgacaacatcccccaaagctcggagaagaagctataactgcaatctggctcagatcggttaagattggtggctggagcaaagggtcggtgaggtgtgattatgagcacagcgggttgaatagcctcaccattcatcagggcatgcttttttggttaactgacagcggttcgttgtgttgtgcgaggcaaacatctgagggcttagaacttatgatttggaacggctcagtgagaatatatgggatgaacttttcactggtaaagcattttgatgacctatacattgtgaacggtggcggttttttcccaaatgaagtagctaaatcataccaaatcgtcgttggagatgagcttcttgttgatgaaaagaggttgaaggggaaagacgtatttacagtctcaagacaaggaggttttgtactcccatcatccgaagcggataatggcaagttattcactggaaacatgataccggatgtcgactgctctatgtaagtataacaccgcctgattacttgatgcaaaatattttgattggataaaatatacttataacatttgaatgcttatatttctctgcaggtacagctggaaaaacaatcaaaatgaaattataaagccctgccactttcttcgccacgctacctgtagcagtgtttgggctatgctgcgtaccaagaggcgaacctagcaaaactccagtaactaccttgtgagtatcttctagttgtatttgttgaccttgcttcaatcgcagccataggaactacccaagagttagtaattatattgagactgcacatactgtactagtgtactttaattttcttaattagttaattatcagaaagctaaactggactacagatgttgattcatgtccataatcataaaatgcttctctattctcattgagttgataaatttttttgatgcatttccatatgaggaagtccggatacctttgaaactaattactatatactgtctgatatcgttctcaataaaattctgacactgaattcctttgatcaatacaggtagaggcaactcttgccagcctgttcaataaacctgggccatgttctttgcgctttatccactgccagtgcctgtcggctgtcgcaatactgcatgaatcaactgtgagataacatttggaataagctgtttttcctgttgggctaccacttatcatgattggatgaatatgtgctcttctagtcccgtacatatatgtcctatactggatgatctgtgcttcattctataggttgatacactgtgatcttctgcaaaacatgcagagcaatgtaactctcacatactggatgatgtatactgctcgttttctttagagaatatatttgaacaaagtaaaacggttgccagttggatgttcaattttattctgcctcctgacaacataattctttgtcagtgaaccagttgccacagttttccccaaactcggatactttctcgtgataatttttaacatctctcttcctttccaaactttttgaagtatatgcatggaaaccttttgatgatgagagtgtaaaggcatttatgtgatttttgggaggtacaaatgtagatttgaatattgatggtggttggctatgatttttgtgttcacttgaaaagtgtgaacttcaagttgagagtatagtttttgagctgaaagtcggggaaattcaagatgtaagctcccccattttgttgacagattggaaaatttgctgttcaaggttgagagtaagatatcaaatctctagttgaaagaggatatatttgcctcaaaagacattgacccacagttataacttgtaattgaaattatatgtagccatgtaggcagaggatttgggatggtgatgaagaaacaaagacaacagtaattacccatgctcaaataatgagtttacaaaatagcaataggaacaaaaaccataaagattcaccactgatcattctgtaaccagtacaattacaaagctgcttacatgtatatacatggtatgcctccataagatgtcaaaagaaatgataatgtttcctacagagaattgcacaaattcaagacctataagaacaaaaagtaaaagtagaatcaaattcaagcccacatgtccaatatgtggcactatttagctcaagtagcgaatgtactagggagaatccaacggtgcacttctgtaacgattgatgctggtatcactgtctcaacagtctcatcaactaaatcatatgcataaatatttgtgatggacttcagtgttgaaggacctaatgaaccagtgaaggtggccacctcagttccattcacgattgagccggcacatttatttggaccaaataagtagactctcctcttcccttcctccttcacatggtacgattggcccttacaaaggaaccagctggtattatccaactccctgtcatccagcagtgaccactccattgcttgtagatccagcttaaagaacttgaaagcactccctgttttacaaggatgcaatatggccacgacttgctcattggacgcaacaagaaaatgagaatcttgtttactccaatcaggacaagatgacactgttctccaaatcatatcagtgatgctgaaggacaagatttgcccatgaaaatcgacgcacacagcctgtttccccagcaacaccacatcaacgatcaaagcactctggaccttgtacattgcttctgacatttctggatcactaatatgcttatagatgctccagtacacatctccaggacaggcaatatgggcagttggaacagcactcatgatctcaatgaatgcaaccactagaggcattccatgagaaccaacatagaaaacaaagaacccctcattaggagaacgaagtaccggtaggtccaagtgcgtgccggtgctaggatgaacaaggaacacgatctgatcttggaaggacaacggcttgtgctgcgccattaggagccacccaccattctcaaattcacagaaagcatctggaaacaccgtactggttaccccatggatctttcggcttgaaacatcaaacagcagtcgcttcttgctgttcaattccacagcgaaaagggccaagggtaccatcaactctttggaacagttattcttctctgtaccatttgtttccatggctcaacctggcacaaaaacacctgcaaagaagcaaagtgtatggattagaagaccagctcattgttcataagatatggcagtaaacccctatatattcaagtctgatggattaggaacatgtacttttttttctttttctttttccagataccaaactagcagaagtgtctcacccccatctagtgccaagcgtgccatctgaaacctgaacagaaccgctcatactactagatttcttcctagtgtgactttgggtgtctctagtttgtgacttttgagtgctcgatggcacactgcttccactacgtgcttgcatccaagaacctaaacatcacnaagcgcnggncgcagggcggggtgtggcggtggactggtggttcaccctgaacaccccgcccgtgatcatggttgattcgactgtttgttcaccacgcacacgcagcaaaaataaaaaaataaaataaaatggagcca

SEQ ID NO: 41687 - DNA, 18820 bp, Oryza sativa
gcggtggggggagtaggtggagctcgtcggggtggccggccgccaccgcgggacctccccgtgaccccgtgggtcatggcgcctagaggctggagagaggagaggagacagatggagagggaggaagaagatgatggggtgaatatggcatgtgggacccacgtgggtcccaccattttttattattttgtgtgtgaagatgacatatgggtcccacggtctttattatttttccatatcgaattgtcacgtaagcgtcacgtcagtgccatgtcagataaaaaccgggtcaaattagccacgtaggcgccacgtcaaccaaaaccgctatcaaaaccgccgagggacctcgtttgcccggttttcgtaagttgggggacgggtcgtacctggttttgcggtcaagggatgaaaaattggactgggcgacaaatagagagacccaaagtgaacttattcctcaaagatcaggcctgcaagggggcccaaatagttatttttgttctgttttatttttgattgagatgcagagagttaaacataatttttttatcgcgaaatctatttcaagagcgctctcggtttagctctatagcgtgacgcatctcagagctgtctaactgtgcacgtcgtcatgatgtccatccacgtgggtgtcttttcctttcaaataaagttcacgtgggtgtatttttcctattcaaataaagtttcatctcaaattacttatccgatctacaatccgattacaccattgtgttcgttataattagatcttcacaacaagatcttacatgattatgttacgatgaaaaaatatttatatttgtaaattacttttattatatacataagttacttttatcatatatatatatatatatatatatatatatatatatatatatatatatatataagttacatttagatttgactaaattaattcttagacatataaaagtaaattcaataaagtctaaaagtaatttacatatattctaaaagtaacttaaaacaaaacggaagtaactttgtcacgacattagaagtaaattcgttgtagggataaaatatgactttttagttaattccataatttgtgctgattaatttaatttctagatagagtcatatttttatctctacaacggatttacttcaaatgacatgccaaagttacattcgttttgttctaagttacttctataatatatatataaattacttttagacttacagaatttacttttataatttaaaaagtaacttaatgaaatctaaaagtaatttagacatatcataaaagtaatttgtaatttttcatcaaaatataattatgtgagatcttgttgtaaatatttaattgcaatgaacacaacggtgtaatcggattataaatcggataagtaatttaagagaaacttctctaagaaagaaaaaaaatacatagatattgagtgtactagtagcttttttttttaaagaagtgtgtctctctttagtactatccagctagcactctcggtgtagtcgcgtccttttcttattattaatgaatgtgtaataatagtcagcagtcgtgagatatttttctcttgttaagaaaacgaaagacacaatagtgtgagagggatgtaatcatgtagttggaaaaaaattagagaagaacaagagaggtgagatgaggtgaggtagtataatatagggtaagtgattttgacattctaatttgtttcatgatatatggggttttataatctcgagacatatttttatttcttatctattaatttgtgtactagtttattttcccatatgttaactatttcctattttatccctcgacctattactcctctcgtcccaatatataccaatctactatggatccgactatgaatataaacataccatatcatgaatctaatcacaggtatgtctagattcataaatctaggataagtctgggtctaatctcgtcctaaattgctacatagtgaaatgaagggaatatcttttttttatgccccaagttattttagtactttattaatttatgtaaaaattggtactccatcatcccatgttaagtgtagttattagtttctgtgtttaatatggtattattattattattattattattattattattattattgaatgataaaatatgaatagtactttatgtacgacttatttttttaaattttttaaataaaatagacaatcaaatgttaagcatagtaatctataactgaatttaaaataaaacggggagtacgtattattggggagagagatagagagagacagggggagtggactgttatgagaggcgaatagtcggagtggtggcagttgaagcaagcgtccctccaaaacgagagcaaaaaggcgcaaccaccaacgctacgggatcccatccatttttcttccctttccgatccaaaagcttccttcccttccgccaccacaccatgccacccgccggagacgccgcccacgcgccgccgccgccgcaccgccgcctcgtcttcgccttctacctcaccggccacggcttcggccacgccacccgcgccatcgaggtactccgtttgctgctgctgcgcttcgtgttcactggagcagttcagtagcgttcgcttcccatcgcaggtggtgcggcacctgatcgcggcggggcacgaggtgcacgtggccacggcggtgccggagttcgtcttcaccgccgagctgccgcgctccccgtcctcccagggcctcctccacatccgcagggccatcctcgactgcggcgccgtccagaccgacgccctcaccgtcgaccccctcgcctccctcctcaaggttttcacccacgccctcctcgctttccacgctgctgcttctctcttcattttccacctatttttgcctgaattgctgtggaatgcagtatcatgagacggccgtggtgccccgcgagtcgattttgaggaccgaggcggagtggctcacctccatcaacgcagacctagtggtactactacttctggattgctcttgtctcattgcgatgcattttgctatttttaggagggggatgttacttgttaagagtgaaatttacttggactgaagtgaatgtgggtgctgttgttgcttttggggcctgcagatctcggatgttgttcctgtggcctgcagggggctgcagatgttggtatcccctcggtctgcattgggaattttaggtggggttatgtctcttccccgctttacttcatctgttttgaatgaatcagttggcacatcacaacttatctctacctcatgttcagttccatgtcttgccaaactttagaatgccaaatagaattgcatatcatagtataaggatgcatactttagcattgcggaatcaagcaacactgataatacgctattgtttcactatatgtgcaatctgcagttgggactacatatatgcagaatatattgtggcatctggcgatcatcaccgttctattgtttggcaggtttgtttttttcccacatcagctcattaccctttcctgttgagagtggtcaaattctggcctttaggttatctgcactattgtctcctttagcaatctcccttttccatgtgcagatacgattacctgctcaatatccaactatctactcaatattttgcagatagcggaggattattctcattgtgatatcttacttcgactacctggatactgccctagtatgttcatttgtgtttttcctattctttctttaaaatgttcatatttcgaacggacaaaattgtcagtatttcatttctcagttttaatttttttaaaaaatgagttttccttaaatccatagtgccggctttccgtgatgtcactgatgtgcctcttgtggtaagagggctacgcaaatctagatcagaggtttgtgtgattctactgatgaatgatgctccatgggcttgaacaacattctgctttcttaatttacagttcccttttttgatctattaggtgaggaaggaacttggaatagcagaaaatgcgaaggtggtggtttttaattttgggggacaggtgggcgttccctatggttaaatttcataagcttaggtgatatgtttctgttttccccctttgatattgttttatataactctgtgttttaaattatcctgaaataaatcttgtgctttttttttgaatctatgttgcctttagctagtatctagatatatcatcgcgtgatgttcccgcaacagaaaaaaaaaaccatgattgcactgtagtactgttttaacagcatgtttcatattatatgctttgttgaaagctcccaatcttgacttcattactgaatgctcctatgtttttatttgagttaaagaagtatgatcacaaataaaacgaaattattaatgtactattgtccccagccagcaggatggaacctgaagcaagaatggctgcctgatggctggatctgtttggtatagatttttatactggatttctatcctttaaataagtaaagcatctgcccggtgtggttgtctaaaacttagcactgtcttcatgaaaggtctgcggtgcatctgattctcaagaggttcctccaaacttcattaagcttgcaaaagatgcttacacacctgatgctatggcagcatctgactgcatgcttggtaaaacatgatatattcattttttaatactagtccatattttctatattttgctatgcactgcttactctcactaccctatagggaaaattggatatggaactgcaagtgaggctttggcctacaagctgccatttatctttgtccgcagagattattttaatgaagagccatttttgcggaatttacttgaggttgaatcatttctaatcatcaagttatgctaggaataacttatgtacagctatgctaaaaatgccgccatgtcccattctatttcagcactaccagagcagtattgaaatgaccagaagggacttccttcatgggcactggaaaccttatctactccgtgctctcacacttcaaccatgctatgatggtccaacaaatggtggtgaggtaattttgcaactgatttcccaggttattgcataatttcatgcaaactggccaaaattcacaatatttatgtggttaatgcaacaacattttattttgtttttttgttcaaaatcagatgtgataagataaaagcaatactcatttatctagaccaaaatgagaaggatagatgcatagtcactaaatcgattgtattccgtataagtattatttgtaatgataaactaatgcttgtccattcaggtggctgcacgaatcctcgaggacactgctgttgggaagaagtgttttctgacaaagtgagttacaacagggttggatttccatgtctacctttttgctcatatgcctgttttcatcctgagctctttagtttttacacttcatgtggaaaacttttctcagggaggttagaggacagtaagcttcttttgaaactttctatgctccatgctatgtaaaaccagcattcattgaactgggaacttctgtttccttcttttaaattgtcaaaaaaattagatctgttttggaaaccctgttgtacaatcatctgagccaatcaacatatcctatttgtaattatagttcaatggagcaagacgattgcaagacgccatagtgttagggtatcaattacaaagggctccagggagagatgtagcgattcctgactggtattctctttccgagacagaagttggtgcctgtccaatctcagaaaatattaaaacaaaagaaagcaccgaatcgtgagttaaatgccctctcttttcatatttgggtagttgttgaacaatagacttcgttactgacataacaagtttaactctggtagatgttttgaagactttgagatacttcatggggatctgcaaggattaccagacaccatgtcctttttgaagagcttatctgaatttaatcaaagtgagttaaagagtaatgggaagcaacctcaagagagaattgctgcatctgtgctctttgactgggaggtacttggaattccctgtattcattttactgctaaactatactaccacatgcaccaaattttgcttcttctgttcatgtagcatgtctagagtgtagctgttgcaagagtgcataaaggtgcaacaatgtacaatcagataataagctaataacttcctaaatgcacaaaatatatcaacaatgatcctgtgatgtttcattttaagtttcactaagctactatattagtttgatcaaagtaaatcgtatctcattttgatgtagtatacatggtccttgtgagtttcacatgtcaattcaccatatgttagtttcatgctttcttacgaaatataattcaagggaaacatttaagataatacagtttgcagatcctttttgtgattggcattgttgaccacgatttgtatcatgtaatttccatatctattacatggtgcagaacatgtccaaacagctctctcttttttttggccattgaattgtttctttaaccgatctttctttttctcaactcttatcgaaactgagctttgataactgattaatcaattattcttgttaaccttttgttctaacaattgaaggaagtcattcaaaatgcttaataaatgactgagtaatcataatcccttatttgttttttgcgtggttccatttcaggaggaaatgtatatagcaagggcacctggtcgtttagatgtcatgggtggcattggtgactattcaggaagtctagtcttgcaggtatgctcaattgcaggtgaaaaatcatatttctgtacttgatctttaagttaggcgattttattctcccttgaccccccccccccgacttttaaataattaataattgggatgtataagtcccattttttgtgattctccttgtttgatccaaaagcattgcttggcactggtggatggtgtattagcaaatgaaccatctaatggcatcacaacaatacatcttctgttttagtcagttgtaattaaaagttttggtgcaattactagctgccccttcgggaagcctgtcatgttgctgtacagaggaaccacccaagcaatcagaagctatgggaaaatacacaggcaagacggcttgagaacggaggcatggaacctgtggtacaaatagtatgttctactcaatcatccaaatatatttttttattaatcctcagtgaacgtggatactgcatattagttatatgctgaaaatgcttgtcctggctaattcttacatgagaaaaaagatctcaattatgaaattcatatggtgcttactaccaataaactctctcacaggtatcatttgggtctgaattgagtaaccgttcaccaacttttgatatgaaattgtcagatttaatggatgtcgacaaaccaatatcctacgagaaagccagagaatttttttgtcgcaacccatcccagaagtaaatgtcttctattccccacagaagcttaaactgctcaactgtgttgacatgtttgttaactccatcctgtttcagatgggctgcttatgtcgctggaacaattctagtgttgatgactgagctagatgtgaagttcactgacagcatgagcattctggtacacctaagcttcacttttttgtcttcccttattgtgcatgtgtgattttcctttttttttttggtctagggaaattattttctaaactctcttttagggattcaagtagaatgacaaatgcacagacatacatttcctcctttttctttttgcccatatgcgacaatgatattttggccaatagtgattacttttgttatgcactgaaactcaggtttcgtctgatgtgccagaaggcaaaggtgtttcttcttctgcatcagtggaggttgcaactatggctgctattgcagctgcctatggtttgtagaattgacagtagttacttttccactactttctttttctcttttcgggatagagtagacaatgagttaacttagggcttataaccaattctgtgtaattctgaaatatatttaactaaacactgtttcatgtactaaatagcatccttggtattttttgctctggtatgtaggtctaaacattgctccaagggacctcgctttgctttgtcagaaggtatggtcttaagaaatgtttggtggtaaaatacaactcattaagtccttaacgtttatgggcctatggtctttcaggttgagaatcatgttgtcggagctccatgtggagtaatggaccaaatgacatctgcttgtggagaagctaacaaactccttgcgatggtttgccaggttagtagcgttcaatattcattgcaaggtagatcaaatctttaacccagtgaaaaaaacaatgttgcttctgtatttgtttgatcgcagttttgctgcagcctgcagaagtgaaggaattggttgccattcctaatcatatgcggttttggggtctggactcagggatacggcataggtagaaaattttccagaccgggccttttgttatcaatttatcaaggctgaacttttgtgattgcaagaattggagctaattgcagtattctactattgcttgaattggtagtgttggtgggggagattacggatctgtaagggtaggcacttacatgggacgaaaaatgatcaagtgtgcagcatccgacttagcttcagaatcctcagtttctgatgctcctgttcaatctaatgactataaacaaaatgccatagaactactgaaatccgaagcttccctggagtatttgtgcaacataccacctcacaggttcactcttatcatagtgttcaccaaaacacacatcgtttcaggtattgcgcggataatgatatcttacagttacatctcaatttcagatatgaagctatttatgcaaaagatattccagaggtcattactggagatgcatttttgaagaaatatggagatcacgatgatacagtaacagcaattgaccctaaaagatcttacaatgtgaaggctcctactaggcatcccatatatgagaactttcgagttgaggttagatctctccatttggactatttgcttttgatgcagttgtttttcttttcctgaaactgagaggcagcaatacatttgtatggtgggaacccttatgaagctttttgttgtttgaatttactctttttggaaacatgctgcggtgatattgttgacatgctctgtgctttttaccatcaaaattacagaacattttacttagaaaaaggggtctgaaacgtgtccaacaaaatgttgattgtattattaactttgttttaatttgtggcatatagaccttcaaagcactcttagaagcagctaataccgatgagcaattgtcagcccttggagaacttatgtaccaggtgaatttgagcatctccactactttgtgtatcgtgtactcttatttgaccataagattgaccatctaaacgtacagttgatgacatttgttgtatattgctgacatgtttttcatcccatactgttggcagtgccactacagctataatgcatgtggtcttggttctgatgggactgatctgctagttaatctggtacaagaaatgcagcacagaaatatgtcaaaaggtgaaagtcctagtctatttggtgctaagattaccggaggaggttccggaggctcagtttgcgtcatggggaaaaactgcctcaaaagcagtgaggagatcatcgaggtatgttcggaattccagttctacgatcataatcagtaataagagatgttctacgttacgtctggaaaacaactctaacatcagaattaagtgttacactcttgcactagtttctttttgtatcatgcgagagatattagctttatgctttgccttggacatttgcagattcagcaaaggtacaaggcagcaactggctacctaccaatcctattcgatggatcatccccaggcgctgccaaattcggctacctgaagatccgacgacgcccctcgtcaccaattgctgccaaatgaagagattggctttcagtttgtcgtgcaactcggtctgtcaatgagtttcatcaagaccgttgattgaaaacattgtgccatcctgtcaactgcaattgttcgttcattgattaattgctccattctggggcacagtcgttgcaattgtagatttcgtgtgacagccaattcgttgggttgctttcgtgtggaactgtgaaaatgtgaaatactggattcttctgaaaggttagtggtttggtactttggtttgtgggttagaacccaattggatccatgccaatgcaattattttgccgtattagaaaaatgctactactattcgcgaaatctggtggctgcaaatcgaggagaggacgacggccggcgacacctatctgcctcgcatcgagagccgcagcccatcgcgccggtgggcagaatctgcatccgcgatctcctcttcctcgtgggggtcttgacgatggcgatgagccgatccaggcaccggcaaaagtgggcggtgatggagcactcgagcagaggaagggggagagaagagggatgagagggggttgacccactgacatgtgggtcccactgttttagctttttatttgagtaccaggtggaacccacctattttgtttttactttttaaatttttaattctagcttctaatgccacgtcaacgtcatgtaagaagatgactaagtcaaactagccacataggcgccatatcagctaaaaccaccgtccaaaccacattaggacatcgtttgcactggttttgtaagttggcggacgggttatatctggttttcagtttagggacgaaaatcaatctggccgacaaattgagagatctaaagcgaacttatttcttacttcgtccgtttcacaatgtaagactttttagtattgtctacatttatttagatgttaatgaatttagacacatgtatgtgtttagattcattaatatctctgtgtatgtgggtaatgatagaaagtcttatattttaaaacggagggagtagtttgttcggcctggcccatcagcgtgtgcagaggccttgttgacacagatcgggccgcatctccgatgagccgagctgagcctgccaaacatgtcaaccggcccaggtgaggttgttgtcttgtgtgacgctaccataccaagctattgacagagagggaattatttttacaaacaaaaaagcaacaggaatgtaatatctcccctcgtctcctctgttcattagtttatcggcccaataaaaaaaatttaacttctatatcttttgtttgaatttaattttttagttcctttttaccagtcatttttcagtattagctttgttttgaacataaattatttttgtttgtttcgtttgtttttctttccatggcttatctaacatagctttaataaaaatactggttggtcgaagcagtggcatgacgttgtgcttcctgggtcacatctaatccaaactgaattgtatcatgctaactactatatcacatcaataattagatgtgaagtgaaagtgtctcaactggttaggtttcttttagtggaactaacccatccagatttaaattctaaatatttgatacgagtgctcgcatttacggctaattaggcgacggaggatgaacccaaaacacttgccgtttcctcgctattctgccaaaatttactacagggagaaaaaagaacgaaactagctaaaaggacgatcacagatcagttagcccagcgtctacgccagaacaaccatggtttaatcagtcatgtatctctgaccaaatcaacgacgacattaattggctagctacctcaacctaaaattaatttcaccaaaactaaagcacatttgtaagttgtgaggccatcaaattaaaccggattccccatagctaattagagcagttacaatagcaggctataagccagctataaacatattttaagaagataaataaggagagagaagggcagcgggctatagatttatagccagctgtagcacggactccaaaacagtgtgtatgacaggtgggaccagatattaatattgtagtatgtaactattatatgaatgagctatcgagattggctatagatgaattggagctagtagttggttacacaattaaacttgctcttaaggcacaaattcagttcagtactagctggagaattttccacatggaagaagtggggcagaaaggaaaattaaaatggaagttgtgagggccataaaattaactggattccccatagctaaggcacaagttcagttcactcctagcttgagaattttccacaaggaagaagtggggcagaaaagaaaattaaaatggacacgacatgttggaaaaaccagatttagacgaaaagacgtccctccaaacattttttaagaagaaattgtgagcgtgttagagattgaacacaggatcacggggttaaaaccatatatcccttaacactgcactatcaagtgcatcttgacactacatgttggtatcaactccctggagcataaacccccaagtatctagcagaaaaaggttaggcccaaatcacctcaatgtcagccaattcggatggacaaagtgggagctttccaacaaatcttgccagaatcttaccactgatctcttggtgcaaaacaccgtagcgcagagaaatcacatccatctggcgatagcgaatgcgtgatgcactaggcgtcactcgcaactgttcgtacgtgccggaatcggtgatcgaatcacgtcgcctacctatgtcgtggatgcgtaatcttcatacccaaatttgcacatccgatcgatatttttctcgccgtctttaactgtggattgggttaattaagtagtactgtagcatgcatttgagagttggaattaaaatagtactccctccgtttcatattataagtcgtttaactatttttcttagtcaaacatctttaagtttattcaaatttatagaaaaatatagtaacatttaaatataaaataaatgtattatcaaaatatatttaatatttaatactgaatttaatgaaactaatttggtgttgtagattttgctattttttctataaatttgatcaagtataaagaactttgactaaaagaaggtcaaacgatttataatatgaaatagagggagtagctatgagtcacttacagggagttatatatatttgttttctatagaagtcacttacatgtttgcatagtgatatatatcttatacaaatttatcttgttattttttaaaagaaaattaatagctattcaagtaacatgtaaataaatgagaagatatcctctcgaggatgaatacacttttttccgaataaaggagattgaacaaataatccatgaccatgacccatttctaattgagattgataagcataaaaacaaccatttcagttattttaagtgaattattgcagtggccagcatgagatgacaccacttgagaaaagagatcgaaatgctgaatgctctcagctaatataccggattaaaagcacatgttgcgcgatctgtctttgacaaagagcgatatgctgctgtatattatcagatatatatatatatatatatatatatatatatatatatatatatatatatatatatatatatatatatctgatcatcactgtttcgtactagctactattagacattattagcaggcaggatcaattaattctcctacatatataccgaattggttcgaaattctcatgacttaagttttttagataacggactaagatatatattaacggtaggtcctctcaaataactcatagcaggctaaataaaattatagtgactaatagcagataaaattgagtactctataaagacaaatagctaatctattatatatgttggcttttaaataagctaatactacctccgtcccaaaaataaatgtagccgttgatatccgtgtctaacgtttaaccgttcttcttatttaaaaataattataaaaaataataataaaaatagtcacatataaaatactattcatattttatcatctaataaaaataaaaatactaatcataaaaattttcaaataagataaacggttaaacgttgaacatgaacagtataaaactgcacttattttaggacggagagagtagctggtagtaagctctcctattaaacttgcttttataagaacaaatagctagacactactcaattagatatcttcgaaaatagttactgctatagtcgagatttaaaatcttgacaggttgttctttgttggatgacaagctagccgtgaggttaatatggtgtcggcaaaagagacgagaggggttaattaatcagcccaattaagcatgtgtgtcggcaaaagcagacgagaggatgacagcggcagaacaagacgcaggtgtcacttgaatcaatatcacccagtggacaggaggacacaagtctcgcaatcccagcggctgatccgatccgatccgatcctttccaatttccaatgctttcgtttgccctcgtgccgttttgcgtcgctgttgatggaaaaatgcaatgtttgcttttgcattctgggtgtcctcacctttatcactcttcatccgtctcaaaataaatcttatttttcgcatatatcacgtattccaatacaaaattaaaaaaaataaaatattcctactttattaaattaagtatgtaactattcctcgcttttatctatttccaatataattattcactactttcacaacctataatgcaatgattactttaaaaataaacttattttttataaatgaaagggactttaaaaaaataaagtaacagaggaggaaatatatgcctttagtttcactttcttcgccgaagaatttcggtgcaattttagtcgctccaaaggatagagacatggttattcatttatgcctacggttcacgtatttctttgtaaaatttattgaacttaaatttatctctaaaattgttacaaacatacattagagaaattcctaccgtgcatatatttcacgtgtgctcatgtatggatggcgtgggtaaaaaaactctagcatttgtgtggttcaggaggtgccctttggcccttgctgatgcaacaaccgtgtactaaaatattaacagagagtgtcttacgatgttgggtccacctgtcatatatatatttgcaatgctcataccgttttatattagattcacatatcatacacacatatgagataaagttacagtttaatttctgacaaaatcgtttgttattgttataatcttgtggtgtactacaaagttaaaattatagtaaagtgaagttttatccaagtaattacagttttctaaattttattctaaactagaaaaaaatacccgtgcgttgcaacgggtgaactctattttaatcttattattgttatatggtttagttacgataaaatttactgtgagagttcgcttggatatatatatttttagaaaatcatgagctgtagttagaagtccgatcgtctcaagttagcatgcgagtttttttaaacagatcaaatacggatagtattttcaaaagcaaacgaacttaaataaccgactcatacacgaataatgtaccaaaataccgaaaaaacatattcaatttttataatagtagagatattactacatctactacaaaataatttctgcacatcttttaaaaatgtatatgtatatctttttgtctagatatgttttgaaaacacatagaaatccttatattttgtaacgaatggagtagtggtactaagggaaggacacacagtactactgtaattaagtaaaattaatcatacacatgccactatattaaaaattctgtccttttctgtacatatatgctagctgtcttttttccctgtatgaaagattgaaaagcagcacgtaggggattagcttagtgaacaacccttctgatttgcttagctagccaggacagtgattgcatttgcagttgcaagggccactctgtacggtagttgtgtccaccagctacgtagctaagtatcctaactatcttagtttaatttgcgtcctaaagctagctaatgatcagtataaccattaacaatttgatgcgtgcaaaacacatatacaacatgcaagcagctagtatatgtaatttagcttagcttttattaataattaattactatttagtgatggacttgacctagctaataatgatctagaggtagagcatgattagtttgactgtataaataagcttatatatttttctccatgacgtgcttcatctacgtacggatgtaatgatattgcacaatgcaagcgtgcatgcgcgtatgcatataatcatgcaagcagctgatcatatcgaagctgctgtatatgcatgcaactaccaagggttgcatactggaaaagaaatagttaggccggtgtggaattaacaaatagcatgtatgtttttcacaaatgagaaaaatgttaagcacttgtcttgtgcctctgggtcagttaatttttgttaattactccatttatcagtcctaaaatataaacaattccagcatttacatttgctctaaaatactcttatataggcatacaagtttcataattgatttatcctatccaaagattagaaaaagttatgattttttagtctttttttatattacacaatatatacgaaagtttatgtataaatttgaagatttatgcattttatttttttaatataatttatctgttatatgctatatagaatttttttttgccgtgctctttctaatgcaaataatctttcatatgctgcacataatatttttgtgctattatattttgtgtgagcaatttcgctctcatataccccaaaaacttttaaaaggataaaaactccccaaaaaaacttaaaacttatatacaaatatctatgttatgtaaggatgttacataaaaaaattgaaacttctaagggtataaatcaatcgattgttaatcttgtatttctttaaggtattttggataaaaaaattaaaaaaaaatactagtcggatgacatattataggacaattgatagtctccggtatatatattatagaagtgaacagtgtcaatagaaatcgttgaattagaacaaacttatgcgtttgagggattgtgagaaagaggacattgccctcgttatccacgcgcacgcttcccgaactgctaaaacgatgtgttttttgcaaaaattttctatggaaagtttctttaaaaaatcatattaatccattaatttttgaagttttaaatagttaatactcaattaatcataccctaatagctcacctcgttttgcgtatcttcccattctcctcctttctccttctcccaaacacagcatcatagaatatagattgccaatacttttctcttaacattaatttctgctagaaaacctaaagacagatttttgttttggaccagagtagtgcacaaagtaactcccaattatgtttatcattttctaattaaaaaaatctgttgtagcatatatagtatgcatccagagtcaaaacaaagttaatttaatcatcacttgtcttaattatggaaattagcacacatatctactcccttcatcccattttaagtgcaattgggagtttccatgtctaacatttaaccgttcgtcttatttaaaaaaatttataattattatatttatcattattagataagaaaacatgaatagtagtttatgtgtgacttatttttataattttttataaaatttttaaataaattgaatggtcaaacattagatatataaacccacaacttcaattaaaaaatgtgacggagggagtatacggcaatctcagtcaatcacaccttaccaaattagtaagatgcgcacatatcacacatggctagcttggtgctgtcatttcatggatagatgtggcttgtgtggccgccgagtgctagctagctctccttagctcgtgcagcaaactaaagcagcttatcctttttatcattttctcggacctggatgatcatgtcggctaccaagctactatatgccttctctgtatatcaacccgtcccgactagtgctagctagtagatggttattagtgcatttgcaaacaaactttttcacttttataaaagagggaaaaggctcatatacccgtctagatagatgcctccaaagtttgtcacgactgggacatgtgaagatgtatattagttggttctagactactccctattattatttgctaaccaaatagagaatgcaattacatttatcatagtgtgaaacttctctagcggggaagtgtatatactctcccttggagatttggcaatttgagtccaggtcccaatcccagagtaatgaacacgaggaattatacatgttcatgctacatagatatgtaatactacctacttctgtatatggactatgagcgattgagaatgagttacaatgagatgagaatcttgcaagagtgctagctgctaagagttagaaccctctatctgttggactggagcctcctttatagattaagggcatccacaatgccgttataaaattctttggatgggggtctgcagcattaaacaggtcgtgtttggtc

SEQ ID NO: 41688 - DNA, 1522 bp, Oryza sativa
ggatcatgagaatatcttttattttacaaagatatataaatgagagattctttcataagccgcaaattttggtcaatgtcgcccaattatcttcttcttttttttttgtgtgtgcggagagaggaggtgcacttgctggagtacgtagaaaagcgagtgtgacatgaaaagaatcgttgcgagagatatcaccctgcagagtgcagtagataataatctagctgctgcctgcacttggtggtggggtggccagtagatacaagcgatgcacactcattgccattttgcgtccaagtaccgtacctcaatatatagcttgtcccagcaaattagtacacggccacaactagcgtactctttgtacgagtacatatactggcagcggcagaagcgtacaggtagatgaactggctgtctggccaatggcaacttcagacttgggagcaaatcatcttcacttcatacatgcgtgtgtacctgtgatcgattgccaactttttctccgtcaacgagtacataattctgtctctgctgtttcttctagtagtataggagtacaagtatggccgtgtttacttcgttggccaaaatttattttaaagtatacggatatatattcaaagtattaaatatagtctaatcataaaataaattaaagatttcgcatgtaaattgcgagataaatttattaagcctaatcaatccgttattagcaaatatttactgtagcatcacattgtcaaatcatggcgtaattaagatcaaaagattcgtcacataatttacatgtaaaccgtgtaattggttttttttcgtccacatttaatgctcctgctttatgtatgtgtccaaatatttgatgtgatgtttttttgccaaaatttttttaatctaaacacggcctatatatgagtcgttttgaccttttgagtaattgttccagttgtttacagtacattgtcatctccttttcttttttttttcttttggcctttgtaagcagaaatttgtggtaatgaccgggaccatgtactgtaaggagtagtacaatatctcatgagagcaagtttaatagtatagctaactactagctttaaatcatctatagccaatttaatagccaatttatataatagttgattactatactattaatatctgatcccacatatcatacacatattacgtcttagagtccgtactgcagctggctacggatccgtagcccgctacactgctctctcttattttatctaaaatatatttatagctgctactgtacctgctctcaagatacgagggcaggcatagtgagtgctatagtggtatagatggtgcagtgagaggggagtgtggtgccgtagagcaaggggacactggaaatccatggtgtttcctcgcgatgcagccgccgtgcaccgcagggccccagcctcatctctccctctctctctctcatatgcctagtgctactgcttcccattgcacttgctgctgctactatacggaggggctgcaggaa

SEQ ID NO: 41689 - DNA, 2212 bp, Oryza sativa
caaggattatgagaagctgtaattgtataataattcagaaaatgacatagaagttaaaagttaggttaccagcttctctagattctcaccagttaatttctcaccggctacttctcaaaatcttaaagtggtgtttgaatgagaggggactaattttagtccctgtcatatgcgctcattaggagtattaacatagactaataataaaactaattacataataagagctaattcacgagatacattttttaagcctaattaatctataattagcacatattttctatagcatcacataggctaatcatagattaattaggttcaatagatccgtctcatgaaatagtctaggattataaatatattttatcattaatctacgtttaatacttccaattaatgtcctaaccttaaatataatagggactaattagtcacatgcatccgaatactacaacattaacgccgtgtttatttccaaagtttttctttaaacttctaacttttcaatcgcatcaaaactttcctacacacataaattttcaacttttccgtcacatcatttcaatttcaaccaaacttttaattttggtgtgaaactaaacacagcctaagatctctccctatcaatcgttatttttttctgaaagcctttccgtttttttttccccaaaagttactactcctcggccaacgatttctcagctccatcctacacgcgcgcagttaaaatatggagtagtaaaaaaaaccgaaaggagagaaaagaagagaagcgaggcccaggtgtcgatgcaagtgtcccctgacgccccaaccggagagcgtgaaaaagcctgcactgcactctcgcttctcgtccaatcaaatcaaatcacatcattttccgaccatatcctgtgagttgtcctccctccgtataaaaaaacaaacactggattttcgtatttaattttgattttccgtcttatatgaaatttttttataatttatatttttattattgtttgatgataaaacgtgattaatattttatgcgtgacttgtctttttaatttttttcatatttttttcaaataagacggacggtcaaacgttggacacggaaaccaggctttgtcttttttttttatgacggtgggagtacattcactcttcactgaatcatcagacggtcgatgcacctttgcccgcggcgagatcaacggatcttggccgtccgatatgtcctttgtgtttcgtgtacatgcatgtaccggcgaggctcacagtcacatgtcactggtagggacggaaacggtcaaaggttctatttggagagctttagattctgagaagcagatattcggtagccagtttctgagaacctggaaaagctttaaaacctaacttctccagtttctaacttcttacttcatttttcagcatctatagactattttggagcagtttctagcagaagcagtttttgggaaaagctgcagctaggagaagctcttccaaacagagccaaaatggtgggaaaattgttttggctcaaaccaaaccagatcttcatcttctgaaaatggaatggtaaacagtgaggatccatttggttcgtaggattagcaaaagattgtcataggatttaaatttatataggagtagaatttttcatatatgccccttttattcatttgaaaagaaagagaactttcaataggtaaacttttattggaaaaatatcaagaggcatgggctctttcctatgacactatttaaagggctcatgtcttatttccttttatttattcatacgggattgagaagtataccactctaattcctatgtttttcccattaagatttattttaattcatgcgaatcaaagagagccgagctaaagccaaaaatagaatcatacggaaaggaacgtatcaatatcaatcgaaaactggtaataaaaattgaactgtaaaatcacatactcaagttagtatttaacttagcataactatataatatcaccagataaatttaatcttgcactatgtaaattagaatgtgttcctcctttagctatcacttaggtcacagatttgattagggagttgacggcttctaactatggttcaaacagaaatatggagcatagatactatggtatttagaaatacggtaactattatatcataaaaatggcaatttcttcaataatatggtaaaata

SEQ ID NO: 41690 - DNA, 9511 bp, Oryza sativa
aacatcgatccatcatcttgtaaatattttgttccaaacacaaaatgaccacgtacgggcagcttgcaacaaaaactgctctactagttcattgctcgccaattggccattggtactcgaagagtacatgttcatcttggaaaaaaatggaaagctgaacagaatatgaaaaggtgaggatcttggaactggtccggaatctatgccttttgtgcatttttatatgttctataatcctcacattaaaaagcttgctttcgagcactaatcatgcatactatttcttttgaaacaaaagctctaatcatgatgcatgcatggtgacattggtgagtaagaaatatttgaaagggccgaaatgagaggcctgcatgcgccatgacgactccacgcgttgctgcccacggaaaaggcgccgtttagccaaaagatgagcgaaaagatgtcaaatttacttatattgattcggcgccgtaaagcaagatcacaacaactttaaaatggttcaaccgtaagaattaatattaaagtaatagtacgatacaagtttagcaatataattaccatattctttttttccataggaggagtgcattataggaaataccatacataagtgttaggtttcatattttcaacatacaagttctagaaaatagcatcgcatatagctaatttctctatgaaattatttcaccgttatggctctatcaatcccgtccaacccactaaacgtataaaaacactcttgcttgcttggccacctcctcccatagcatcgccaacattagcaaggctttatggccacctgaatcgcgctacactcttgagtggagctacatggctatccttgatgatgttgcctccatgtctcccatgctcctcttgctcagccatcgtagcttttcctccgctcggcgtgaggccaactcctagttcggcagagccaacaaacaaagtggctggattggagacacgcaagaaggcagcaccgataatacccgtccatccagtgcaccctgagcttgcagtggacaaatctggcacgcctcatcctctaggcatcccatcactcaatggtcatcagttgaccttggaaatgaggaggccgctaggaagacgaaccgggaggcgatttctgagtctattgtggatgaatttggctcgactagatcttgtaggtggtaatgtggtgctattgggagcgcaacctccatggataagagccatcactcccacaactaaaatcaaccgccagaccctgtgtaggagacgcacctcccgttggccatcgcctggaactcaacgccatttgccggatgtccgttgtctgtcgccgttgttttagcgtgtacgttgggaatttggggatttgacgttgttaaccgagtggtagaattgtatttttctatcgcctaactgacaacttctactatcaaattaacgacgatgccatttctctgacctattaatttgtaagatggtatatatttttacagcaaaacatagaatttaacacttgtcgatggtatttatttctaaaatatatctatttccataaattggtgagatggcactacgtacgtccataaatatattctgaaaagcaaactacacataaattaaatacggttacggtttgtccatacttaatacctgcattgatcaggtcggtacgcgatgcatgattggatccggccagaactttgcctgcagcgccagccagccaaaacctgagctaagcttgcaactgatacttgttagagcaagtttaatattatagcccactactagctttaattcatctatagccaatctaatagttaattcatacaatagttgtttattatactattaatatatggtcccacctgccatacacacattatgtcttggagtccgtgctgcagctgactataaatctgtaggccgctgctcttctctctcttcctttatctctttaaaatatgtttacagctggcttatagcctctattgtacctgctcttagtaatcctccagatagaatcaatagtttggtttaatttaatttggtgttggtttggatctgaaatccccaggaagctacggaacaaaaatcaaaatggcgatggcgaagcacatgatcatcctcatccccggcgccacatcgcatgcattttcttctcttcacgatgttcgtgcttgcacacaccggccattgctaaccttcacatgacagcctcacatggaatgttctcccgttgttgctaccactagagtttgttgagtcggcgacacgcatcaatacaaaacattcgtcagttgagttttgagacattagggctgcaagttggagactattatgaatgaatgaatgaattgaatgtatatattgctgcgtggaattattgttgggatgcagatctgataggcctctgttgtcgtttctaatttctaacaggggtacaatcatatctcatctagaaaaatagtactacaatctctgtttttgtggtagcattccctgtaggctgtaatgcttgttggagcttcaccatgcatgcaagctaggcagaatattttgtcatgatttaaaaaatttatccttcgatcaattttatattagaacaaaatttacaaaatctactatgtaataagtttatgatattgtgatagtatttttcaaggtaaaactacgacatctcaacatttattatgctactatacgagtagtaccagcttttaatgccataaagaatttatccaatttcttatttcttatttgcgtagcagttgagattgtgctgaaattttcaatggtgtaaaaggaattgtttttttattcttacgtatacaatttttgttacattttttcaggtccctctgtaatatgggattgagaaaatgaaggaaaaaacatagaattttaacatgaatgcacgtgtaaaacaaatagttacaaaagacatgaaaaacataaaaaatatcatttaattggatcacagtgaaaacacataaatttgaggagatataaagactcgtagaaaactttccatgaggttctacttcatgttaaatttcctcgaaaacttacatgaaatgaagttcctcatatgaatttgggattctgtagtgtccattcatttgattcaacgatctatatagaaaaatcctataaaatgaaacctcctctaaaattcctactattttcctttgaatcaaggggccttatctttaggacccatttgaatcgtagaaataaaaaaacgtagaaattaaaaaacacatgattctaactaaaatgtaattataaaacatataatgcaaaacaaaacaaaaatactggaatgattgttcgattggaccatgggaaaaaatacatgaatcaaatgagaggtagaatcaaagcaatttgttttcaaggggttagaattcttgctaagttcccttcaaaatctctatatgattgtctattccatagaaatttcaaatgatgagaaatgattcgataatctatttcaaatactttcatatgaaattgttctatagaattaaaatcctctgaaatttgtatatttttttccctacaaatcaaagaacttgttaatgtgtactccctcatcgcttgttcgtaaataagggattctaggttgatgtctttgaagtttcacaaattgaaaaggtcatgtttgataataaatgtagtggttagatggattatattgcaatattttcccaccttatgttctgagcgaggattgccatttgtatcaagtgaaacaggataaacaccggatgatttgctttgctgtgggctgttgacgagagaccacatggataaaaattatccaaatctacagggggtatttgtgtcaatcaggccattgttcatgtcgtcatcctacagttccaagctacacgaatctccaggtgagaacaaattttttttgctgtagctcctctttcgtcagtcccgactcccgacacgaggcctcgcaacccgggtcacctggtcaaaaccagagggcccacacagcgcatttccggggaacacccgggcccaccctcgtgctcccacccaacacgcctgaccagaaaataccattctttttttatttttaccaacacgtattgccaataatatttttcaatgttaggccgcatttagttgtattttttttttcaaacttctaacttttccatcacatcgtttcaattttaaccaaacttccaattttagtgggaactaaacacagccttacagcaccttacttcaaccatactcgtataataaaatactactccctcaaatattaggaaaattgatgtcctcaatttgtatagcaagagaaaatagaaaaagtcgctctcaatacaagagatagttaaacatgttttcatgcattgaacatatagtactactgcatttcagtataccttccatttcaaaaaaaaaaactcaattctaattacgaacttggacacgtaggtgttcatattcatagttaatatgatttactactatttttttttacatagtactagtgctcttgaataatgcgtcatttcatggaaaaaaagtgaagctgaatttatatatggaaatgaaaaaaatcgttttagtgcagtcgctgtcacatggaggtgggcccgggaggcgccgaccggcagtgaccacgtcagcaactgaattttatacttacgtcctcagtttaaggaatgtgtttttacaagtggcagaaagaaacaattctcgcactgtcatttctttgttcttggttatatacagtacggattaggagcccaatccctttctttaagtactcaattgacaatattttactactccagtttctgtacaatgttgatgcagtatgagtggttttaagtcattcctaaccccggatgctcaggccagttgggcattgcttgatagagaccatagtcgtaataaattcaatggtagaagtactaactatttatgccttgtttttttccttaagattattcaccaaaattttcaaaatggactagtttctccacttgcttaaataaaacattttctaaaaaaaatgcttaagctattacgactgtgctgccacagctagcacaaacgaacaccctcaatctttttggctttatattggtatttgtgggatgggtgagaaatgaacttattttgggatgaagataatatataataaagtactccctccatcctaaaatgtaggtatttttagttatgaatctagacatactgattcataggtaaaaattactatattttgggatggaggtagtacataacacatagcataactcgctgaatagtctaaaacaaacgtggtctaagtaaatttatctttgtgtaaactttttatgtactacattcagctagtactataaatttaaatttgtagacactgtcagcactaatcaatcacgatagaaacatgggggaatttgggcaaatatcataacaagaaagtgttacactcgatcagtgtcacaccctctcttttggagacgcacacaacacaagagaaaaaaagcaaagcaaaccaaaccaaaccaaaaaaggcgtaaacacaaaagcaaggcagcgttttgcgcgtgaacccccaaatccaaaaaacgagttttgcgtgacacggtttacgaggccgtggcacgcgaaaagatctgagccgtcgatgaggagcagtgtgcacgcgacggcaaccagcgccgcgccgtgggtggcgttcacacggtgggccccgatcggatgacgcggcagcctttcccgattcggccgtggggatctcgccacgtggcatgatggcgatggccccaccggccaggggcccagggatcccttttgtgggggccatgatgtcggcgtgtcgtcctgtcgatcgatctctcgtgggttttatgcatcgaccgttatttcggttgagctcaaatgcgtacggagagtggagtggagtacattgggaatcctattgtcatttggtgcttttatctcggtttcatctcatgttacctcacttcgtcgtgaggattagaccattcccaactcgatgaatacgatgatgtccataatattaaataagctgtcacctataatgaaaaatgatatgacaagtggataaatgaggaaagagaaggaaaccatgtcttacatgagacatgatttctacacaacatacaagacatcatgtgagataagtagcattaaattcaagtatggaatagtggtgtttgcattggaagaatagtgtctagtactagtttcttgatgatgtggagtttatggaaactatgcctagtgtcttgggttgggaatagccttacatttgagtacttcggtccggttgtattcttaagtcaggccttgtttagttcccaattttttttccaaaaacatcacatcgaatctttagacatatgcatggagcattaaatatagataaaaaaaataattacacaatttgtatgaaaatcgcgagacgatcttttgagcctgattagtccatgattagccatagtgctacagtaaacaacatgtgctaatgatggattaattaggcttaataaattcttctcgcgttttcaagcgagttatgaaattagttttttcattcgtgtccgaaaaccccttccgacatcaggtcaaacatccgatgtgacacccaaaaaatttcttttcgcaagctaaacaacgcctcaatgtttcaacttcatttatcttgttttccgcaagcaagtttttcaaactgttaagtatcgtttttctaaaaaaaatctataggaacttgtttttttttaaaaaaatattcatacgtttttaacttttgttagctaatacttaattaattatacagttatgcatgcttcattttacatgtcaggaaggaggggttcccgaccccttctcctgaacacgcctagatggttctaatagccggtgagtggcaaacacatccatcaaatgtaatttaaaggagtattgtgggttttttttgcccaagtttatattcgttgttgatgtggatactatagccatgtttagttcctaaaaaattttgctaaaaaacgtcacatcgaatctttagacatatgcatggaatattaaatatagattaaaagactaattgcataatttgtatgaaaatcgcgagacgaatcttttgagccaaattagtccatgattagccataaaagtgctacagtaacccacatgtgctaatgatggattaattaggcttaataaattcgtctcgcggtttccagacgagttatgaaattagtttttttattcgtgtccgaaaaccccttccgacgtccagtcaaacgttcgatgtgacgtccacaaattttcttttcgcaaactaaacacaccctgtaatagtcaccgtagacatgtggttttttctctctctttttctttaagaaaacaaattgttatcttcttgattgaatgattgccatatatgccaagccaaggttatcttcttgtacgcttatatttgcgaagcactaccaatatgcgatcttttatgtgtttatttgaaacatgagtattctcttaattcttgtaaaatataaattaattactttgaaattttgatgaaattattgcatttggaaggagctctattaaactattaaagtaatagaaacccaaaagaaatagaaactattaaagtagtccggtaattgtgactggacaatgtaaagaaatgctttgcttttattagcacacaaattactatagtatctcccactattgtaccatttaggttctcaatcccttttagcccaacaatttaataacaacaactgtagttgtagtttttattataggaattgatgagactactattggtgatgttgttttgccctagcagatatgggcagctaggcaagggggcaatcatgctcctaaatattcccctgagcaagatgcccataacaaaagatgaagctaagcaatgtaattagtttaattacaagtgggggtgattagtttaaagatgtgcacatggcaatgatggagctggtgaggaaggccacaggagattagttggcctgtgcatatgcatgcttgcacacctgtgttcccggctttgctctctccaattatcaagggccacactctttgtgcttacatcgatcaaacccaagtctaaaagcaggggattaggggcagtaggtttggtgaaagtatccaaaaacggattagtttaatcttagattgtactagtagtagtaccaactagtatgtgtttgcaaaaataaaaatgcttattggagatgttttcaggtgacctaatggaacatttcttcggagaacatggaatctgtcccaaggcatttcttatttgtatgatagggatgtgaatttttcttgtactattacacttgacaatttgattttttatttgactctatggtgaggttacttccaacaaatgtttgtagcagtaacttattactgtgcacatagtgaggagtatttttatgggagcatttcagattttttaaggaggaagcaaacttttgctttgatccttgggattccaagttcctgtttgatttttattcatgttgattccatcaatcccccggtcccatccaccaaacaatcccaattcccaagcttcaagtaacctgtgaaagcttcaggctgcgtcaaggtcaaaattagcggcgacgatttatactgctaatgatgctcgtgccagtgagattactgtttgttggtagataaacacacaaactatactcaagtcaaagggctcaaagaaaaaaccacgaaaagttcagctcccttcacttcagcggtgaagaggattattaaaagttgcaaatgtttcgtttgttcagatgaaatcatggaacggttaaatatgataatacagtatatagtattgtactagtaatgattatatatggttaacagaagtagagatagaatggtctgaagaattgcaaaggccacatggccaattcaactcaaaaatgattctcctactctttccacaatagttcaaccgttttgttttagtagtagaacttcatcctgcaattctacctcacaatgcgaaaatacaacatactgtgtaaccataagttcttttgcagtataaccatatcttcttgtttaaaagaaatcaatcactgtactagaataactacagtcaaaccataaccgtccatttgagtactctaatatttagtgcataatatgtcaaagaacaattgactattactgttatatctccgaattatcggggagcacgtttaaccaaggataaatttctaaaagtgtgccacaactttagaaggaatccaaattttgtactcaaggaaaagagctaaattttcaacgcggagagaccatgttctttcctgcttagggatgaatggatgaattcgctttcggatcttgtagacatgcaattatttcaaaaagaataattcttagtgaactattttaagttcagttttgaccttcaaaataatagttagggctgcaggaa

SEQ ID NO: 41691 - DNA, 5668 bp, Oryza sativa
ccaccaccctactctctctctctagctagggttgcgctgcttcggtctcggtcttggcgccgcttgccgcgcccttcttgctcgcccctgctcccctgtccctctcgtgtcggggcgacggacggacatcctcacccgcgcgcacgtacgggtgatcgatcgattgattcctgctccgacgaagacggcggcggcgccggtgacctcgccggacatgcgcggggcccgctgaggtctttgttgccggcgaaaggggtggagtgattgactcggtcggtgtctgcctgtctggtctgaggtcatgatgaagcaggcgcagcagcagccgccgccgccaccggcgagctctgcggcgacgacgaccaccgcgatggcagccgctgcggcggcggcggtggtggggagcgggtgcgaaggtaggacgagttcttgctttgcttgctgcttccaatggcggttcgggatggagcagtggttgccttgccgtgttcttgtttctgcaatctggtccctgttttatcgcgttattatttcgccacaaaattaggcaaataaatcctttcttattcttcttggattttggattactgcatttttttttctctgcatttttgttcctgtgatttctggcgagcgtcgcagcatttactgttccacatttatgccccctcaaagtttgagtaatcgcaacataggagtacgagtagctgctactgcagtgctaagccatgtgcagagattaattggtttgtgtaaaaacctggtcgtttagggggcgaactgcaaattacacacaagctcgccggcggcgtagggcaaaatgcatttggtcatttggatcatccagcttacggcgagattattagggaaaaaagttttcactgttttgtttggttactgattggccgtggtgttttgcaggggagaagacgaaggcgccggcgatcaactcggagctgtggcacgcctgcgcggggccgctggtgtcgctgccgccggcgggcagcctcgtcgtctacttcccccagggccacagcgagcaggtgacttcgaagttctattgatttttttttcttctttgtttcattttcatagccatggatggcctcgttttgagaccctttttaattgactttttgttcttatgattctagtttttttttggtttgctttttttaaaaataagaattctaattcgtctcgttctgaatgttgatgattcttgcacgaataagttcacaacttgctgtccttttatgagttcttgagaggtggaatgcttttttttttgtttggtgttccattttgttcagtagtggtggcagttataattatatgatgggaataatgggatgtgtttctagggccaaaatgatatattttgttcacatctttatttctgggaatgtttcacttatcgcctaggagtatatgtctcctggaatcttttctgaattcatgtatcttctgttgccgaaaagtagtagtattatcttttcatgaattgttttttttggttctttgatattacagccatcattgatctatttggtaatttgattttctatgttttatacgatgtgggagatctcgattggtctgtttgttcattgtactttattttgtttcattagctaccaatttttagcttatggccaaagtggttggaagtattgggcatactggacccccttcttttatgggtttatggtgtgtggcaccattctcttgctctgtcgtttggtagatgaagcagccaagcagcttcgatttttttttcgcatttaatggtaattacattcagtagcttcttttgcaactttcttggctttggtgttggggctaccttattttgagcaagtttgaagtatggggtgatgaactgtttggatttggaaaagattctttatctaaaagctagtgctggaaggtgcctaattctgtattggtttttcctatcccttttgtgatgatgagaaaaagggaacttttttagtaaccgtgtgatggctatgtcctcatagcacatgccgatgtgaggcaagagaaagttttgctgtggcttaattaatataaaacgaatttatgctttaaacttaaattcagcctaatgttggtcatgcttttttgtgtggggaaattgctgtggttgaagtagggaacattttgtaaaagggagaagagttacatagagaatttaaaataaaacttaagcaacataaaaataatatttgtaaaaattcggttgccattttttcctgtgattttcatcgtgatcgagtaccctttggcctttgtttccctgtgactgatgattttttgttgataaggtcccagtatcaacagatttatatctgcatccttctgattccagtgtgaaaattgttgcttagagccacagatttaagtatctttcatattgcaggttgcagcctctatgcaaaaggatgttgatgcacatgttccaagctacccaaatctgccttcaaagttgatttgccttctgcataacgtcactttacatgtaatctacagacgtgagatgttattatagtttctttttacctttaaccatctatgctgaaagtatggtccatctatatttcttaggcggacccagaaacagatgaagtgtatgcacaaatgactcttcagccagttacttcagtaagcatctgatgcccttgcagatccccaacaaattttcatcgatttcccttttgttcatggattgtaacccaccttttgtgtttcaattgattgtgtattgaaaagtatgggaaggaggccctgcagttatcagagcttgcactcaaacaagcgagaccacagacagaattcttttgcaagacactgactgcaagtgatacaagtactcatggaggcttctctgtgcctcgtcgagctgcagaaaagatatttcctccactggtatgcaaagatcagagtcatatgccattgtttacttcattttctgcatctttattattaaatcactggtgcttgctgtaggacttctcaatgcaaccacctgcacaagaactacaggccagggatttgcatgataatgtgtggacattccgtcacatatatcggggtaagcaaacaatagcaacgataaaaataaagaaaatatatagtataacaaatgaaaaattctgctgttgacatcctactttatagttgttgatacttaatatttggcatgattggctgaaattgtgtgcatatgcatgttttgttctttacgcatggcagttcctgtattcaaacttcaaattattgtgtttttatgtaatatatgtggctcgatatgtattttgtccagacaaaatatttaatcgcccatgtgttttgatataaacaggtcagccaaaaaggcatctgcttaccactggctggagtctatttgtaagcggcaagaggttatttgctggagattctgtcatttttgtcaggtatgctacagcttatatgctatatctttaaagtttgaactaaatgatgagaacaagagatgcatgatgttttcttgttttttgtggttattcacatcgatttaacggtggtcttctttctttttcctttttattttttagggatgaaaagcagcaacttctattaggaatcaggcgtgctaaccgacagccaactaacatatcatcatctgtcctttcaagtgacagcatgcacatagggattcttgctgctgcagcccatgctgctgccaacaatagcccatttaccatcttttataaccctaggtcagttctgtactaaagtatgttttgataattctctagtagtaactactggagagctgttgaaatgatggtatgcaaattccgtatttcagggccagtcctactgaatttgttatcccatttgctaagtatcagaaggcagtctatggtaatcaaatatctttagggatgcgctttcgcatgatgtttgagactgaggaattaggaacacgaaggtacttttttctcacttttccataaatggaaataattgtggactgaattgccatattatatgattatacatgtcaatgacaaagctgggaatgattcttaattttctttttaaattttttgttgttgttttcttgcccttattgcagatacatgggaacaataactggcataagtgatctagatccagtaagatggaaaaactcgcagtggcgcaacttacaggtttgttctctggttaattttggcagcactataacctagtatttcttgtgcccattttctgctgctgatacaatatattttgtgttttttcattcttgaacaggttggttgggatgaatccgcagccggtgaaaggcgaaatagggtttctatctgggagattgaaccggtcgctgctccatttttcatatgtcctccaccattttttggtgcgaagcggcccaggcaattaggtgagctctcatgttacattgccattacttcttttatattctttaactgctcttgaatccagttattgatccaggagaataccccttagtcatttgttatgtctagctactagcttggaaaatatacctgcaaccaagctttacctttgagatgacaatctggataacataccttttgagttgtacgcacccaactgatttgagctaattatcgaattctagtggtgttgtgaattcaaatagatgaattgtttcactaaactgcttgtatgtatgcttaacttttgatccctaccatgtaattacagatgacgagtcctcggaaatggagaatctcttaaagagggctatgccttggcttggtgaggaaatatgcataaaggatcctcagactcagaacaccataatgcctgggctgagcttggttcagtggatgaacatgaacatgcaacagagctcctcatttgcgaatacagccatgcagtctgagtaccttcgatcattgagcaaccccaacatgcaaaatcttggtgccgccgatctctctaggcaattatgcctgcagaaccagcttcttcaacagaacaatatacagtttaatactcccaaactttctcagcaaatgcagccagtcaatgagttagcaaaggcaggcattccgttgaatcagcttggtgtgagcaccaaacctcaggaacagattcatgatgctagcaaccttcagaggcaacaaccttccatgaaccatatgcttcctttgagccaagctcaaaccaatcttggccaagctcaggtccttgtccaaaatcaaatgcaacagcaacatgcatcttcaactcaaggtcaacaaccagctaccagccagcccttgcttctgccccagcagcagcaacagcagcagcagcagcagcaacaacaacaacaacagcaacaacaacaaaaattgctacaacagcagcagcaacagcttttgctccagcaacagcagcaattgagtaagatgcctgcacagttgtcaagtctggcgaatcagcagtttcagctaactgatcaacagcttcagctgcaactgttacaaaaactacagcaacaacagcagtcattgctttcacaacctgcagtcacccttgcacaattacctctgatccaagaacagcagaagttacttctggatatgcaacagcagctgtcaaactcccaaacactttcccaacaacaaatgatgcctcaaca

SEQ ID NO: 41692 - DNA, 3356 bp, Oryza sativa
caaccaatacttggtaggaacaaacattgtagcatgatcaacccagaaaaggttcctcagtctgctgctcctatgtcagttccaagctcccttgaagctgtcacagcaaccccgagaatgatgaaggattcaccaaagttgaaccataatgttaaacaaagtgtagtggcttcaaaattagcaaatgctgggactggttctcaaaattatgtgaacaatccacctccaacggactatctggaaactgcttcttccgcaacttcagtgtggctttcccagaatgatggacttctacatcaaaatttccctatgtccaacttcaaccagccacagatgttcaaagatgctcctcctgatgctgaaattcatgctgctaatacaagtaacaatgcattgtttggaatcaatggtgatggtccgctgggcttccctataggactaggaacagatgatttcctgtcgaatggaattgatgctgccaagtacgagaaccatatctcaacagaaattgataatagctacagaattccgaaggatgcccagcaagaaatatcatcctcaatggtttcacagtcatttggtgcatcagatatggcatttaattcaattgattccacgatcaacgatggtggctttttgaaccggagttcttggcctcctgccgctcccttaaagaggatgaggacattcaccaaggtcagtacctttctgtttctttatctgaagccaaccaacagcttcttctgtggtcagcgtgaattttaattataagtaaacatgaagctttttatctttttcattaccatggtaacaataatttaaacttgcgatggtagtttcatctactggaaactaagttctcatttattaaccttcaaaacattgaagtaaatgtgcatatggataagccgaattgcatgataagtctgagtcagattctgttccgtgatgtgatgaggacagtatgagtagtttttttttttggttgcctaggagatgttaagaagttttatggttgagtttctagccgaacataacttttatgtgcgaatctcacatgtttgtattaattatactctttaagataagagttttctaagtgtaacttcaggataaatctgttaaacgaagcaccgtttctttgttgtattatagcattttatggatgcatttgcagttgcatctttgcataactatatggtactgtaggtatataagcgaggagctgtaggccggtccattgacatgagtcagttctctggatatgatgaattaaagcatgctctggcacggatgttcagtatagaggggcaacttgaggaacggcagagaattggttggaagctcgtttacaaggatcatgaagatgacatcctacttcttggcgacgacccatgggagtaagttcagctctcattttcttctcatgcttgcataaaacactctcaagtttcgcttccagaatctgaatggatagatggccgcattccacccacaatcaacatcgcctatgtatcgggcattcatgttcttgcattcctaatgagtgctactgtggatcatacagggaatttgtcggttgcgtgaaatgcattaggatcctttcacctcaagaagttcagcagatgagcttggagggttgtgatctcgggaacaacattcccccgaatcaggcctgcagcagctcagacggagggaatgcatggagggctcgctgcgatcagaactccggtaacccttccaatggttcatatgaacaattcgaatgaccaaattcaccagtccatattgtcatgctgcgccggtgtaagtagacaatcaccggagtgttgttgtagatgttatcagcttacatccgggagcgcaaatggctcggcggatcagtagtgttttttttgtctatatgtgtagtttctcacacatcaaaagggagtagggatggtaaatgaaacttacctagagtttcttaaggttaggcgaaagatgattgtactgttggaaaggcagttctgtagtaaaatgattcttcttcagaggccattcttaagatctccatgatgaaatcaaaagttgaagatgtcaggtctgtgttttttgagtcgtatgcatttgctttttgcaaatgttatgtcgggttattcttcaggtattggaatactgcgtaatttccataggacaaacggtttttgccaacatgagtgctaatttttaacaaaaaaaaaaataaaagttactactgcaaaaaaatacagaacacaaagcccttccctaacctatgctaaagatcatgaatcaccacttcaccagcacacattggaccaacagaaatcacagtagaaactttattcttacatgtattattaatggatgatgctataaagtataaagattacactctcgaggagatgggttatttcatactaacatgctaatacagcgaactgccatttcactatatatatcggctattggcgaatattgcaatgtagtccttcaaatctcaacctgggtcgtcgtcgtcgtcgtcccaggctgttggatttcctgcatgaatgattggtaggtttcaaccctggacttggattcaggctgttcgaggccatccatgaacccgtgggtcatcgcaaggaaatctttcatgtgcaacctcttccattcctgcaggggaaaaaaatgaatgagctcaaaatggatatcacacaatcgtaataaccactgtcaattttatcaattcagttaagcatgaagacagtttaagtacaggtgtgagaatggaagaactaacaaaataacatgggcttaagatcttgtatatatacaaaatggcatcaggtatgaatacagacggaaataccctcacctcaaaatcccattcaccataaagatttggatcctctgcatcagcccatacataggtgtcagcaagcattgtctctgaagtatcctgcaaggacaaatcacctttgtttttagcaaaaccatatcgattttttgacgacgtatcaacagcaaaaaatgtacatgatgaacagaggaagaacattattgtatggcaataacaaataatttcctaagatgtatttttgtgtctcctgcataatacttgctgccagcattgattatgttgacaacgtcagtgaaaaactcacagttaatgatatctcaactcttgtcctcacgtactccacatcttcaaattcatccagaatctggagctctgcatcagtaacaccggtgatgacctgcagaaaaatagtaaccgtaggtaagaggagagagaggttaaaagcttaacaacttcatcttttcgcttatgtttgtacttatcagccaaaatttaaatttttgaccttaaa

SEQ ID NO: 41693 - DNA, 3253 bp, Oryza sativa
actagctagcgcgagaggaatccattcccggcgagggaggcgaaagcgaatccgcaaaaggggaatctctctctgcagaagaaatcaagaaccctaggagaggaagaggaggaagacggcggcgcttactagttggggaggagcgccggggaggagggcgggacgcgcttgatgatggtgcgcaccacctcgtcctgcatcaggctcccgtacacgaacacgctgtgcgccccgaccccgaccccgactccgtccacggcggcggcggcggcgggtggcggcgccatggcgaggtgggcggcggcggcgataaggactagcggctgccacgtggcgagcgaagggagatggaacgaactctcaactctggctcactcgattcttgtgcgtgtgtgcagactgcagaggtgcagaggaatgcgtgccattatatacaagctgggctctacgtcaagattcgtgctgtgtggtgtggacgtgatcgccgtggagattcccgtctctgcctctccaaagatctgatcagtgtggacatgatctgattcgttttttttttcttgaaaaaaaatagacccgaggcatatataactacggttgaccttaggctgcgttcgggaggagcggttgggaatctcttctccccggcacgtaaaacagagcacgcattactgaatgattaattaagtattagctaatttcttttcgaaaatggattaatttgattttttaagcaacttttgtatagaaacttttttaaaaaaacgtaccggttagcagtttaaaaagcgtgcgtgcgaagagagagagaaggggttgggaggttaaaggtaagaacaacttgagcaaatacctagatacgtaaaaataaattgggtcgtcaagaccaattgagtggaactgattggagtgttatcacaaaatgaacttcagagatagagctgggttaacttcactacaggcttaattcttaaagttaaatttataagttgaaaccttaccaaatagccctcaaatatattactgacataaacccgtgtatgcgctcctttatactagtaccgtattgattgtgtattgtatggcagagattaggatacaaaccattttcgttataaaaaaacatcgaactttttaagagtacaaaaatccagacatgcgacattgcttgataattctaggcataaggtcgttctcaagggaatacaactagtgataatatatgtgtccatactctgctttttcatcgagacatacttatcaccagtatgtatgatcccatgttagttgaacactattaatctatgaggctctaatgtccaataacaattgaaaattcctccaatagaaaggtatttggaagtttggccatggacccttactaattctaagctacattgttacataatccttcatgtgaaatcttgactaatcttaattgaagcttcaataaaaaaaactaaaaaaaaattctatacctactacatatttacaacccattacattctaaatcttaatgtacaaacaaaccatatcactatccgctaataattattacatcttaatactcatgcaaacattccacatcatctactacaatttattaaattaaagctccacatgcaagcatatcaaattatcaccccttatcatttctaagatatctcaacatataccattcatcatttctataatattaagagtacatttatccttgtattcggcagcaaaagcgtgggtcatcattttattacttctactttggtggtcaaaatatctatgcatgatcctcacactatagtttagatcttaggacccatatttactctttttttttaataaagaaaccaacactaatataccaatttcattgaatatagcagaagaaaaggtattgaaaaaaaatgtaggagaaaggaaagcactaaggaagtagaagtgttttgctcctactaaagccaagttttggcctcctccttgatttgtcctccgagagatgtgacatacagttctttgtgtaaaaaaccctatgattcctttcctatcaaatttcccatgccgtaaggaggatgagggtgcaggcttcttttttcagtagtcacatgtgactataatgtgataaaacattttattagatcataatttggttggaactctgttttattgttttatcatgtactccctccgtactcgtagaaagtcgtttaggataatatttaagtcaaaccttgggaatataaaccatgataactctcaagttgttgcgtttgaaaatgtaaaaattatatgaatatatttgtcttgaaaaatactttcataaaagtatacatatatcacttttcaataaatatttttacagaaacaagaagttaaagttgtgttttcaatactgtgtcgctgtccaaaacaacttcctttacgagtacggagggagtatgtattaaaagaaatacaataatcctctatttctaaataactacaaccaactaactgcaattattgtatactaagtaagttcgattgaattaagtaaaatataattttgctgtggggtctccagtttagacctgaccaaagacttgaaacttgaattcttgaaagatgtaacgcaagcatatgttgcggtcaagttgatgcgcttaatttgcctttggctctctacacattcaaaaaggggaattcaaacgtatttacaaagtgtaacattctagatgaatttgctgccttgtcaaatgtcatgttagtctgatagtctcatgccttgactctgctgcatcaacttattatattcgagtgataactaatttgccttcttttcgaggacctaaatgctaatttgcttgcgaacagaacatgggccaggatattccaaagatattcgagggctggaaaacatgggccatgcccaacttgagcaaaacggacagcccataaaccgggagtacctatacatctttcgaaagatttttatgatcgtatcacatagatttttaatctttagattaaaatccgatatatataataaaaggcaaaaagcaattaagaaacaccataatggatactaaattaccatatcctcaagaaaaagaccaaatccaatacaaaatttaaaatttacatgcgaagattcaaaaattacagtgtaactaacaaaagttacagtgtaagtttcataaattacactgtaacttataagaaaaggcactgtaaatttgagtgagaaaatcgagtgagagataagaaaaaatctttcgag

SEQ ID NO: 41694 - DNA, 1459 bp, Oryza sativa
atatattcatggcggagaagacccaccaaacatgggccaggcccaaattgagcaatgcgggacagcccataaagggtgctatttatggcccagaaggcccaccaaacatgggccaggcacaacgtggaacaaacaggacggcccatgagggcactaataaggcccatccgatcaagcggcccgcccatccactccgtctccacccaacggcggaggcgacgacccgatattccgatccgccggcgccggcgccgccagtcgccgactttatcggccgtgcggctcactccactccgggcgccgccgccgctgatcgccggcttcatcaaggattcctcctctcctattgggaagcttcgggctcctctttttttcctgtgagtagcaagggctcagcgcgtttattatccactccgtttattacaattccagttgcttttttttattattattatttcctcttcttctcaaccacgtctcctcctctccgacgcagcaaggaggagatcccctgcggcggcgccgtcgagccggtgggggaagggagagcttgaggcggaggcggaggcagagcgtgagctccgaaccaccaccatggggacctctgcgcaggagccaaatctctggaagcaaatcgacgacgccgagcagtaagatcaaatcctcccccacatggttcgtagtcgcattagcctaggtcttaaagtagttcatcttggttgcttgtttagtcaggtaattgaatcgcgagttcgcgactgcctcgctgaattatgtagtataagacggtagcgaattgagctaggttttcagttcgcgtagcgcaaaagggcagggaatttagccggatttgtagacatgcttgccaggatgaatgccatgtaaaatacactgttcttattctggaatctggatgactttaggagcagtcaaccatatactgtataattgtgctttacaatttacgcaagcatgtaaagttccaaatggtgaataaaaggttttaaacttgtttacttaagttgacatcctgatggctcagctatctggtcagcggattgttcgagcaggccgtatccactgccttatctgtatccagtcaagtacattcggctgccatggagaattcatgcgaccatgatgagcttctggaaatgcttgaattagctgggatggtacttgttcaggcgcttaaagaacttaagaggtaaatccattacctttcctcattttattgcttttatgctctgaccaaatctaaggttcttatacattctgtaattagagagaatgctgcctggtaaagcaaatttaagttttccattgcttctctatgataatacaagtataagttattttttatgggcttctgattttgcccaagaaaaaatatcttcacgagtaactgtatataatcataatatctgtcttgtttcctggtgaaacttccttaataccc

SEQ ID NO: 41695 - DNA, 964 bp, Oryza sativa
aaaggactcgtctacagttcggattcggaaatatattaagagaattatgtagtgggctcgcaaattcgtgatagattcggagacgaggcccaacaaacttgggagcccatctagtggggagaaggccgcccacaatacaggggccttctggacatgggccgatctttagctatgttggcttcaaagatcggaataagttcacttagggtccctctatttgtcgcccagtccgattttcgtcccttgaccacgaaaccgggtacaatctgtcccccaacatacgaaaactggacaaaaaaaaggtccctcggcggttttgatagcggttttggctgatatggcgcctacgtggctaatttgacccggccttcatctgacacttcgatccaaaataataataaagtccgtgggacccacatgtcactttcacacaaaataataattaaaaatggtgggacccacatgggccccacatgtcattctcacccctcatcttcttcctcctccctctccatctcccctctctccatctctctcccctcctctctccagcctccaggtgccatggcccacggggtcacggggaggtccagcggtggcggccggcgacgcaacagcctcccgccccgacgagctccacctactcccccccgatcggcgttgctgttgggatggaagttgcgcatggcggccttgtacgccgaagtcagccttccacttgaggagcacgccgtcctcgatgccgagctcgccggtgggcagctcgatgtggaggcggtgcaaacctcagacggcgagtggtgtgagacgtccacggcggcaggagtggatggcgtcgaagtcagcgccgtccatgctcaccagcctcatcgccgggatccctagcttctcgtggaggtacgccatgcctcacaccacgccgacggcgatcctcatcctcgccggaccaatccagcaccaccct

SEQ ID NO: 41696 - DNA, 2758 bp, Oryza sativa
agggtacttgttacagttacacagaggccccatgtgtcgttggtttttcatggagtgttttcatgcttccccttctttgtatcaattactggtatttttcttctcgtagggctacgatgcacatggcaggaggatctggatctgatcttagaccaatcttcgatgaataccttgctaaatggagatatactgatgatcaagtttatgttttagatgaaggaaagaacagctcctcaaatgggttggttgttacatcggttatgtcacctgaacaatattttgaggtggcagagttgtacacggtaacattccttagtgttgtctcccatgagactgcaactgctatctcatggactgaaaaggctgagttgactgaacaagatcggcaggtaagtttttgttggcgccttgtagtaatagatacaacttaggagtttcagatttctatattgttttttttctgaacttctattgctgctctgccccttaagttttgctcctgaggtagagatgcactgtcaattcttttgcattattaagttgtttattatattttcctctacaggacctattgagaaaacttcatgcgttacaatctgcagctaataagaagtccaccaatcagggtgcaaaactatcagaatcagcagaaagaaacctttccacttctcagaatggctcaatatcaccagcacatgaggatgctactaaaagctcagcacctacgcacaatgggaatatacagggacttagaaaggctttgccgaaatccattcaaccttcttttcaacgcgtcacaaatcaatttgatccattgttctggtggtttcattcatttcgcataaaatttggaaaggtgcatgtggttctaccaagtggtaaagtgatgtttctattttcactgctgttctcgacattatacatccttaggaggaaaggtgctgcgttgaagaggtatggatgtctcacacttgcaatcgacattttcaatcgtaatgtttttgtgcctctatgacccaaaagactcattgggagtgaatgtgctttgagcaggactgcattccaacaaatttcatctctgcgacggggcttccttgatgccctgcaactcgccttctccacccagataaatccactcgcagctgttcaacaggtgccacaagccccgcgtgctagctggtgatgtagtgtaattattttacatatttatgccgacatcagacttgagatatgagtgtatgacaaatgtgatacctgattttgtgccattgaaaatgtaaggcaatggtaagagagctgcttaatacttccttgtaaggatccagattgagactaatatatatgtttttttatgacttctggtacctcctcttggcctcttctatgttgtcctagatgttaggctgacgggctcaatttggactaaaaaaccaagcaaaaacagttcaaacttgttgttcagtgattctgtttgcatttatagagtgagaagcggtttgcaataagtgacatattcatggctgcaagcgatatgtttatgtgtaagcctggagcatatggtggatgatttgccatggtaataatatgaagtgtgtcaagccacaaactaactgccttcctaacataggtgtagtaaaccaacagatatattttaaatattatactattttgtaacacattttgtaacacgaagtggctgtagtttagtggtgagaattccacgttgtggccgtggagacctgggctcgaatcccagcagccacactatttttttaattttttcttaacactttttattttttatttttacctttcagtcattaacactttttaatttttttcttcagtcattagccaactaataaagccttgatttgattcattagccaccctttgattcataaactttttgaaaaatatattttgccttgattggattcaatcattaacactttttaattttttttcagtcgttagccaactaataaagccttgatttgattcattagccaccctttgattcataaactttttgaaaaatatattttgccttgattggattcataaactatttgtcattaaccacgctaataaatccttgatttattttcagtcattagcattctttcttgatctttttcttcaggcatcagccacactaataagttttcagtcattagtcatgattatggtaaatatcgatcgaatgatttttacgtgttcgcttgacagatctagctttgtatgctatcgcctcctggttgagctgccccgtgacagtttacttgagcatcttcgtgctggcttctattgaaagaatggctgaaagaatgctaatgaaagaaggtggccatcttctagggcttgcttacctgagcatcttcatgccggcttcgactcacttgtcctttggtctcttggcaactgtggaagaaacgcaactgtaggggcttcgactcacttgtcctttggtctcttggcaactgtggaagaaacgcaactgcagggtttacgactccgcgctctcttcggtcttagtggttctaaagtccatcatcttagagagtcatatgtgatcgttagctggcattgctacttttggggattcctcgggagtgtagtgtggctttgctctctcccgccgatcggatttgtgtttagccatcctagtagtttctttcttcttccttggtttttgtctttttttctctcttcgcctggcataagccggtctgactgattgcgttgtgtaacaaaa

SEQ ID NO: 41697 - DNA, 12063 bp, Oryza sativa
cgtagtccgccgccggcgccggcagcgccatccggcggtcgacgatcctctccagcttcttgggccggatgaggatggggcgggcccagtcgacgaggttgcacttgctgcagccggcggccggcggctcgagcgcgcggcggccgacgagcatctcgagcaggacgacgccgaagccgtagacgtcgctcatcgcggtgaggtggcccgtggcgacgtactccggcgccgcgtagccgtacgtccccatcaccctcgtcgacacgtgcgtcttccctccccgcggcccctccttcgccagcccgaaatccgacagcttcgccttcatatcctattacacccccaaattattaagctaaattaacatttgaaaattcagattgttctctcaatttatagaaatactaaaaaaaggtattaccgttttaacggaatagttgacatcaacctagtaactatatctataaggtattcatatacggtaccgatatcaaatctggtacttacgaagatacctatacctacaaactacaataccctactgatgtcagcatgcataaaactattccatccatttcagattatacatcattttgacttttcaaactattttaaattgatcaagtttgtagaaaaaaaatattttcaacccaaaataaatatattatgaaaatatatttaattatagatttaatgaaactaatttggtgttataaatattattaaatttgtctataaatttagccaaacttaaagtactttgactttaactaaaatcaaaataacttataatttcaaacggatgaaatattttgttgcaatggtatagcgttatgtagtaaccctcatgaatttgtatttgagtaagataactactaactgtgtcaagcaaaatgttggaggtcttgaagtcgcggtagatgatcggccggtcgccgccgtggaggaaggcgaggcccctcgccacgtccaaggcgatcttcatccgggtcgtccatgagaggttgcatgaacctggccgggatcgttaaccagtttcaacctttgcattgcatgcatatgctcttgatcatagtgatcattagcaacatccttagcaaaataaattaatggcgagaaattaatttaagctcacgtcggaagaggtggttctcgaggctgccattggccatgtactcgtagaccagcagccggtgatcgtcctcgcagcagtagccgatgagctccaccagattcggatggttgtactgccccaggtagctcacttccgtcttcatttgattaatttcaattttatttgattaaattagtgcaacattatagcaagtacaataaacacatatcaagaaaaaaaggaagaaaacgggctacagattgtagccagttccaacacagactccattatattttatgtgtatgagagatatgaccgattaataatggtgtagtatatttataattattgcatgaatggactattaaaatagctataaatgattagcagcttgcatgagcacaagaatggcgagatgatgatgtgtgcacactgaccagccattccctgtcgccctggtggcctaaggggttgagctgcttgacggcgacgacggcgccatggatgaggcccttgtagacgacgccgaagccgccctcgccgacgatctgttcggggctgaagtcggcggtggcggccctgagctggtcgtaggtgaacagctcgaggttggtcccgtacgccggcatggtccggaactcctccacgtccttgggcacggccagcatcaccgccgccgtctccgacaccgtcttcctcagcctcggcggcggcgacggcgacggcggcgccgacttgggcgcaatcgcatcgcctgcattcacatacacacatggcaataatcaaacaaacgacccgaggcacctataaatcgggcgctcgatctttttttaaaaaaacggacggtgtttcactaagcggatcgaaattgtttcattaagtagatcggaaatgtttcgatcgtttaaaatgctgaaacataaccaaatcatctcatgagacattttgctacaacgtatgaaacagcggtttttaaagctgtttcactatatataaaaacaatgtttcagcaaatagtgaaatgatgtttcaattcactgcaacatttgatctatacatagtgaaacaacatgagtatacttgctgaaacattgttggtagaaaaaaaaatgaaacagatccccttaataaaccgtttctgtaatatatgggtgatttgttgcaacggcacgtgtgatggggacggcgcggaagcgcgggcatccgatgcatgcggtccgatttgaagaattttcgcaaaccaccgattcagatcatcggaatgcatgcgtggcgtacctcctcggcggcgggatgagcgcgccgccgccgcacgtatgtctccgcagctggcaatgaaccaccggtgcatcttgaagatgaggaaagccagcacgccggccggttgattagtttctcacacgcacgtagttaatcaatggaggtcgttggatatagcaagaatgtgatggcggtgtccctcctcaccggcgggtgcggtggtgggggcggccaatgaatggcaacctccgaccaccacacgccgggagggaaagggaaggggggagaggaggaggagagaagcggtgggcaaaagcgcgcgatggcaaaacacaagtcatggaggggatggaggttgagatggtgtcaagagagggaggcgacgggaggaatggtcggagttggcgtggttggctcacctcgccccgcgttgctagccgcgcgcgcgcatgcatgcagccacccacacttgccatcgtcagttttttcaggccgttcgatcgcaagcagagacagacagctaggcagaaaatgcttcaatccagtcgtccgatctcttgaaaaaaaatcgaacctcttgctatgactttgctgcatgcagcctttttgtcagatcctctctttatatacatgttatatatgcttccttactgagcagtatgcatgaaggagagatgacacgagatatttgcatgtacataatacccttttagcaaacttgaaaatgatttttcttttagattactgtcttcaacgcaatcattgccgccatgtcatcgtcgtaggataccacctccgttgagctgtcgtagcttatctcgccaaaagtctacaacgctacgccgtcatcacattgcacacaaaccatcatgctgccccaccatcattgctgcagaatctcaactccaccgagccaccgaagcatatatcaccagaaaatcgccgctgacatgtccgggcagcgaaggcagttggacgtactagttccgtaccttgtttttgctcatggcggactgaggagctcgcattggtagcgagagggcgtggaggaggaagggcgaattagttccgcatctccaaaatttgcaacaactaggaaaaacttgaagctagtcatatagtctttttcatttcggttatttgtttttctttgcatcttagttttgagatgttgagtgtatgcactcgtataattttgattgtgtatatccaattatggatatagatgccggatttctatccattgtctaaaaaaaatgtcaagttctgatacaatggcaagttctgaatggtaagacagccagggaaatttatttttcaggttattctcgagtctttgacttcaccacatgttatttttcaggtttacgatggtgcagggttgaccccatcggtttatagttgcagcctcgcagtgaaactcaattacgacactatctacagtccagggggccatttacggcctcaggggattgcaattgtaaacaagattccagagaagtttcagggaggtatttccagttgtggggatcatttacaatcccaagctcatcgctatatatccaaaatagtttgtgaacgttgagttgtggggagtaactaacaagcatcattctgaaaaaccatatatatcaaccaggatttaaacttgaatataaaacttggggcaaccgtagtagattaccaattggtcaccattgccaatttttttttaagaaaaaacactcaccattaacaccatgtttgtgaaaacatacagccttattgaaacagcagtaaacgagggcgggcagggatctcaccatatatggacgtagttcactgatgactaaatttattttgaaagtagttcactcaactctgatttatgaaacggtaaatattcagaacttgcacagcaaatatatctgacggccacaccgaactgatgaagctgtgactagaagctggccggaaattacagcactgaaacagaagcctggtatggcgtacacacaagaagtaaaaaagtttggttagtgacgctgagggtgatgatgaatacttgaaacattttgcaatggaggatagaggtggcacctgcctgtggtgagtgaagcgaacggatcggcgattatggcttagcttcccccttgcacgacagctctggttgacgagtggaagtggtgctggaactctggaaaatgcacgagcttcttggttgctggcttcatgccgtcatagaatccttgaggcatttgagccaaatgcacctcccggaggaagtttagttcatcaagcttcggcggcgggctgctgagtcttgcacatttagcaaaaacaagcacctcgaggtttgccatgttcttggtgccaaacgtgcactcattgagctttcccatcgcgatgatggacagcttcttcagtttgtggtagccattggtacaagtcaacttctccccttcgtagacgttgtataacgagaggaggagaagctgctgaaggccttgcagaagctgtagtggatctttaccttctactggcagtttgctgtcccagaggtagaggtatgttatggattgaagctttggttgtagacggtcaaatttctgcatacgacccccaagcttcagcttacggagattcttgttgacatttagataactcaaattgaaccccctcttctcaccagcagcacatgttatagtgagcgattgtaggaggtccatcttgttgattgcatcagagatgcctttgctgcatgagattgatgccttcttaactgatagcttcctaaggagcttgaggtatagcagttcttgctcgaaaggtaccatgcctgccttttttcgttcagaaggcacctcgtgtgttgcacctgacagcgtctgcagatgaagcagcgacagcaggccttccttgatgagcacggactggtcgcggaaggagtttgcaagatagagatgcctcatctctttaaattcagacacatcgttcacctctgtgatgccagtgtccctgatatcgaggcacatcaagcggcggaggctctgcagagtttcagggagatattccagctgtgttcctcgcaggcctaggtagcgcaggcaaacgaggcaggtgatactggagtgcaagcgggtgagccgagttccctgaagatccaacgtgcgtagaagcttgtacgtccgaccaaatgacagctcaagcttgggaggctccttcctctcggttctgaaatacagcagggagcgcagccgaatgtctttactcatcgcactagacatttcttggacagcttcattgccgtctccatctccatgcacagcgagtacacggtagcggtgcaacagtgctgtctttctgctgaacaagctcgagctgggtctggttcggggtgccgggtgagcggggtcccgtgcaaatctgcagattttctgtgcctcacacatttccagagccagggatcgcatgtgctcgttgaccttgcatttcagcacctcgccatccaagcctgttttcttcaccacgagcagtttgtagtcaatgagtctttgtagcaggttctctgcctcttgctcttggctctgaagtgggctgtcgttcggtgggaagccttctgccgtccagaggcgcacaagcttccgtgcagggatcaatgaattctcagggatttctgatctctctggaaaagccaggcagtacaagaagccgagccggatgtcagcgggcagttgggcatactctgctggtatgagtggatcacgcttcttatctcctattaccaaatcatcaacttggttttcctcgatttccttccatttatcgacgcgattagcaccaagcaacgctcccacggcccgtatgttccacgggttgcctctgcatttcctcaagatgcctttcagagtctccaccattggcgtcaagtcatctccatcgatgttatctgtctctgtcttccccttgagagccttttccagttgatcgtattctcctcctccttgctgcccatcattgtttctatcgacggccacaggagcaggggtgtcatcagcattgcgaaaagctacatgcaccagtagctgctgttggtaagccagttcaagagggcgaatctcaaccttggcatgcaactcttcgtactgtatacgtgtgttcctggtcaggcacacaatcttcccctcccatcctcctaggacatgtcgtaaaacatgcagcgaagatgtatcgtcgacatcatccatcaccatcaagtagcgattgcccacagtccgaaaggtacgctggatctcttcaattatcttcaattcatcaatggcatcgggatacatggagtttgtctcacgctcttcgtgtttcagcacagcccgcagcaagtcactcaaacatctagtttttgacatgtcgaccttggaacgtattttgaaatgattcctgacatcgatgtctttatacacctggttcatgagagtagtcttccctgagagctgctctccactgacaaagatcactggagcagcatctcgcaacaatatattcttcaattcttcaattttttccataaatccaattggtactgtatcttgttcttcacaatgagaatgtggggtgaaaggaaggattgcaggaagccgctccatcacttcttgatgataattttgcacctcagtcggcatctcgttttttcggtctctgatgattttcacaagtttgtcagttgacaacatcccaatagccgacttcatcgcatataaatgtcccacataaacaccacgcattgcgtacatggcgatctgatcttccaagcaagaggcggccttcagggcatcactgatccaggtgtgcaagcgcgacgtttgccaactctgggcattgatccttccagttccagccaagaaaaatgaagccttgttgatgcaattctgtagttcctgtagatcttgtttagccaaggtaatcttgtgtcctcctcctgatctgatgaccctaatatcttcctttagcaaaaggtaccaggacagttctacgagtttgggtaataaggtagaagacggcagcaatgcggcctccatggagcccaaacgaatgtatgccactccctggactattgaaaaaaaaaagagaggcaaagttaaattcccagcatgaaatataattcattttcttttgttgctcctaaatatttcacgtttttgttgtcaccacacatgtaatgaaacaattatcttgaaggggaaaaaatgactataagcaaatctggaaatacagaaaataagtcctgaaaagcaccctagacacatagtttcatatgtgtgtgctgtaattttattagtgacattactatgaaatgatcataattctgttaaacagattttcttatatgcataaaacctgtcaagtatcgctacagctcacctacattgtttacacagacaaagtaagggacacaaagtaggcatatatgttcaacatggaaaagtagttttgtttttctaagcacctgaatttatgtccacaggttagggatgcatttgtgcagagctagtgtaattccctttattgattgtttaattatataaatgcatatagaggaatttcctattaagccattggaagttgaattcttgtatgccactgatgatcatgtgtcatgtgaacttggacccaccatgcatagagactaaaatttggtggcatatatcctttataaattactagctgaatgcccttgcattgcaacaggacattgaaagtaactatcatatattataaatcccaaaaagcgaaaagtcaatccaacggaaagctccaataactccttttctttttttttaaagatcaataccaagttagctacggtttaatttactaatttcagacattggcgagattggttagctgatatcaacactaacaagtgtgattagtaaagtgtgactcaatcattttctttgaaaggaaaacagtagctcttctatgcattaaggatagaaaaaaagtttgcaatattctccaaattaagtttcgctggttctttgaagtgtgattcaatcattcaatggggataccgattggagaaaattgaaggcaattgttttttttttggggggaattgaaggcaattgttgatggtctacgacagtgtgaagcctcttgaaatcatgattggaaggccacacaaatagccgaaaccttaggcacaaaatactgatcttacagtgagagaagaaaagaatgagttcaccatcattttctgaaacaaagatcatagcaattcaaataagacagttttaatcttatctactgccacaaaaccatgctataagtcaagtagccaactaaagttagaaaaaatgttcgtctcaaagctggtagccaataaaagcaggacaccacagtggaagttcatttcaacgcatgtaacagaattaggtccacgaaataaaaaataaacacaccatatatcttctacagaaggtatataccgcaaaagaaataagaataaaaaccacacataggctagcgctaaagcacggccatacaaagagagtgaataaagaactacctgaaatcccccgttctacagttgagaaaatatacagggggaaaagcatagcaagcaacccattccagagaaggaattcatgacactaatctagtaatttactcaggatgacaggccacacgcatatttcgtctacctgactgatttgcatactgtgtaaatggcaaatatagtcgaaacaggaacacagctacccttctatgcgagctaagaaaattagttaaatggggggcataacataaagcagcttgccgtatgcactgaattagtcacactgagcgtatttgatcgattcacattctcattagtcactatccgtaaatccctgcattcctctgaagcggacaaactctctcaagcagaaaaacttggcataaacgagttatgagtgaactagtgttgcctatgaggactcctggatggcgtcaaaatccaacaggctctgacgagcacccatgaaaccctctgattgaacccccccccccccaacccctaaaatcctcacatagatcctacttgccgccacgaaatgcttaatccgtcgcaggtcggcgccgagcttgatggtcgggttggtcatctggggaactcggagtcaatggtgatgcaagtgaaaaatcgaaatccacagggggatagaaagttggaaggtcggggtaaggtagaagctggggggcgcgtaccatgtggttgtcgacgaaggcggacggcggcggtttacttgactccattgctcgccggcggcggcgggcatgccggcgtgatggaggctacttcagcgaatgacagttttgcccctgtctggggaacggggagtgtacagtggcaattccaattataccttttttaaaaaaatcaaaaaaaatatcttcttttttcccctccttcctctctccctcttctcttcctccttcctcatcgccacccttagggcgcttcatcattatcgtcaatatggcggggcggagttcgacggacaaccgacgactctagatctagagggcggccgacgagtgcacactcaagccggcagccatcgcttgcaagctaaggtgatcattgtgcagtgcagtgcacgccccattacagttcaatctcactacctcactggcgtccaggggcgtcaacgtgcatggagacgaccaacaagaagaagatcgatgtcgtcttcaattgccttaaatcgagtaggcaccaagcacactgggcggcatgatcgtgtcggaggataagaagctggagaggatgtgctcgtggccgtggaggtaagctactcggcaactgcttaaccatcgatgccaccatctcctccatcttcgatggttttgcgtgcggtggtggcaaggaggagcttgagctccacagtgattggaggagtacatcctgacaaagcaatgaatcgcaagatcgatctaggatcactacgacgctgtggtgcatgggatacggtatagcgattgaagtgtggaattaatctcgtcaatccctttttcttgtggattggattaattgaacaagctactccatataacggaacgtgatcctcgtgaattcttctatgaggggatgagaaaaacgttaaccctgttagcttaaatggcatgggaacagaaaggcatttccatggaggataatcccatatttccgttaattgcagtctacttcatcccatgatcccatctcaaactaaacgcatggatgagatctaatcctaaaacgtttcagttccatcctacttgttgcagcaactaaaactaccttactactacttccgcttcaccgaggtattgacttttctttctttcttttttttcaaaatcaaattatttaagtttgtgtaactttataggtaaacatagtattattttcaaaagaacaaatgttggattcaatcatactaattttatattagaaatattactactatttttataaatttgattatacttaaataagtttaactttaaaaaaaaagttatgtgaaaacgagaaaatagtacttacaaactatttgctataatatttactttgaggatggagcgactctcgtagcgtaattttaaggagcggagcgatagctccactaaggatattgaaattgtttaattcacgagtcacaacacactatagtaggcctcttcttgtcaaagctgcttgcctttggtgagctcggcaacgatgacttttgtgaggtctcaatagttgctttcttttccttttctatataggtttttgccggtttcccgtttaattaaccgtgcttgttcggtttttgggcccgatttcccttattaactgggccaattcttttcttctataaatttcggcatgagaaactcctactatctgttccttaaagaaaacaagagtgaataagttgtcctagtataaaacaatttctgtgcagagaacaagaaacattgaatgttgctgcctctctctgctcccgttcacacgagaaatgcttaatctctctcctctttcaactagtaaaccttattaagggatgtacttgatgagggtatttctgacttttattactaattttgaattgggaatctagggatcgtgttttataggggcagagggagtatggcattgagggcttgtttagatgccggttaaaattttcgccctattacatcgaatgtttggacacatgtatggattattaaatataaataaaaaaatacctaattacacagattgcgtgtaaattgcaagacaaatcttaagcctaattgctccatgatttgacaatgtggtgttacagtaaatatttgctaatgacggatcaataaggcttaataaattcgtctcgcagtttacagacgaattctataatttgttttgttattagtttacgtttaatactttaaatatgtgtatgtatacataaaaaaaaattagccaaacaactaaacatggcctatattaagtagtgtttggatccagagacttaactttagtctctttatttagacactaattatttagacactaatttagagtattaaatatagactacttacaaaactaattatataaatgaaagctatttcacgagacaaatttgttaagcctaattagtctataattagataatgtttactgtagcatcacataggctaaggggtgcagg

SEQ ID NO: 41698 - DNA, 2814 bp, Oryza sativa
aacgtggagctaagaacacggtagaagctcaagatagagatgacaagttcatcatccccaagaggatgatggagctttagatgcctgagtggtggattcatagagccaagcaaataatctattttatctcctgcagtagcttgagctagtggcggccgatggaactggtggttgaggatgagaaagagaagggaaatggaggaataatattgaaaaatgtgacatttcactagcttaatggtactgttagaattttgagaagatgttatgttattaattggtaccttaaaaatccgtggtattatttgactacgatggaatctaatgttggaatttaatttgactttgagtaaaatctcttgtctccactcttcttgctctctttttgtgtttcttgctctagtccttgtggctcctgtaactctgtttctatgttgaaatctaggggtgaaattaggataaatgatcgcggggtcagtactaactagggtctatgttttcaaccaaacctggtcgaaaaccatgcaatctcgatgttccaacgtggaatggaagtagattctaagtaaaatttttaatagttttctaaaattcaaatttgaaacgataaattcaaccaaaattaataaaaatttatgaaattttggcaaaaaagtcatatctctatgttcagaatctaatattaaatcgaagaggtgaaccttgatgcaatctgggtttgttcagatctatctacaggttctaaacccttccctcccagcacacacaatggagcgaggattaacacatgattaattatcattaaaaaacttgaaaaaacaatagattaatatgttttaaagcaattttgtatagaaactattttgctagaacacttgagaggttgttggccactagccttatgcatggtctcaaatctcaaagactcaaataatgtatatgcatattcggctgtataatcataagttctagctaattttctctttgatgcttctagtatcgttcctagttgtcaattgggctttaacgcagcaatcaacaattaatgtcactgaggtcatagctggtaaaataaagaggatatgagaggttaaaagcgacaactttcaataccaagtgttcttaactctgtttttccctgattaagatacatgttttatttcggttttcattagatgcttttcaaacttctaaactgtgcatcgcgtgcgaaaaattttctatacataagttcctttaaaaaatatcagataaatccaatttcaagtttgtaataattaaaactcaaacaatcatatgctaatagctttctcatttttcgtgacctaacttcatcttcattttcagtaaaaacgaacacctaattttaattttctattaatgtgatactccctccgcccaaaataagtgtagttttgcactattcacgttcaacgtttaaccgttcgtcttatttgaaatttttttatgattagtatttttattgctattagatgataaaacatgaatagtattttttgtgtgactaaatattttcaaatttttcaaataagacagacggtcaaacgttgggcacggatatccacggctgcacttattttgggacggaggtagtactaagtttcaccttaattgtatctttcttttttttttcttatcctaacggtaacgggagttccaaacatggaaatgacaagttcatcatcatatccaagagcatgatggagctccacatgctagggtgaattccctggagctaagcgaactactaccttgtctctgataatagctcgtgctagtggccgctgactgagctggtggctgagtctgagaaagagggaagggggaagaataaagaggaaatatgtgacattccgttaggttaatggtatagttagaacttttgagaagatgttgtgttattaattggcatgttaaaaatttgtgatattatttgactccgatggaatcctcatgctattaataaaatttaattcctcaaaggaaaaaaaaaaccattctagtgtaataagatgaaacagcatttctttggccagcaacctcaaggttatttggagatctctatttgtcggaattagcgacaagggatagatagaggaagtgaaggtcaaatgctatgagattataaatcagacgagtgtaattgattaccacgagctagctaattgatggctgaccgtagaataaccctcttaaaagtggtatgcatttacatatgagccgtatcaattacaaagtgacggtagcacaaaaatgttgttaaaaaaaacagaggtgttgacgatttgtttttgaaaataaaccctctaaaacccttattattagaaagatcgaaaattttccccggccaaaagtaaacaatggttgacggagctcgtggctcctcaccgggagaccgcgcaggcccccctttgccggttcggccgggggcttagggtgagatctcaagctctctcggtatgtggaaagatcgtctgttagcaagaaaacgcgagactcggacgatgtatacaggttcgggccgctgagaagcgtaataccctactcctgtgttttggtggatctgtgtatgaatgagctacaagtgtgagctgacttctcccccgttctaagctcaccatctgggaaagaaccaaccaaccccccccttcatgggcaaggtcctccttttatatttcaaggggataccacatgcacccttctctttccaaactggactgttctttttctcttgaatgggcggagatcagcacggttgccgtccgaatgacgctccgatgggacagcccacac

SEQ ID NO: 41699 - DNA, 41181 bp, Oryza sativa
  unsure (1)..(41181): unsure at all n locations
tttgcccttcttcacacaacatcttgcctgtaatggttaggatgaagcctggcatatatcgactggggctaacgtgtcatctctaagagataacacgcttaactccggcttgagacgagcgcctagaggctttcgtcttgacgggatggggcaaggagtgcgtcagaccgccagtcgccacctaacccgtgatctgaccggtctgtgactgatcacagaccggataaaagaacgcgccgtactgcgctgcatgcagcgtgacgcgcttgaccagactgcaataaatgctgctaggtgagcacagctgtgctcacttgccccatatatgtggcgcagatttctttaaggggtcggggtgcctcggccctcggggccggggcaagcacaacccgaccccccctcgggggaaatcaggaggagggcggacacctcaccctcgggcccgacgcccccgaaggtgccaggccacgtgggcgattgtgtctgcctcaagcctctggtcatgatactcccggtcccatattaccgacagtagcccccggcgttatgccagagcaatttcccttcccaagggaagcggtcaggtgtgacgccaccctgtgacaggtgggaccggtctccgtagttgggcaaaatacccaacggtctcaatccatgcacattggtattggtaactttggttgtccataatgggtggtctattcaagactgccacaccacttgagcagcgcgcgaatctgggtgagcagattcgtctcgcccggagatatggtaacgccgcttcggtcggcgagcgtaattaacgcgcgcacgatacaatccatttcgattgccacaaccgcatatccacttaatgcgccgtaagcgggcgaatgggattagtggatgcgtgggcacgggaaacgagggagcgagatagcgagatacgagggagcgaggtagtgggcgcgagaaacgaggagtcaggcctagcgatggcaagggtataaaagcatcgaggaaaggatttgctcccttcctttcgccattgttcctcttgccttcgccgcctgagctctaactctttctctgctacgccctactttcgccacacgcgctcgttcccaaccatctcttcctccaccgccatggcgcggggctctgctctgctcgacggcagtgtactgccgccttcccgcatcgtgaacgagaggcacgtcggactgccgcgccgcttcatgccggagtccgccaccggtcgggagatagtgatgctgggcgaggggcgcccggcaccagactacccggggcggtccatcttcttcctcccctttgcaatggctgggctggtcccgccattttctcacttcttcatggatgtcctggagttctacgatctccagatggcgcacctcacccccaatgcggtgatgacattggccatcttcgcacacctgtgcgagatgttcattggggtgcgcccctctcttcagctgttccggtggttcctcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccttcgccgacgaagcgcgcctccgacttccaagccagcccccggcgccggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccgaagcgcctgggagtacactgggcctgaagactacatgcggacccaccagggagccagatgggattgggctcctgaggacttcaagatcgtagtccaaagggtgctgaatcttagctctgcggaggcgtctcgccttcctcaggagatcctccccctctgcatagatcccgaccgcgtctccattctaaccattatgttgggggtcggggcctcagaggagagagcccctaagggccacgacggcgcgggcgagagccgccgggggaaacaatctgccccaggagggggtcgtgcttctgggccccgcgtcgggggctcggggagcagccgtcctgccgacgccccggggaagaggaagctgggaggaacacctcccccatctcctccccgagggggcggggcggcgcgtgccagcagtcggcgcccggagggggccgcgccgacatcgcagcccgagggggtgcgcaagaagaagcggctccgcaagacgggggagacggagccatgccggggaaacctgatttcccctccaaggtggtcattcacccgtccccctcgcaggttcgtctcactctcattgcaaccatctttctccaaaaagaagttttttcttgctcattttgttcgtcttctggttttttcttctgctttagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggtcgcccgggttcgccaagcggaggaaactgctcgggaggaggccgcccgggctcgccaagccgaagaagctgcccgggaggaggccgcccgggctcgccaggctgaggcgacagctgctgctggcgcgtcacttgggcccactccctcgggcggccctcaggcgacatcctccgaggcggctcgcgacgtggccgcgggcgcatcgcctgggcctacctcaccgggcgacgcccaggaccaaacgggcccgggggacatccccgagctcagcgcgtcctccggggggccaagccgcgtcgccttttctccaaggcggcttttctcctcatcttccgtcgccctggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgccctcatcgccaccaccgcgatggtcgaggcgcaagacaccctccgccttcaacacgcaagctgggaggcggagctgaagaacaagctcgacgccgcccaaggggttctcgactccgccgctgtccgagagcggcgggcaacggaagccgaagcagcgtcccggcggcgcgaggaggccctcgaggcccgtgccatggcgctggaagaacacgccggcaccgtggagaagggcttcacggaccgcgaggccgccaccgctctccgggaggcgacgctggcggcgcacgaggccgcctgcgccgaggaggagtccgcgctccgccttcgcgaggatgcactcgctgagcgggagcgagctctcgaggaggccgaggccacgacgcaacggctggcggatagcctctccctccgcgaggcggcgcaagaggagcaggcgcgccgcaaccttgaatgcgtccgtgccgagagagccgcgctggagcagcgggctgccgacctcgagacacgggagaaggagctggccgcgagggcgcgcatcggtggggcggctgcgggcgaaaacgacttagccgctcgcctcgcggctgccgaacacaccgtcgctgacatgcagcgcgcgctggattcctccaccggggaggtcgaggcccttcgcttggcgggcgagatcgggcccgacatgctttgggatgcggtctcccgcatgaagcgcgccggtcggcaagcaggcctctggagagaccagacgacggtgccccccaccaatctggaaggcctcgctccgcacctcaacaggatggcttgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgagnacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccagcgacccgggtgcatttgaatgagcccccaggcccccgccaatctttactttttttctttttctttcttctaaggccttcatgcctcttttgtgtatagatcaacttaatctgcaatcaaaaatgatgaaaaattttctatgttaactttattttgctatgcatgtgagttgaggatgatctgtgccgtgatcctctttttgtgtcttagcctgatttaagggctcgtgctcaagtcccaatcctcagatggctcgggtcggggctagtgcctggggagatccacatgtcgagactggccaggccgggaacatggtgaccgagggttatgggtgacccgattgtgggtttttgccgattcccccccggagttcaccatgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaacttcttttattgaaaagctgaaataagaaaagtaagactgtgcatgtgtggtagcccccggccaaccctgcacacccgaggggggtgcggggttggcccgagccaaaacctgacacccgaccccccctcttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagagccgcgcgccgccttcgctcttctaagtagtcgaggtcatctctgcgaagctgatcttggtcagcctcgcagtacatggtggcccggggagacctcagggtgagctcggatgggagaaccgcttctgcgccgtagacgaggaagaaaggcgtttccccggttgctcggcttggtgcggttcggtttgcccagagcaccgctggcaactcctcgatccatgaatcgccgtgcttcttgagaatgttgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgttataatacggttaggcactccaaaacgggccgtgatgcccttaatgaatttaagagcagagtgcttatcgatcttaacaaccggataagcctcgggccacttagtgaacttgtcgatcgcaacatacagatactcaaacccgcccggggcccgtttgaacggtcccaggatatcaagcccccagacagcaaatggccatgacagcggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacaggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgcctgggcacatgccgaagctctattccatcgaaatggcgctccatacgccgcacttggcgtacgtaggcgtccatctgtgggtcagagcaccggtactccttacagacctgattaacgactagctgggagtcgcctaataccaagaggcggcggatccccagtccaactgccactctgagtccggcaaggagtccctcgtactctgccatattgttagtcgctcgaaagtcgagacggaccaaatatctgaggacatctccgttcggagaggtcaacgtgacccctgcaccggcgccctgaagagacagagagccgtcgaactgcatcacccagtgggcggcgtgaggcagctgtgtggggtccgtgttggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggcctctgcacccttcggtggggccgatcctctctgctaggggccgtatccccggggcgttcttcgttcaagtggcctttcggggcgcacttgtcttctgtaccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttcccgggtcgagtcagcacagggttagcctcggggtcaaagggcgttaagtgcggccttcccacagtggcctcggggccttcctgagggtcgggggcacccggcaccttctgacaagcggggggagggccgactccggtcgtcgggggccttaggccaccgttcgactcgggggtctctcctccctgcctgctcccgggcctagtcggcacagagtgggggtgcgcagaatgaggattatcctcatcgcgctccacaaccaacgctgcactaactacttggggggtcgccgctaagtaaagtagcagggactcatttggctccggggcgactagaaccgggggagagctgagatatgcctttaattgagtaagggcatgttcagcttcctccgtccaagtgaacggccccgagcgtttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatacgggcggagcggaggttctcaaaagtttccgctagatccgaaagtaaagtttcttggttgcgcgtttttacaaccaagtcatcgacatacgcctcaacattacgtcctatttggctacccaaagaaattcgagtagtacgctgaaaagtgggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtctagccacctcctcgcggatgaaggcttgacgttccggggcttgccgccgcactttctgccggaccggccttgcgcccggccgcacggcgagacgatgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcctgtggccatccgctgcctcggggcggtgggggcagaggggccaagcctctcgtcaccgccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagctcacccgctccgtgcggaagttggcaggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagacttgagcacatgctcctccatccacggtggcaatggtggccccaggttcttggaaacctaggtcatcatcaccatcatcaatgtcaacagcgggggccttctgcttggcctcacttcgccgtttgccggagggaaccgccggggacttgccctcacggcgttcctgcctcctgtcctcctcccacttcctcgttcgctcagccaggtttttgactgcgcgacagtccgcgagatcgtggagggaggtgttgtggacggagcaccacctgccggcggggcgctccctgctgggagtaccagcctctttcttcttgtcgctcgcaggcctcccctttcgggtggcccgcggagcgccctcgacggcgaggacatgaccctcgtcgccagaacggtccgacctcttcttcctcctcctgtcacaccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgtggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacgttccgaagactcgccacaaaggctctacagccaacaccaccagccgggggcacggaaggctgatcttcacgtccgtgtcgaggtgacactctggacgaggaggcaccctccgttgcacggggagtacgccggctattacgccggcgcccgatgttgaggcgggcatccggctccccatgctgatcctccctagtcgacggtgtcgacgagggagtggcagccgaatgacgtgcagccgccgccgctcgccgcgccctccgccttgatgacacggagccggtggtagcggcgccggaggtcttggtggtggcggatcgtccaccagcacccaggcgctgctgtgccgtcatgaccaagttggccacgtcttccagccatcgttgggctggagactccgggtcatggacgacaggcgggtgtcgtagaagcgcgccagcagcctgaagcgcaccctgaggcgtgctgccgtcgccgtagacgaggaggcgacgctccccatctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagccctgaaagcacacgctgagccccctacctggcgcgccagatgacggagctcgtggctcctcaccgggagaccgcgcaggcccccctttgccggttcggccgggggcttagggtgagatctcaagctctctcggtatgtggaaagatcgtctgttagcaagaaaacgcgagactcggacgatgtatacaggttcgggccgctgagaagcgtaataccctactcctgtgttttggtggatctgtgtatgaatgagctacaagtgtgagctgacttctcccccgttctaagctcaccatctgggaaagaaccaaccaacccccccccttcatgggcaaggtcctccttttatatttcaaggggataccacatgcacccttctctttccaaactggactgttctttttctcttgaatgggcggagatcagcacggttgccgtccgaatgacgctccgatgggacagcccacacctacctccacttccgccgggggtgagcgcgtcgtgggaacatggctgtgcgctgacgatatgatcagtgtcagaccggtcacaaatcggtcattcttgtctaccgcgtgtaatcttggcaatgtgcatgtttgcccttcttcacacaacatcttgcctgtaatggttaggatgaagcctggcatatatcgactggggctaacgtgtcatctctaagagataacacgcttaactccggcttgagacgagcgcctagaggctttcgtcttgacgggatggggcaaggcgtgcgtcagaccgccagtcgccacctaacccgtgatctgaccggtctgtgactgatcacagaccggataaaagaacgcgccgtactgcgctgcatgcagcgtgacgcgcttgaccagactgcaataaatgctgctaggtgagcacagctgtgctcacttgccccatatatgtggcgcagatttctttaaggggtcggggtgcctcggccctcggggccggggcaagcacaacccgaccccccctcgggggaaatcaggaggagggcggacacctcaccctcgggcccgacgcccccgaaggtgccaggccacgtgggcgattgcgtctgcctcaagcctctggtcatgatactcccggtcccatattaccgacaatggtagtttgttacttatagttctattgcttatagcacctccataagtaatgtgatgcaatctttatcacacgctagggtttttaacctacatgagtacatgacaacgttgttctaccgtgttttgaccaaaaggttagtaaacttgaaaagggatatatgttatactttttgtctccgttccaaaatatcatgatttttagtttgtttaacaaataccaaggttagaataaaatattccctttttaatcatgtcagttgtcaatatttgaattttaaattacttaaattcccttcgcaagcatgcgattggctttataattattgaaataattgaaaccacgggaatcactgcatagatccttatattgtaattcccccattccaaaatataaaaaaatttagttagatgtgacacatcgtaatattatgaatttaaacagactccctatctaagatttatagtagtagaaagtgtctctgattttagttcggactaaatcctaaaatttcttaaattttgaaaacaagagattaaattctactaaaaccgtggaaacataaaaggaaaagtaggccgagagcaaagctcggaaatttgtcttgtcagaaagggttgacacttcaccaaaagctagtagcaggcagctggctatcgatcagctacccatcaaatcaatatagagttccacattaaaattaaaaatttaaagaaattggaactatgtgatgaaaaagtttgaagtttaaatgcgtagaaaagttcgatatgacggaaaagttaaaagtttgaaggaaaaaatgttggaatcaagacagcgccgtaatcaaacggcgacgtcaatcaggcctggataggcatcgtcatgtcgccgtggcatcgatcgtcgtcgtgtgccgtgtcgtctccggcagacctcgccggaaagggacgcgagccactcgacgacaggcaccggtcgtctccgtctccgtcgcggtcgtcgccggccggccgtctctatccctccgactgttacacagaatgattcggccgtgcgtgccagctaagggcccgattagttctctaaatttttttccaaaaacatcacatcaaatctttggatacatgtataaagcattaaatatagataaaaaatgcatgaagcattaaatatagataaaaagaaaaactaattgcacagttatagggaaatcgcgagacgaatcttttaagcctaattagtccgtgattagccataagtgctacagtaacccacatgtgctaatgacggctcaattagtctcaaaagattcgtctcgcagtttccaggcgagttatgaaattaattttttcattcgtatccgaaaaccccttccaatatccggttaaatgttcaatgtgacacccaaaaaatttcttttccccaactaaacacaccctaagctagctagctagctgcaggtgacgtgaaaatttcagctatttggtactttggttttttaatggtcgtctttgagtatgcaccggtgtcgtcagccaatgacgccatcctgcattattttcgttatttactattattacagtttgaaagatgagctcatgcaccatgttggttcttgaatgcacaccgtaccagtgagtatactgtcaatatataatcttctaggaaaaaaatatttgacttaggtgtgttagattagtactcctatctttaaacattattgattagaggagtggtaaacagataaaaagaagttataaataaacctaataaaatcctatcaaaacgtagttacaaatacatatattaatttgggtagaaggatttgaactctaagaatataattgtgctccaacgcttttaataagaccactccttcaaaaagttaaactcgaaattcaatatattggacctcggaaaagaccgagggtgtcattacataggtggtacctattagggcacccacaatggttatctataggctctctacaaaagatctatgtcaacatattttcctacatggaagatattaaatgaagagagagagcaaaactatctactaacttagagatagtctatagagaaaaacgaggcaatgcatgagagagctatagatacccatgtagacatactattgaggtggtttactattaatctagtctattgctgagatgtacatgttttatagatagcaccttactttaccattgcgggtgctcttaggactcttttttggaggctacagttattcatagaatatccggcacctccaaacaatctagatttttatctagattatgagaaattatcgctgaaacataagctaaaaattgagttttccagcttctctatatacttatcagctggtacctatgccagctgttttgcagaatcttgaggctacgttcgttccccagctctagcacataaaatggagcgacccattaacacatgattaattgagtgttagttatttttctaaaaaatagattaataatatttttaaagtattttttttataaaaaaattttataaaaaaattgtaccgttagccgtttaggaagcgtgcgcacgaaaaaaagatggcgagttggaaaagcaaacaaaaaacatagcctacggctgcgtttggttggatccaaagtttggattttggttgaaattggagatgatgtgactgaaaagttgtgtgtgtatgacaggttgatgtgatggaaaatgactgaagtttggatccaaattttggatctaaacacagcctataaacgcttagaagtccggttgacttctcagacaggagaactggaagaacttgcccaaatcaactagaggaggggcttgactcctggtaattccttcgcttggaatctcaggaaggaaagagatgcccacgttttcaatggtacattcacctcggtgcaagcactggtcaacctcatcctgcaggaagccagggtcgaagcaggcgcgccggccacagcttaattggagacctccttacgccttcctccatgttatgcctgcctatatatgcagcttgttcattttcaagatcatggatcctatttttacttcactagttcactgttgtttgcgtctacacaccaggatttacaaaaccgtacggttatcacgataatcatgtcagtaccttagtttttgaaaccacagtatatcttacggttttcatagtaataaccacatgtttaccacgataaccgccaatccatagagtaacggtaaccccaccaaaaacggtttgagaaaccttggtacacactgctagtgactatataaaacgagataattatgggtgatgatatttattttaattagaagtttaggtgttttttgtgttctaaaaatatttatgtttgtattcgtgtccggttatatttgatccttatttttatttgagataattcatatttgttttcgtatatgaattattcatatttatttttgtatgtgaaaaaaaatacaaaaataaatatgatattagcattccatccgtatttgttctttttcattcctagctgcgggcggcctaatcgttattctcagcttctaatgtattcatggcaaagcttttgcgtactcgaaaaataaccagcttgtaaaaaataaaaacaataaaacgagcaagcatgtgtgtccccgtcatacatgcatcagaaaaaaggatgttcatattttagcacgaaagatggaagtcatttaagtggaaaaaacattttttttttgggttatggtggttcattgggccaaaaacaagcccaatgatgtgctaatcgggccaaggcctttgattgcaggtgatgaatgaaatttctaatgtatagtctagccaggtgattccaagaaatagctgatgagttttcaattgatgagaatgcgaaccagacgagggtgtttttactattattattattcacattttacggctgctgagtttcagaatctggaaatcagctatctcgtttgcttgctagctcaattatcaaccatatctaaattatgaaatataaagcttatattttaagttgatttcgaggtttttctatcgcattatatatttttattagtctttatgtcgctaaaaatatatatacaagtagacatacacattacagatgggttgtgtcgtagctaaaacacaacccacccttaccccctacccacccaggtgcgctttagcgcttccttatgtacatactttatatacaaacgtacatatgaaaaaaaaaaaggacgcattgcgcggagagtggcgcgtgactaggcaccggttcgcgtgactcttacattcgcgccaatagtagctaaactgtttgctaccaaaaatacatttggacaagcaaataacgatttttcatgcttatttatatatatggcaaaattagatcaggcaaaatatgttcccaagagctgacttgaaaagcaaaaccgagagcaagaattcatcagtgcacgtggcagctgcatgacatatactgcaattagttcataaaactgtgacactgcgattatatcttaattgtacaaagttataacaatacattgatcaaacataataaatacaacaattaaccacttaaaaaaggaggggaaactgcagaaacatattcagttcctcatccctgtcgccctgcttgtcctacgtaccctatatattttcaaggatacgtaccctatgtatgaaatacggtacatacatacgtatatacgtactgctgcactgtaggcctgtagctactggtacaacaaaaaaaatcaatggtaaattaattaatcacttagtaataagtaattaattagttactatgcttgatcgattaattagcttagctaattatcctttgctattagcttgcaatggatcgatatcgaatcgatcacggctcgagcttgacgaactcgtaatcgccttcctcccctttcttggaccccgacccgccgccggcttgctgctcgccgccggcctcgccgccgccggccttcctctgcgtgagcgcgacgccgccggcctcgcccttggggctgccggagtgggggctcgccgccgcgtggtcgccgccggcgtcgccgtgcttggatgaggacgccgccgccggcttcttcttgacgccggcgcgccagttcttgagcgccttggacgtctggtcgtcgaagattgactgcttcatcgttgaccccatctgaccgtgcacggacacgtgtcagtccagggatatgaccacgtggcaataatatttttttaaaggaagaacacttaaatataataggagtactcgctttgtttcatatttgcgatatgctttaactttttttaaactcctttaacaaaatttatacaaaaaaacgtagtagactgtaaatatataaatatattattaaaatatattcgatgttagatttaataaaattaatttgacgttacaaatattgctaatttttttaaaaaattgatcaaatttaaaaataagtttaatcaagaaaaaaaagttaaaacaatttataatataaaagggatggagtaatatacttgtgagacgagtgcatagagggggagagtgacatagctacacaagaactgaaccacaactctgcaggcacacaaaatcataatcaattttcagacgataaatcaaaaccaaattcaatgatcacaatatctacaaattctggatcgaaacttatcgttctgaaatgaaaagtttggtgttaattaattattacccgaggcagaggcgagcaaagacgaactctttggagtcattgaagcaggagtccatgccgtactcgtactacacaaacacacaacacagaagcagtgagacaagatcaatcaatctactgaagattttcatgaagcagaactgaagaaattcagtgagcaaagattgggtcaccagtatccagaggaagtagatgatctggaagccattctgcgcaaaacaagaagaagaatcaatcaaaggtcaggtatagtttatcactaattgcaatggtggatggtgacaattaattcatggagatcaatggagagagaaaaaatgattgattgagaccaacctggaagagggtgaaatggatgaggaagaggacgaaggttggtcggctgaaccagaagtaggagtcgctgacctgcaccagcggtatcccctggatcaccgcgtgccgctccgtgatgtcgatcgccatcctgcagatgatcccctgcagcttcgtccccaccgacaggatcgtctgccattttcacccaatatatcactcactcatcactgattcatcattcttcagttcagctcagcacaattcagttcagttcagggcagttttgtttacttcagctcagttcagtttaggattgaaatgtatatatgaacattgtactacttaccaccaatgtcatgatggaaattcagctaagtcagctcagtttagttcagttcagttaagttcagttcaggattgtggtgatgtatgaacattgtatacttaccaccactggcatgatggagatccaaagcatggtatgcaaccctggaacatatgaatgcagaggtcagtaattcatcaagtatatactcgaacaaatcaggcaagatcactgcatatttttagaaaaagcaagaaatgtgcagatcagggactgaccgctgacattgaggagcaggaagatgagagcagatgcccaaaggggagggctgcaataaacattcagaccaacaagaatatacttaattcgtgatggttcagtaccaagaaaaaaattgacagattgcaagatgagaatgtgattagcatttagcagcacacctgattccgacaatgaccttgaaatcgtcctcgagagaccgtttgatgtacttctggaaatcgaacttgctgccaggagctaaatgaacctgcaaaaacattattaaccactcaaaagcaagattatctgggatataatatgttttgcacgcagatgctgagagatcatccaagcttgtgttgtactcacgttgacgaagctgtgacgcaacgcgcagtagtcggccctcctgactgatctgaagaactgcctgaagaaattgctctgcatttgacgatcatcagagaggaaattcatgtcaaacgaactgaatttctcgtcttcttgtggcagttggtttttcttgtcagaaatggtgaaccgagctgacagatcgatcttacaatgtagaacgacgccggcgtcttgttcagcacgttcatgtgctgcctgacgaacgacgtctcgtgagtaaatctgaacttcgtcggatctgcaatgcaatgcatagagttaattatgcggaaagtagtattttctggtattttccgcacctactgtatgcatgtggtataaatagttaaataaaaatatgaaaaagtttgacaagatatattatgataatataagttaatatacaaactagaaaggtagcccgcgcacatgcgcgggcacgttgctgacaccttgtttaatgttgcttgaaattttatgaataatattaacacgtgggtgattttttttggtaatatttttttattatattctaaatctgtttttgtccataatttgtttaggattgctttgaatgttggtcatgattttcttctaactaccctatcaacatataaattctacactaaaactatttgaattcgtaaaatcttgagtttatgagaaaatatcgtgtcgtggaaatggagttgattcacatggacctatcatttgtactatatgtgtttttaatatttagtatatcttatttttggagtttctaaactttacgtaatatccttttcttgtgtactatagatatctttatggaatttaggatatttaatggaagaaactttctattaagatatatggtaagaggaaaattttatcaaattatgacaaatttatatttacttctgctacctccttttttcatatgcttactatgttcttggaaaaatgaatttaaaattgaaataagagagcaattatataaataaaatcagtatgtgtagagtatttataaataaaattgtaaatgacatttgttgaagttaggcgtttgtctatagcacttttggattttgtaatcctatttagtcgtaaatatttgtcaactgataacatatatataatgatatactttatattgtcatttgttatataattttcatgtctgtttggattacatgaaaagaatcaaaatgcgacctaaaatataattttattttataagttgaaatatattcaaaacagataataatatgatggtctaaacttcgttttcaattgtagagtgaatttagttatgcatgtttgtaaaagtgatatatgataaaataatatatgtcgccatttgtttgtcatatacgatgaaaagggtcaatatacgacccaaaaaacatttatttatttattataatttaaaatatgtcagcaccactttaagcctatctcaactattacattatatgtatgtaaaaattgtatgtgtaattttgaatttatagttgtttagaatttattatgataaaataacaaatattatctcaactactataaaaaaaattaaaggaaagggaagagaaggtgaggagggccggttgcgtgcatgcagtatgaagtgatattttttaagggttaattggatccatgccactacaaacatgccaatttagaaaaatgtcattattattcacgttattggctacgtgccactggaatttgagaaaattagaaccatgccactccatcacgttttccgtcaaaaatctccgttagccccaattgcacgtgggacctagctgtcagtttcatcttcacctccctcccctcttttctctttccccttcctctctctccaccactgtcgttgaccaccaccgtcgctgccgttgtcattgaccatctccgtgaagaccttgggagccactgccatcgccgctatcgttggccctatccgcggcgggaggcttgggagccggcgccgccgctgccgtctgtggcaggaggctcgggagcagccgtcctcaacgctatccacgtgggagggctcgggagcccctaccgccgtcactatactcgaccccatccgcgacgggagggctcggaacctgcagccaccgccgccgccgctatccttgacgccatccgcgtgggagggctcatgagccgccgccgccgtctctgtcctcgattggatccgcgatgggaggtctcaggtgccgccgccaccgccatccttgacgccattcgtaatatcgtgaatagtagtggtatttttctaaaatgacatatttgtagtggaagaaaatataagtgattttggttgaatgggatagcatagtactacgaatctaaatccatgtccatgcatccaacaaaaatttcttctattttgggacgggggaatatgtagtttctaattaacttctttttattttaatcttattaattagttttgtgtgttttatattgtctagtgtaaactacgtgttgttaatcacatggttttaaactctatgtgtttttccattaaaatgtatgttgagtggccaatagctggtccaaagcaatgtatttcttttacttgttaaatacagttaatttgggacttgcattataaattttgttataaatgatctaatagtatacatggataaaaaaaatagctacatatatatgatgtagatgttacagttgttaaaaaaaattttacaacaaaatatgtttcaatctaatagggcatgaaaatagaaaagaggagatgcacctgtcagttatgggcgtacgtatgtgcagtttgcttcacacgtacatgtacaggccctatgggccttttcttttattattaaagtaaatgcaatgaaggaaaatagtgggtcctttgttaaataatagaaattggtgggtccaccttatttaaaagtgccacgtgtcgaatcaagagcgtttgtaggaagacatgtggcagcttaggagtgtttttaggaagtttaatggacttttattagttagtatataatagatagaagatagatagatagataatagatagatagatagataatagatagaagatagatagatagatagatagatagatagatagatatgaagctacaaattctatctaaagtttacgaaataaaaataacagattttatctacattctgcggtgtcaatttttttttcttgaacgataaatcatatttgactatgtatgttaccatatacttctagcatcacaatcaatctaatcatttttatttttttctacaactattcatgtaataaataataggtgccattgcatctagttgtaaaaaatatatatccgttaattatgttagttaatcttcagagggtgaagaaataacaaaaaatgcaacatatcaaggcgtatatatgtatatatgtaccattagcgaactcgaaatcttggcccgcggcttctttttcccactctttccatccacgaatctgcagcagcgtcgccatgaacgcggctcgaagctattagccgggatcgccatgaaagaagaagaagaagaagaagaagaagaagaagagaagaagaagaagaagaagaagaagaagaagaagaagaagaagaaaaaagagagctttgccttggccctgccaagcgccatggtgatggcgctgtaggtgacgtggaagacggcgaggaagaagatgaagatgtgcagctggtgcagcgcgttgattgagatcagagacaccttcccctgcacaagttgacagcatccatggagcttgttaatcactacatccattttttacgtgtgacgtcgttggctcttcgcataacgtctaaccattcgttttatttaaaaaatagtatatatatatatacatatatgtgaaaatataaattaaaattatagtttttaatgatagaataagtcacaacaaaataaataaaattatataattttttaaataagacaaaatttgaaacgtcacattaacatcctttcgcaatcggtctcgcaggaggaggaggaggaagaagaagaaggaggaggaggaggaggaggttgtgaccgacatcggggcatttggttgccatcttggcctcggcgagcaaacggtggtgagggcgggagaaggcggcggtgaagggagggccgacgccgacgaggctgaagtgctcggccggcgtggcctcgtgttcgccgccggccggcgtggccccttgttcgccgccggccggcgtggccccgtgttcgccgccggccgtcgtggccccttgttcgccgccggccggcgtggccccgtgttcgccgccggccggggtggtcccgtgttcgcccccggccggcgtggccccgtgttcgccgccggcttccatggtggtggccccgtgttcgccgccggccggggtggccccgtgttcgcccccggccggcgtggccccgtgttcgccgccggcttccatggtggtggccccgtgttcgccgccggccggggtggccccgtgttcgcccccggcctccatggtggtggccccatggccgccggcgtcgccgtggtgacccttgccggtctcggcgtggatggtggaggccttgaggcggcacgggagcatggtgtcggcggccttctcagtgatgcagatcttgatgatgtagttctggccgaacacgagcagcagcgagatgaaccctagcaccatgagctctgtcttcaccttctccagcgcctccaccatcgccttcttcttccggtgcgagaagaactccccgatcttgtggagccccttctcgaggaggatggagatgagcacgatgacgccgcacacggaggcgacggcccatgtcggcgtctggtcgagctccctcgtgttgccgccgccgcctcccccgccgcccatggcctcccgcgccgcctagagctcaccgccgcgctcgccggtgggattggatggatcaaccaagaaagatcaaaccaaacgagggagacaaagaagaagaagaagaagatgatgaactggtgaagcaagcggagctaagctagatcaaagagaggaagaggaaggcgaggaggaggaggagagggggacggcaatggtggatggcaacggtgatcgatttgccaataatttcttggtcgcgtaggattagggcatgcatgcatgcatgcatgcgaggagtgatgaaggattgggaattttttcctatcaaaaaaaaaaaaaaaggattgggaatttttgaaggccgctattttggacgcacgcagcttttgcgcgcgaagcgtggagggtccgttaatccatttccgtttcagttttcccgcctaaaaatagccatggcatctcttctagcagtgctacttgtttaatagccagctggtgaatatcttttcgatgtcatatggaagatgaatgcgtgctatgcaatttttcattttaaactagatttttgaccttagatcgcaaagatcgcaaagaagttagttaattcattaaggttatgcttataccatgtagaaggttacatcggaacaattataatttatttcaagccatttgggttctttcttaatcttcacaaagaaagaaatttcgtaatggaaagatagaatgaaaaaaaagaaaaaaatctgagcacatattggcgatgtgaataatctgcatttaagaaaaatctctattttttttttggaaagttccattcgcagcttagttacaagcacggctatacaagttattgtcgtttatcaagctagtgccagttgtctgtgcatgcatatacacgcatacgagaatgcatgcatttgcttaatggaattgcaaattaatattcgacataaaacttaggagaaattatgttgaattttcggatggactttaagatccatgcaggctggacggggtaaaaatatgcaaagggcttttgtttaatggaattgctatttaacattcgataaatgtattttatgaaattttcctatattttcactatttttctttatttttccattcgatattcatattccctattttctttatttttctgacacaaacggttttcccatgttttttaatttgttccctataaatttttcatatttcttttccaaaattttcatgggccaacattgcacggttaccgtgcctaccagtatgtaccataatgggctatgctaatactgggactatatccttggtaggcagggttgttcatttggccttcttaagatatcatttattatgccactgtatagctgttaccaaactatgtgatgataaataacattgatgcttccgatactgaacggttgttcattttatttctaaaattaactctactaagttttgtcttaccgaaatgtggcaaagcaacaatctaaacattaccaaagattgcctcaactatgaatgtttggcaattataagatcttcctctcaaaaaacttattaaaggtattaaaccaaacaacccatatatctcaatcttattaaaaaaatgatatttcaaattttgaggctaccaaaattaacccttttaaattttggctttaggcatcaaagcgaacaaccctcgattatggcaactaacacatttttcagggcacttgtccaccacggattcgttgcttgcacacattcattgaggaagaagtctgaagctgaagtcttatactccctccatccctaaatatttgacgctattgacttttttaaacatgttcgatcgttcgtcttattaaaaaatttaagtaattattattattttcctatcatttgattcattgttaaatatacgtttgtgtataaatatagttttacatatttcacaaaagtttttgaataaaacgaatggtcaaacatattttaaaaagtcaatggcgtcaaatatttagggacggagggagtatatcctcgtatcagattgcatgtatgtggaacttgttcaaagcttctttttcttctgttctttggaaaaaaaaacaggtatgtataacacaaattgttatacacacacacttcttactaattctgatgtggcgtattatgattaaatctagcttttacataacttccaactacttgaattaaatggtcgagagctttagttagtaagattttttttaataatttgctagtacacatagtattttccatcatttgtttcaatagttcttcgatcaacgaatgagtgttggtcatcctcatccatgaatgagttaggcagaaatcctaatatgcgtatgtttttgtgggctgtgtcacacacatccagctcacgagagtccacgtgggggcttaaccttgacgcggtgctagcgtaccatgtatgtccgtgtgtgacatccaattttttttaagaagcgtgcatgcttgtagttttgcatatatctgaaactcaatatttttcaaaaaaattaaactaaaattagaacttaaaattgaaaaactttcgttcaaacgtagaaaactttcaattgaaaaatttaaactttcaactcaaaatttaaaactttcaactcaaaattttgaagcagggcgatgaaccctcaataatgagaatatattgtaaagtcaaaaattggatccaagaagataactaatataatacaatcatgatcaaatgtgcgcacgtgtgtgggaaatggatgtgtatgcggaaaggtggaagatggggttatgattcatttctgtgtgatcctcttccttgcactttatatggagaacatggttatttttatattattttttctctcttttttacattatgcgcgagaatattttatccttctcttgtaagcatttttatgaacatcattttttagctcatatctcacttggcatggatagttggagggacaatcatagacatgtgaagtttttatttggtggacagataatgtatgctgacttccggcatgtaagtttatcatatggtggtgaatggaatattttgataatcctcaagtgtaagcaaaataatgtgggtagaaggtatattcgttgctaacctccactgtggaggaagaacaaacttggtgcgtgtacgtgattttgatcatgaaagcataaaaagaatgaaagaattaaaaagggtctcaacaatttgactacactcgaaataataacaaggaacatatgcataaggtttgcagtatgatcgacgtatggcttgggtaggaataagacattaatgaggagcatgcaaagttataccatttttttcatttcataaaaattccctagaactcaacaaataggagtaaagttcctttcattaggctatctctcattcatcaattacttagatgatatgtgttcctatagatatgtgttcacaagcagtagctaacatgcgaggaataaaaattatgcaacgcatttccaggaaaatcatatactctagttgaagcatccaactccattgtaatcttgagtttaatttttttcagatattttctatggtgagaacagattaaactcaaaatttcagggagtttcagggaaaggatgcgcaaaccatcacttagtataaagtgtaatatgagggggctcagggatggtttggccgacgcggctgacccttccccagttccagtcatcttgctccttctcatgtatgttctgttagattaattggctaggcccaattaaatcctaataaattccattgcctcacattaagtgtgacggagcgtgaggctcctcaccgggagaccgcgcaggccccccttttgccggttcggccggggaccctgggtgaggttctaagctcctagtctgtggaaggttcgcgagaatggaagaagcacaagacacgggcgatgtatacaggatcgggccgctgagaagcgtaataccctactcctgtgttctggtggatctgtgtatgaagaagctacaaagagccggagagtcagagagcttttactctagaaaccctctcctctggttcccaatccagcctcgatcgttctggatcccctttctcagtgcgcaaggtcctccttttatacctcaaggggataccacatgcaccatctctctcttttgtgtggggacttatcctatctttactcaaacttgacttctcttcataaatggacggagatttgtaatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcatgttcgcccttcttcatacaatatcttgcttgtaatggttaggatgaagcctggcatatatctgaccgggaccaacgtgccatctccaggaggtaacacgccggctccggctagggacgagtgcttggaggctctcatcctgacgggatggggcgaggcgtgtgtcagaccgcctgtcgccacctaacccacgatttgatcggtctgtgactggtcacagaccggataaacgagcgcgctgcactgcgttacatacggcgtgacgcgctcgtccaaaccgcaataaatgcggttaggtgagccccgctgcgctcacctaacccatacacgcggcgcaaaacctacaaggggtcggggcgcctcagccctcggggccgaaacgggagcggtccgacccctcggggagacaaagaggggggcggccacatcaccctagggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctcctcagttgggcagaaacccaacggtcgccaatcacgcacatcggcaatggtaactcgactgtcaataatgagcggcctcttcaaggctgccacattactcgagtagcacatgaatcgggatgagccggttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacaacgttggcaagggtataaagacaccgaggaagagatttacttccttcctctcgccattattccccttgtcttcgccgcttgcgccctaactccttgtttcctgtgccctaccttcgccacacgcgctcgctctcaaacatctcttcttccggcgtcatggcacggggctccgctccgctcgatggtagcgtgctgccgccttcccgcatcgtgagcgagaggcaggccgggctgccgcgccgcttcatgcaggaatctgccaccggccgggagatagtcatgctgggcgagggacgcccggcgccacgctacccggggcggtccgtcttcttcctcccttttgcaatggcagggctggttccgccattttcttctttcttcatggatgttctggagttttacgatctccagatggcgcacctcacccccaatgcggtaatgactttggccatcttcgcgcacctgtgcgagatgttcatcggggtgcgcctatcccttcggctgtttcggtggttcttcaccgtacagccggtgtcgccgtcgtcggtggttggtggttgctactttcagccgcgggggccggtgctgaaccgctacattccctgcgtcctccgcaagaagtgggatgactggaagagcgactggttctacaccccccttgccgacgaagcgcgcctccgacttccgagccagcccccagcgcaggcctccaactggcgggcgccggtagatctgggagatggctacgacgccgtcctcgaccgcctggcgggcctgcgatccgaggggctcacaggggccatggtgtacggcgactaccttcgtcgccggatcgcgccactccagcggcgcgcccggggcgcctgggagtacaccgggtccgaggactgcatgaggacccaccagggggtcaaatgggactgggctcctgaggacttcaagatagtagtccaacgggtgctgaatctcagctccgtggaggcatccctcattccgcaaggagtcctccccctctgcagtgatccagatcgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcagccgccctgccgacgcccgggggaagaagaagcaggaaggaacccctcccccatctcctccccaagggggcggggcggcgcgtgccagcagcaggcgcccggagggggccacgccgacgtcgcagcccgagggggagcaaaagaagaagcggctccgcaagatgggggggacagaaccatcccggggaaaccttatttcccctccaaggtggtcgtttaaccgaccccctcgcaggttcgtcccacgcccgtcgtggctgtattcattctctcaacgcgagttttcactcacccatcttgttcgtcttctggtctttcttctgtttcagcgagatcccgtcgcgtccctcccgccattccaagtccggccagtctgaggccgaggatccggcgaccgcagaggcccggaggcgggaatctgaccggcgagaagccacggatcgcctacgggaagccgaggaggccgctcgggaggccgcccgggctcgccaggccgaggaagccgctcgggaggaggccggactccgccaggccgaggcgacgacatcctccgaggtgacccgtgaaactgaccggcaagaggccgcagatcgccttcgggaagctgaggaagctgcccagatggccgtccgagctcgccaagctgaagaagccgctcgggaggaggccagacttcgccaggccgaggcgacgacgacttccgaggcagctcgcgacgaggccgcgggcgcatcgcttgggcccactccctcgtgcgacgctcaggacaagccaggtccgggggacatccccgagtccggcacgtccatcggcgggccgagccgcgcggcatcctctccgaggcggctcttccccacgccttccgttgccccactgagtgccgagccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgcctcagagctcgaagcccgtcggaaggtgttggcggagatcgccagggaggtggaggaggagcggggggctgccctcatcgccactaccgtgatgaacgaggcgcaggacaccctccgccttcaatacgggagccgggaggcggagctagggaagaagctcgacgccgcccggggggtccttgacgctgccgctgcccgagaacagcgggcggcggagaccgaggtggcatcccggcggcgcgaagaagcccttgaggcccgtgccatggcgctggaagagcgtgcctgcgtcgtggagagggacctggcggaccgcgaggccgccgtctccatccgggaggcaacgctggcggcgcacgaggccgtctgcgccgaagaggagtccgcactccgcctccgcgaggatgcgctcaccgagcgggagcgagctctcgaggaggccgaggccgcggcgcaacggctggcggacagcctgtccctccgcgaggcagcgcgggaggagcaggcgcgccgtaatctggaaggtgccagcgccgagagggccgcactgaaccagcgggccgctgaactcgaggcgcaggcaaaggagctggacgcgagggcgcgcagcggcggggcggccgcgggcgaaagcgacttagccacccgcctcgcagctgccgaacacaccatcgccgatcagcagggcgctctagactcgtccgccggggaggtcgaggccctccgcttggcaggcgaggtagggcccggcatgcttcgggacgccgtctcccgtctagaccacgccggccggtaggcaggcctctggggcgggaggaccgcaaagtacgccgccaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggatcccgacttctccccatggacggcgctggacgagttccctcccgggaccgaggacggcgcgcgcgcgcaggtccgggacgccgccgaccacatcgtccacagcttcgagggttcggcccctcggctcgcgttcgccctcaactccgacgaggaggacgatgacggcggagtgggcggcagtggcgacgaggctggcgacccgggtgcatcggattgagcccccaggcccccgccaatctttaaatagtttcttcttccgaggccttcgggcccccttcttgtatagactaatttaatctgcaatcaaataaagaggaaatttttgtgtcaattctatttgttgtgtgtatgagacgaggatggtctgtgccgcagtccttttgtgtcttggcttgaacaagggctcgtgcccaggtcccagtcctcaaatggctcgggtcggggctagtgcctggggagatccacatgtcgagactggccaggccgggagcgtggtgaccgagggttatgggtgacccgattgtgggtttttgccgattcccccccggatgtcgcgtcccaaatcggctctaaaaattcatcctcaaaattgtgccaaagaataagtaaaatacaatgtgaaagcctccaacaattaaaatgtgcaaagataaaagtcaaatgaggcttggaggatttttgtatatttcctaaaagcctaaaatgcttaaataaattttagtggaattttcagagcacaaatgataattgaaaagaaataaacaaagttaaaaaggtttataaaaagaaaaccctaaaagaagttctctttcccccccccttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccgtccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgtcgtcgctccgctcttcctcccggctcggcgacccctccgtaggcttcgccgcatcgtcgccgaccccgtccgccgctccgcttcgcccgtcgactgccggagcaccgtcgtcatcgtcatcccgagccgcgccgccgtcttcctccgctccggccgccgctctcgtcgtcgtcgttgtcccggggtgagccgaagaccgccgttcgccttcccccttccctcctctctctcgggcgccgctccgccgcgccggtggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatgggatttttaattgaaaattaaatgaagaaattcgcaaatatccatttaaagagcatataagcttcaaatggccatatcttggccatttgaactcggaattggaccgttcaagtctctaatttttccttaagatgtaaagaacccatttttgtgctttgtttctgctgttatgtggagttattttgtgttaaggcctttttcttttccgttggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgttattgttattattattaccttgttcaccctagacaaacaaaaccccaactagtggacactctactcatggtatccctagtataattttaggtagatgcttcgcaatctaattaggtaaccttaggtggttttacaactatagactttgggaaatattcatatcacctggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgctaggggctcagttccgtctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttacaattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtatagttctaagatcgtgtttacaaaatggcctggagcaactaaatgtcttaaaatgctgttttctgcaactctaaccctttatattataattcccttgtactcccttgcatttattatgcattcgtgggtgtgtcttgttgagtacggtggttgtactcagtcttgcttaattttcccaagcccagatgaggagttccctgaagatgaaggcttcggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgaattgtatcaacttttggtgtaccttgcctcctgggacaaggaataatacacgcacgtcaggaacgcctgttgggtgatttccggtcgtgacattgcacctttaactgactcagactaggctgcggtggttgaggatggggcttcagttctagaacttcttatcattcatatctttggcgtcaacctcataccagttaccaccttcgtgacatgcgtcgacatcagctttgtcattactaggatatcatgtttggcaacttgcccctaactgcctcatattagctttcctggtctccgggtgctagctacttctgctattcgatttgagggtcgataactttgcctttgaattatgcttcccaagagaaccaatttatcccacttgacatgctttgacgtcttcccgaatgactttgctgctggacttgttattgtctggtcgtgatcctgccagatctgaagcttcgttgttagaggtgattttaatctgacctctgtagactatcttcgaacatatcacttggttcatcactgggaatagctcccacgaacaagcaactcagattcactttctttatgttcagtttactttccgctattctcttcatgttgtcatcatttagcattcaacgtattcctgtgcaccttcagccttgatgtgttctttcccatgggatcatctcccaagacatggcgttgcctggtaaccggggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcttgctatctgtatctatgccactagggtttagtgcttcctcgagatggggagcatccatattgttcttctgccatatcacctttgacccttttctgatacctgatcgactaattaccaaccatcgactattatgttctcaaatattgatgtctcctggatcttcttaactgtttgcaggtatatccgaacttatcaatgtagaggcatggcgggtacccttatgggtttcatccaacaatccttatcttgatctgtaacaggcgtatccaaactcctattccccaactactgtctcattggcttttttttttttttttttttttaacccaatacagtttaattggttttcttttccatcaacaggttggttattaactcgaggttagaacatagttcctctgaaatgagaccctaggtctcctttatcagtaagcaattatacacataatcacatatccgcatcttccaaaagaatcctcatggaacttgtctgtattacacatttctcccacattacatgaatacgaggcactgccttaaacaaaaagggacggtgcttaacatcggtacattgtatcctcaatatgaatcatccataagcatagcaagctcactgtttatagacatgaatatatttatgtattacatgattgctgcaaactttcgattacaccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttttgcttggtatcgccctccggaggtcgattgccctttgcttggcctggagtaggtcggggagagacacaacttcttccatggacgacaattctttgctggggctgtcggtgcagagaatggttagtgctgaaggtattattgccatgatttattgcagagttaggtggagcaagaggagcattggtgctgtggatgatatcatcgatgttgttgttggagctgactagctgacgagacaatcgtagggtcgttcgttggatttctgcggtcttggtcaacaacacactgagttggcaatccttgggcacatggtttgttccttcgcacagaaaacatgtcaccttgcgagtgggacactcccctggtggatggtcttcttcatagggagtgcagagtgtgagacacatgctagcaacgtgtccaatttctccacaacgggtgcatgcctttgatccgaagaagacacatctgaaactcttagtccaaacaaatgtctcttgggttgatcacttgattttcttcgccatcaatcgcgaggttatttgattcataatagattatgagcttacggaaatgagaccctgggtctccctaatcagcaacaaagtgtacacaactcaccgcacttgcaatcttaacatggatccttcataaacttatcaaactccttcataatctcatgtttctctgttattacatgattgacggggaacaactataaaacataagtatatgattactgatataagagtattatggttgcttctgactagagctaggcttaacaggtactgcatttgctccagcgaccacttggcgatgggcatgtccgcttccttaacaggtaccacagttgtaacagacaataactttctcgcgctcgggttcttcatcttgtacttgatttcttggctgctgtgctggaacatccaaaggtacgatgccgatactggcctctgtcttgtcaactgctggctggggctgaaattgagcattgacaccttgtggtaatgcgcctgctggagttggagctgttgcaacgcgggctataggactgcttcgggatgcatggatgacaattcgctgaggagcaagcttctgattgcagggagttgtgtggactgacgtgctggcagctatgtttctcagttttgggcacttgtcggcgaaatgacccattccttgacaattgaagcaacagatatcttcccggactcggcattttcttttctcattttgattcctctgtcctggcactggttttaagctgagactgtaatcttggcgaggattggtgttgccttgaggcttctctccgttggaactggcgggttggttagccatcttcttcgtcagcagaaaactgaattgacaattttttggtacatgatcagttccttcacaaaagaaacaagtgatcctgctcgttggacacctgtcgggtggatggtcttcctcacaatgaacgcatatagtggcacacgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgccttgtcattcctggtggaggccattctgtgctggtaatagtcatcttacgtacttcttcttcagttcgcatcggtgcttttctcttttgattcttactcttcttgcctttggcttgcttagtacgtgaccccacgtggtacgaaaggctaggaggaaagcattttctaggattcaatggattgtctccattgggctcttcactttgcacactaggctgcaagcttgacttggtgcgaggaggctggtttagcgatgtctgccctgctgaaccaaaggaaggggcttctttgacatatacccatggacaattcagggcatagtgtccttgctctctacaatcgtgacaaaaggggacatcctcttctagcattggaagctcattgacctgggtggcaaacgctcgatcaaacacatactgattttggtcttgacttccaactaatggtagctgtgaactaagcagcatgcttggaatggaccgagggtgtgcccttgttaactctcttgaggccagtggcggattgagttgaaaacttgagttactggaggcatacccgctgacattctttcctttttctctgttaaacatctgttacagggattgaggtgagagaggaaaccaaccaggaaagaatagaccagaactagagacaggaccttaaaggaactaactctttttgttgatgtgttgtttgttttgcttattctgcaagttgattaagcaaacaacctagcatggttacatcacaacccactgatgcaaaccacgcgctacacacacaagcaaggaacacacgactaacaacactaccctatagggtggcttaggttctacgacgggttctccaagatcttcactcctgcttcacagctggcttcactgcttcctttgcttcgctagcggatcctgcagtcttccggagcttcggcaaacaactgacgatgtcttcttcttcacaaagctgaccaactagtactaattgaaatttgaagaaggaagaaaagggtaaaccttttgcaaatagcattaggggaaggagaaaaagaggaactttcgcaaatagttttatttataaaatatgtccttaggttttatccacttggcttatcctacagtcgagatggctctgataccagcttgtcg

SEQ ID NO: 41700 - DNA, 6704 bp, Oryza sativa
atgtggaatggttggcctgggttggcttaggacgagctgggacccagggtcgggttgccagttcggtctgaatcatcataggccttgggttaaggcaggttcgtgtgggttcacggccttgattaataatattgtatagttctaagatcgtgtttacaaaatggcctggagcaactaaatgtcttaaaatgctgttttctgcaactctaaccctttatattataattcccttgtactcccttgcatttattatgcattcgtgggtgtgtcttgttgagtacggtggttgtactcagtcttgcttaattttcccaagcccagatgaggagttccctgaagatgaaggcttcggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgaattgtatcaacttttggtgtaccttgcctcctgggacaaggaataatacacgcacgtcaggaacgcctgttgggtgatttccggtcgtgacaccggagttcaccacgccccggggcacggctcggttctgggccccttttggcgatttaagccgacccgagcccctgagggcaggattgagcacgagtgacctatttcaagtcaagattcttcaaaaggaaataacagcacagatacagcctttaggaaattgaaaatgcttttattgaaatacagatataagagaaataaaaatatgcatgtgtggtagcccccggccaaccctgcacgcccgaggggggtgcggggttggcccgagcccgaaacctgacacccgatcccccttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcagagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttccggtgtgggcgggtgaggcgaagcagagcttgatgcccatgtcttcgcagtagtcaccgaaaagctcactagtgaattgggtgccgttatccgtaataatacggttaggcactccaaactgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccagaatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaatgtgcgcgaggcggagtgggctccgcattcgccttcatggatatcagcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggctggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgctgtacttggcgcacgtaagcgtccatctgcgggtcagagcaccggtactccttacagacctggttaacgaccagctgggagtcgcctaataccaggaggcggcggatccccagtccagctgccaccctgagtcccgcaaggagtctctcgtactctgccatattattggtcgcccgaaagtcaaggcgaaccaggtatctgaggacgtctccactcggcgaggtcaacgtgacccccgcaccggcgccctgaagagacagggagccgtcaaactgcatcacccagtaggcggtgtgaggcagctgcgaggggcccgagttggcctcgggaatggagacgggctcgggagctggggtccactctgccacaaagtcggcgagggcctggctcttgatagcgtggcgtggttcaaagtgcaaatcgaactcggaaagttcgattgcccatttcaccacccgtccagtaccctctcgattatgcaagatttggccgagggggttgtcgcgaccgggaaaattgccttttcccgaacgctagtgtattaatccccgtcccaggaaaagccggggtacaccatacaaacatgatataaaagacacctctttattaaatcgataatatttacattattacaaaggcatttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggcggatgcatgattaatgcaagggggtacaaggggataataatataggggttaagttttgcagtaaaccgcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaccccatcctagccataaacaagagtaccgacccaatcctcctacggccgggacacccgggacaggcaggcaggactgagccccctagcagcagggcaccaaccctctgccatgacatctcgactaccgggccgcagctcgtgtagccttcatttgccctggagaatgtccatcgacccctgacttcatccatctccaatccgtgtacttttgtttataaccagactgagccacaaactaagccttacccactagacatgtggaagtacggtagtgctttgcaacagaggcccaagcttaatccttatagtacccgaggtacgactaacaaaacccaaccacgcacctcgagcctagcctaaaccattttgggggttttgaaaagagggggaggtgtgtgtccaattccaacataagccaaccattccatagtgtccaaatgataagagaattcccaaagtctaaagttataaaaccacctaatgttgcctaattaatcagcgaagcatctacctaaatttatactagtggaaccatgaatataatgtccactagttagggttttgtttattctagggtgaacaaggtaataataacaatagcaataataatgtcttaacaaaggtgaataggcatggctaaataaaacagtgataacgcgggaatttaaataaagcggtaatgcaataatttaaattaaaaataattttgtaaactgggattcaatatgctcaaggatgatgtgacttgccttgctcgctttcccaaccgacggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacttggcagccgcgagggcgcgcccgaaggcggcctcgccggcacggccgacgggagcggcgcgcccgcgccccgatggtcaccgccggcgaccaccggcgcggcggagcggcgcccgagagagcggagaggagagggaagcgaaagggcggtcctcggctcaccccgggacaacgaggacggcggaaacgacggccgaagcggaggaaggcggcggcgcggttcgggatgacgagggcgacggagctccggcggtcggcgggcgaagcgaaggggcggacggggtcggcgacaacgcggcgaagccgatggaggtggcgccgagtcgggagggagcccggagcgacgtcggcggcgtaccggaggtcggcggcgacggcggagagagaggtggacgtcgcgagcacgaatccgacggcgagagcaagcggcgaacggcggaaacggaggagggaggcacggggagcaaatatatagcgccgagagggggagagcgcggccggagagggaggaaacgggcgcggagatctcggccgcccttgaagacgccggcgaaacttgcgggattaactccgaacgaatccgagggagagagagagggaaaagcgggggaaacgggagagggaatcgcggggaatgattcccccctcattatggcgcgcggggacggcgggatgcggcggaatccgcggcggcggcggcgctagggcacgggcgggcggcgggagcggcgggaggaaggcgatgacaggtgggccccacccgtcagcgagggcggcgggcgggcccgcctgtcagcggcgcgcgcgcggggggaggccgatgggccgcgggggagaggagagagagggagagaagtgggccgagccggcccaagaagggaaggggggaaaagaagacttcttttagggttttctttttataaaaccttttcaactttgtttatttcttctcaattattatttgtgctctgaaaattccactaaaatttgggggctccttttagaccaaggagaatttaacaaaaattctccgggccacatttgaatttttcttgtacgtattttagtgtttgccaatttctttttgaattttaattaattctattattccttttagagaatgatttttaattcgggatgaatttatcaggacgtgacaaatccaccccccttacaagaatctcgtccccgagattcgaggaggctagcaagaagataggttgggcggtcttctcttcttgtctgacttcttccgctctgtcttctataacaaacttgtctaactaaacttctccactctggactgcttggctcgatctcctgttgcagatgaaatcttctcttcacccgacttgtccctggttgcatgtcgcgtcccaaatcggctctaaaaattcatcctcaaaattgtgccaaagaataagtaaaatacaatgtgaaagcctccaacaattaaaatgtgcaaagataaaagtcaaatgaggcttggaggatttttgtatatttcctaaaagcctaaaatgcttaaataaattttagtggaattttcagagcacaaatgataattgaaaagaaataaacaaagttaaaaaggtttataaaaagaaaaccctaaaagaagttctctttcccccccccttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctaacgccgccgccg

SEQ ID NO: 41701 - DNA, 14518 bp, Oryza sativa
cctcacctaatttatcgttattattaaaaaagtatttgaattgatttgtaaattatcagaattgatttgtaagggaccaaataattaaatttctgtttgcatgcagtcatatggaaatctgcgactttggctgaggtggtgagaattatttctgcatgattttggactactcgatcagtcacaagtcacaacgtaccttgctagttaggaaaactagtcttgccattttatttgtctttttgagagatcattactaatttggacgcataaatccagacaaaaccacaagcatatgcctttgttttctctgcaaacgctcgaatatgcatgtagtggcaccttaaagcaatggcacgtgtacgtgtaatgaacgtgctaacgaaaattttggcttttaaaggccctccttgtaatgttagaaaattttcttgatcctatgaacacgtcgtctctgcttgttgattatcagccctagtattctattgaaatccagtatgagaaaaaaaaatgagccacatcatcaggtaatattaattagttattggattcactagaagataaaagaggatgaattaatcttgaatggattagatggatggtataaaatttgaattaatcttgaatagattagatggatggtataaaatttattaaggtttccggagatttacgaagctattggaaaggattagctagatggatggtaaaattcaagactttcgaatatgcatgaagttattgaaagaaagaaaagaaaagaaaaaagataaagaataagcacaagaagagatcatgtggtgcatataattttaggatctacacgtacagtaaaaactgttttacaaataaaccctcgtcacattccttccaaagaaacaggcagccataatcgcctaattttttagaatgatttcgtaatgatttttttataggtttattaatttcacatgaatttaaaatacaaataacctattttcttacaaaacccaaaaaatatatgtgcatgatctataaaagcatatgcaccaacagaaaataagaggatggtgagaaggcaaacgataatatagtgactcgtacaaatataaagtttgcactgcatattaagccatttataataccatcataatatcatttatcctagccaacgttctcttccgatcaacgagagaagtccaatatagaaagattgccacttccacgtaaacaagatgtttatagtcgtgccattgcgcgatattataggctagtaattttgaattttaaaaacatgattttaaatttatttaaggttttctttcaatatagcttacttttatgcatttgcttttggaccccgaataatgtagatgcaaaaaaaatacatgtaaactatttttatttggttcattcatatctttgcagattatcattataactcaaccaatcaaaaatagattcatgtatttcaaagaaaatataaaaacaataaccatggtaacaaatatggacatgttcagtaaatgggttataaaaggtgggattgtgatagggtaatgaacagagggttgggatgaaattaagcatgaaaaatgaatggccagtacttaaatatacccttcagtgggtgtgatattatttcctaaacctctttgccaaccaaacactatgccccaattacaccgacaccaggctcagattgaaacagactattcagcaggttatctatttaattatagggttaaattaaagattttttaaactaaacttcataaataacttagaacaatgattcaaacaatgtcataaaagaaatatttttttgagatgatatatttttagaggcataaaccaatgattcactaatgatctaatgaagtagtcggaaaaaatcaggaccctttaaaataaaaaaaaagattgttgtggtacgagcaaacgcatcaagtgcagctcagggatgcgtcgacatcaaacgatagtggaattgacatgtgacgtatctcccaaagcaaagattagctaaaggtccatggatttgacaggtgacgcatctccgaaccttcggatcaaagccaagctcgccatcccagaaagatccgggaagccaagccaagaaagccagccacctcgcgtttctcaggccacatggctgcatataaattgcgagcctcgccgccctgaccatttatccattaccatcacagaagaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgtaagaaggtatttttggtgttggatatattgattgattgatggattaaaattggtactgaattgtttttgtttgatttgattttattaggatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaaggtacacgaatattgacgtcactgccactatgcccatttggctatcaatcttaattaattagtaccacaagtttaatcactagcttaattactggcgttctggccaatcaaagttttataatcaccttttctgaaatatcatctgttcagggttaaaaattttagaatgcaaaaaaattgcggagattttgaactgaattttcagacaaattttgtaatttgaacaggttttcactttacttgaaccgaatttgagaaaattcaatcaaattcagagtgtttggtcggtattacttcctaccgggactcactgatagacccaaattgaatttcattctgaaaactgtaaaccttaggagtgcttcggacgaaatttcgttccaaattaaatttgcattggatgatgaaattcatcaatctccctgtcaattttttcagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctattcggcaggcggctcgctgctcttctgaggctgatgagtttgtctagtactagacacgcccgggagctctagctaggatagaaaactagagaaagtttaattatacctgaattttaattaatcacctcacaaaactctgatgtatcatattatatcgtgatagtgactgcttgttaatttaattttgccgatcgatgtgatcttcggttcgtgtgttcatgacttaacgtcttcatgtatgtttttagcagaaagatcaactgctggttttaatatacaatttttaggaattttaccccgtaaggtcgaataccattacttcataatttagtgggatcattttcataaattttaatgaattggcatgtaaaaaccaagagttgtaatgatgtttgtgaaaaagttatagggttaagtgaccccaaagcctcatacatagctccaccactgactgagcattttcttttctttcgcttgctgaagtgatccactttctgagcgccgcattccaaatacaatagatcaatggacacaaatgtacgatatttgttaataagattagccaaaccctatacatctggcgtactaattatgtctacatctctcttaatatacgcacaactacaatataccaatgacccacaacaaactagtttcatcgatcgcttcctcgcctatgttacagcaaatgcggcggttatctcaggtggttctctttattttaaaaggggctaggatattagaatattagaagttaactctatttatatctttaatacctattacaactttaaaacctattgatagccaactttatatagtagatatatttaacataaacttaacaaagttcaccgttttgcaatgaaatttataaaatgtcaggtctatctcactgtaggaaaaacaagttcaccgcctctagccagaattttagaatttatttgaattcaacaaattaaaatgtttgaaatcagtgaaaacatgtttaaagtttaaaactcttcattcaaaaatttatgtccctttctcctgatttgtttttcgttcgcaatgtaaagccttgttgtctctgagcaccatttcaacaagtaacaagtcattaactggtaactacaagtacccttgacccagcaaatgagctaattagccggtctgttattttcttcctttagtccaaatcgccagcaggcaaattaaaccggttgaattcccagtcaaaatacgagacctgcatgatcgatgataggcaggaaaagactcgtgtaacgtactcctatcattctccgaagtttctatactccttaatctctcgcttgtctatcttatcaatcaaatgaacaccactctttaacatcgaatattcatttgaaaaataacaatccctgaaatggttccatcaggaactaacttattatttggcaaccatacattacatgttccttatgggaccaagaatagtatgtgttggactttggaatgttcttttttgttaattactccattgtggcaagaattgaaatagtttttagtgatattatattggttcatgtcttaaatggattctaatttgcttgtcatgttacgaaagtatggacatgaaatttgcaggaaaaaaactaaggatggcaacgggggtgagggcgggttgtaggcagagctgcaatggagttcagggcctgtctggtacagctccaactccaactccacccctcctagagttggagctcagccaaacagtttcagctccatcaaaactgggagtggagctggatggagctctctcataaaatgaactagagttgtgtagctgggtttaggcagctccacaactccactccagacccaactcctggagctaaatttaggagttagagctgtaccaaacaggcctagaatcttggtgtttgctagagctattgcagggcaaggataaacaaatatgggtgggaactcaccataaacaagcattggttcgaggtcaattggccaccttcactcgcaggagcaccttctccctatcgtgccatctatctcagctctgggacttctgtccgcccacgaatccatgatcaccatccacaggcacggtgagagtaggagttgatttggtgggagtcaaaatggaggtatactgtagcagaatggtctaaaaaaaatatttctactagcgtgaatggccgtatcaacacccgagctgcgtcatctacactttgaatcttgggtaatacaatagatcaaaattaagaactgtggagattatgggtaccccatacccacacggcatggttatccgactagttataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctatagggggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggttgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccagctggccttcgccgccgccgactggtgtttccgcctgcacggctggcctattatgccgccgctgttgggcgtctacgacttcaccaccggcctgcctccatcgccgccgactggtgtccccgcctatacggtcggttggtcacaccaccgttgatgggcatcgtcatctacactgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgttgttggatgtctacatcttcaccgttggctcaccttcgttgccgtcgactggtgtttccgcttacacggctggcctattctgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggttcgttggatggaccgagtaacgcaaggtgctaagtattattcggaataaatcaaaagcatagagatgagataaatttattttctgctcttaataattgcaaaagtacctgagtagtaaattctgatccgtgaaactgtgttccattaatgacgaactcatgtcactcatatgcatgtttgggaaatgcctaggccgactcccgatgcttgggggcaatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttatactccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcgtcaccgaccggccgccgcatccgccgctgactggtgtcaccgcctgcacggctggcctgttataacgccaactgatgctatcttcttcacggctagctacatcgctgtcactactaataggcatcagtatcttcaacacaagctgcctacgtttgccatggctgccgactggtgtttccgcctgcacgctggcctattatgccactgttgatgggcgtctacgtcttcaccgaccggcttgccttcgccgccgccgactggtgtctccgtctgcacggctggcctattatgccgtcgttgttgggcgtctacgactccaccaccggcctgcctccatcgtcgccgactggtgtttccgcctgcacgctggcctattatgccaccgttgatgggcgtctgcgtcttcaccgaccggcttgccttcgccgccaccgactggtgtctccgtctgcacggctggcctattatgctgtcgttgttgggcgtctacgactccaccaccggcctgcctccatcgccgccgactggtgtttccgtctgcacggctggcctattatgccgtcgttgttgggcgtctacgactccaccaccggcctgcctccatcgtcgccgactggtgtttccgcctgcacgctggcctattatgccaccgttgatgggcgtctgcgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcgaccggccgcctcgtccgccgccgactggtgtcaccgcctacacggctggcctattatgccgccgttgttgggcatctacatcttcatcgccggtcgtctcgtctgctgctgactagtgcccttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaggcaatgactattcgacgacaagaagctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgcttcagaacagacattctacttcaacaacatcaaatattttgatttagacgagttggacaacagcatcaactctcctccaagtgaagcatctacaacagctataacattaatttgatggattattgtcactgacatcatcaccagcacctttgcttcatcggccctgacatctccgctgttgctaatggatgattatgtcttcaccgacttattatttcaccttcacggttgacctactatgcaaatgctgatgagcgtctttggcattatcattggttgctacactgctattggcttgatcaccgacatcgtcatcttcatcatatcggttgcgtttgtcgtcgtcaagtatgaggctaggtcttcatgattggtggatttcgtcatcgcctttgatttgcctcgtctgtcaccgactgattatttcgctgccatagctacacaactttatcgctgagcgccttcatattcattgctggctgatctgactgctgccgactggtttcttcgcctccacggctgtgcaacttcatcacttttgattggtatcactatcttcactaccaccaatatttttgccacctctgctgggcaatattatctctgtattggtcgtcttgtctctatgccaattgcgtcagctaccatcaatgaacaattgtgactacgtgctcaggggcttactagctcaaacacaagtatcataccttcaatttggacttgctctggatacatgcaatatggattcatgatcatgggtctattttctatgtttaaagactggactatttattattccccgtaagggttatcaaccgaatacttgcgccagtcgggattcaatttttatatctattttggagtattccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttagcctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattattgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggtttgagagaagattatcttttcgactgtgaaggtctcaggggctactgtggagattatgggtaccccatacccacacggcatggttatccgactagttataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaagccctctaggggcatgagacaacctgatcgtcagatcaatacaccctcggcggattcaaatccccaaacaggagtagggtattacctctcattgaagggcctgaacctgtctaaatcctttgtctccacatccatccacttttaggtctcgtgcgctaccccgttttattattgccgaattcatgtttcgacaagaacataggtttgaactttacaagtgttcatgtgcctagatgaaaccaagttcaagtacgtatcatgtattttactttgattgtaaaaaaaaattacaattaacacagtggtgtgattggatcctaaattaaataagggttaatttgatatgtgccattgtaaatatgtcaattcagataaatgctattaccattcatctatccgtatcacgtcattcgaattcgcacaaaattataaccgtaccatcaccgtcacgttttccatcatcatcatagaccaaaatatcccttgacgtgggacccacatatcagttccatctttccaccattcttccatcttttttcctcatcttcttttttcctttttctctcgatctttgtctcgctcatctctcctcctccgttgctcacacgtggcatggcaccaccgtgcctcccagtcagcactggtgataccgctgctccacctcacgtcggccgctgctacctttctccacgcctcatctactgtctcagtgtccacttcgatcgtctccatgcctctgcactctcctttgcaccgtgcaccgctcaccgctgacttcgtggcctcgaaacctccttgcatcggcgctctgctcatccccaggctgtgccgtgccaggtccaccactgcttttggatctgccagaccatgtcggatgccatcacttcacggccgatgctgccatttgctccaccaccgtcgacgctacctcttgctcgagctccaccccatcgccactgcttgctgccgttgtttgaggatgacggtggtgatggaaaacgtgacggcgattgcatggatcatattttagaaagtttcagtggcatacaaccgatatcacaaatagtaatgatatttttctaatataaaatatttttaatggcatggatcaaattaacctattaaataaatagcttaagataaagtatttaaagatcatgcctttgaagctttttagttgttgttactagacacatgcaccatgcaaagcagagtcacagagagataaaagagaatggggaatggggatggaagtagtacatcgatacctcgctggtgagtcttcggaaggagtggtggcgtccacactctgacatctgacttgatgaattttagtactaataataactagatgaaactccacacgttgctaagagattttttttatgataatagtaaaaatatttataagatagctagacataataattttatataattttcatctttgatcgattactaaataaaaagatgtaaacaagatggtgtggtttataataatctaagttaatatataggttaatcactcaaaagaaaaattaagataatgtggctcaatgagagaagaaaaataaataagataatatagattaatcatctaaaaagaaaacttaggtgatatgacttcgtgagagaagagaaagaaaaaagataatttggatataaaccaataatccaagggttagaaaaaaataaggtgatgtcttactgagaagagagagaagtggcattaactgtatttagtgggaatgaacctataactattgattttttttatttccaattgctaagcaatggtaaatcacaaccggaaaggaaagcacccaaaacctataattaccctttccaaatttgagcaactttgctactataaaactgcaaagctgtagccatcagaatggacctacacgtcaatcaattaaatgtttatttattttattttggtatctaaatcaggttagtactgaaagatcagcaaaaatcagctagcgtatgaccgtatgagttgaaatacgagagagaaaaaaatataatttacaaacaaaataatgactacttgaaaaaaaatcttaaatactgaaactaaatattgatcaaattttgaaataaatattttacacaagcatttacaagcttgaaccatagaactaaaagttcaggaaatagccagatatgtactcatttcatcctaaatatagcaatcttgtaatagatatgacacatcctagtcttacgaatttttggaagaaacacggtacaaatacaaacgctcacaacgattacgatttttaaataagtgtaggattcctgtccggattccagtcctaattaagtactccctccatcctctaatataagggatttttgacattttgcttgtactgtttgaccattcgtcttattcaaaaaaatttgaaattattatttattttatttgtgacttactttataacccaaagtactttaagcaca

SEQ ID NO: 41702 - DNA, 6151 bp, Oryza sativa
aagacgagtggtcaaacagtgcaagcaaaatgtcaaaatcccttaaagctactatagtagaagatttttaaagtacctctgtaatttgaatttgaattttaaagttactatattgccagttgatgtaacagcttgctcgattttcagtcatatcgaatccccaaaaattttaaaattaaactacacgaaattaggttaggtttggttatagttcggtcaaatcggtgagccgaacacacccgaaaatcactgttaggttcaggttcggtccagttcggtatgtgggccccaccggtcagcctcagacaagaaactccccaaccccatcccgtcctccatcacttcgccttcgccttcgccgccgtctcccctcctcgccgcggccgccaccccgccctcgcgcctcgcgaaccctagcagccacgccaatcgccgcgcgcgcgcgtgggagggcggcgccgcacccgggagacggacgatgtccggcggccaagacgagggctcgggtgatttgggttcgccgaagctagcgcaaggtatcgtgggggattcaactgcaattccttcttgtttttttttcttttggaatgatagggagaagggcttggttgaatcgcgtgacctagtttagtttgttcagtgattgctcttaggtgatccatatgcagcattaggctaggaatttatttcattattatcgcgaattcgttatggcctgcggtgatatgacttagggattcgatggataaatctaggagcaaaatcgagtagtgagtagttcgattgaaagccgcagagtgcttattccaaacaatgtatgcgcgtattttgtgtgaggaaaaattcgacgcgttcttaacagaggaatcgtctctctggagacatctgatagaaaccattggaatatgttattttttgggtagagctgttattcactgttcaatgttaaatggtcaatttgtttgttgttcaacaccactagagctggcagatgagtgtcgcacatgtaagaagcaagttgatgcatggaaaagaatcaacatgccaaacagtagttggaaatgtatgtcctgataacactgctgctgaagccttgataagttaattggtcaacaaggatttcagatgcctgaacggatggaataccgaattcgctagtgtgaaaatgagagcacattcatgatcacaaggtgatgacaccagattgattttacttctagggtggcagtatttagccgattaaaggtatgcggattggcatagtacacggccatcatgtagttgttcagaatggtgaatatcattcaaagaagtatgaaggtgggagtcatcctggtgtgctcctctaataactgtgcaattacctactgccttgtatatatatttacatgaaaattgaatgagactttgaacttcaggatttctctagtccatacccaatgaccctccatttcgtgcggggctaaactgatgattgtaactcatgttctttaattacactggataatagttgcgtaaacaatgtcttgtatgatgtctgaagttgattatagtattttttagatcaggtagtggtggactgccaataggtagctagtttactaatagctctgtgacattggtttggggagaccaaaggtggttgaaacactccctatattaattagagtggttacagatcaagcagtgatgcattaccaataggtcttataattcgatgactctgcttcacggatttggagagaaaattgatgttgcatttgcattgtaatgctttacaatgcagagtgcaaatgttaattaatgcatacaccacttgctgccacaactattacttgtattgtgttcatacttttatttatcgttgatagtttctactgtttccgcagaatcttaagtactccctccactccagtaacaaaaacatgtcattttggacgccaacatagtatttgaaaagcagcattgatcactaatttctattacgatgcatttttgaaatctgacaatattattatattactaaagttctttcttcagtgaatctacccctatgattttcatgcatcctatgcaaatattaaaaaatatgtacatatttaaattttgaaagtttgacttaggatatatttgaaaatcaaaaagagtggggtttttgtgactggagggagtatgatttacctactatcaatgaggttactgcaattttacaccataatattcttaactcctgtcactcaatctacttcttgtagaccatcacatcatggacttgggtgacaactctaagatcaaaagggcaagagccacgaattggcctacagtcatgtcaaagtttgtgcttgattggtaccttcagaagaagaaggagatgccacccaagaccaagttcaagaagatgcaccaccattattgcacgaccgtactaaatgctagatttgagacaactttcactgttgatcaggtccaccgccactttaggcgcttcaaggaggtttggaatattgtggcccgttatatgaatatgagtgggagtaggtttgacaagaaacacaaaatgctaatactacctccttcaactttggctagtctacctgtaagtatttttatcgttggagatgattgcagtttcactattctccaagtgcactaatgattcttttcctccttgtacagatagcagagcgtgcaattcttgttaaaccaattccattcttcgatcatatacaagctctctttggtgagtggtcagtggatgctgcccctgtgacagacccaattgaagctgctgacattaacgatgatgacatggaaatcctcgatccgttgaacatgatggcaaattgtgcagatgcaagggaccctgatggggcagacttggacaagtttgttttggaggatgaagatgactgtcatgaggtggcagcaagtagtgatgcagtgccttgtgaagtgatgtctgacactagtgcaccatctgcccagccatctggatcctttgctgagagcacaatggctgctctcaagcctggattgaagaagtgcaaagtagtcagcagaacaaaaacaaccccaaacccaaaaccgcaggcacccgtgccacatgatggcaggaaggcggatatggtaaagagtaccttagctgggatccatgacacccctgcaaaaccaatacgagcagcaccgacatcatcggacccaaatgctcctctatggaacatgctgaaagaaatcccactgacacctgctgatagactctcagttggaatttgcctttgtaaaccagagtttgaagtgcatcgaagctttttcatgaacatgggtagggagtaccttgaagcttgggcccataagttcttatctggaggtgagcctggatccttatagtctgatagcgcagaaatctggctaatggttcttacttttaccccatcaatagcaacccatagtctctgctgatggattactgtttatagagccttggttcagctgctcaaatataattggtaaatatagtaggcaatgtgaaactcatcttatcttgacccatagctgacagttcagtaatgtcgtcttgtaatttgtggacaaaggtattaacatcgtaagttggtaagctgtccagagcttacactgcaagtctacatctgatgtcccatgatgctgaaaatgattggatgttatgtgtgccatgtctttgttcagattcgagatacctataccttctttttttttccttcatctgaatgtgtccttttgtttaactttcgtgtgtcaatctaactgtatgctgtccttccttgagcaagacagctctaacctatgctgattgccgctatatacttgcagtattgctttatgaattaactgtgcaagtgggtcgacctgtcaacctacttatctctactataaaaacgaagtcatcctctttgcaccctcccccactgtgtcactccgcttacgtaatcaccgggtccaatgttcctcaaccaccatcctagtctaaccctgatgatacggtccagttataatgtacgagtatgttaccagtagaccaaataaatgggtaacttaaggataaaccaatttaattagcttataagtagattcacgtgccgatccacttatatcctcttaaatataaaatagtgcaccgaaaaccttttgccgacaaatatcttgtcaaaagattcctcgcttttgttgatagatttgtcggcaatctagcgtcgcagtgcagtgaccatccctttctatgcatagtcaaatgatgttttatacagtactcccttcgttccaaaatatgcgcattttagaatagtaccaagtcaaatatcttttaattttgaacattagtaacaaaaaaaaatttaaaacatcaatcatgtaaaatttatgttaatagatttatcattcaacaaactatcataatatgcaactcctttttatttaaaatgttttactattttagatactgttggtcaaattagcatctcggaaactgtgtcgaagtctataaatgtttatagtttgagacggagggaatatttaggtacctttctttatacatgtacgaaacatacatataccataagataataaattagataaacggaacataaataaggctgcattcgtttcaggctgttcccaacctctctcccttgttttccgtgcgcacgcttttcaaactcataaacggtaagttttttgcaaaaacttcctatacaaaagttgctttaaaaaataaaaatccatttttgaaaaaaattagctaatactccctccgtattttaatgtatgacgtcgttgaatttttttactaacatttgaccatttgttttattcaaagtttttgtataaatacgaaaatattatttcatgcttaaataacatttgatgatgaattaagtcacaataaaataaatgatagttatataaattttttgaataagatgaatggtcaaatgttagacaaaaagtcaacggcatcatacattaaaatatggaggtagtacttaattaatcacgcgctaatagaccgctctgttttccgtgcagaggagatggttcccaaccctagctaacgaacacagctaagttgagaacaaaacgaacaccagtcattatcgtagcgggcgcgggattaccctgatgggcctaaactcgaaaattaatgggcctaacttgcttctcctaatgggccaagtggcccaatctccccacgatacatggaaaggtagtactagcgaccaatgtgcgcccaagattgatctgccaccgtccgtgaaccaatctgacggccaaaactgcgaaccggattatatccagttctttttccactggacggagtgcgtttcgtatccccttttctccagtgacctgcggtagtagtactcactactacacacggctagggtttgagcgctctgtgacactgacagtgggccccacccccgcctcctcttctctcacgccgcctccgcttcgtctcctcgccggagttgagccgcgggatccgtcggagatggcgaccggagaagcggcggcggcggcggcgtcgccgccggagctggcgtcgttcctggcgatcgggcttgaccagcgcacggcggagaacgccctcgccaaccgcaaggtcaccgccaacctcaccgccgtcatcgccgaggtaaccgcgccgccctcccgcttcggtctcgccgccttgcgtttgggggactagctaacccatgcttatgcctgcaggctggtgttagtgggtgtgacaaatctgtggggaatcttctctacactgtgagcatccgtcgctgctgagttattatatgatagtagtattgatctaattaaaatctgtgaattggtgatagttagtttgtgtgttaattggttgcgcattggagtaggtcgcgacgaagtatccggcgaatgccctggtgcatcgtcccgttgtcatccaatacattgtgtcgtcaaaggtgagttctgttgtgtgtgattgtgttgtaaacactgctgctgtgtggctgagttcgtaagtgttgtgaacttgacaaattgtggtttccagatcaagacccccgcgcaattagatgctgctctgtcgtttctttctactttgggtcctgatccattggacacagcaaagttt

SEQ ID NO: 41703 - DNA, 3484 bp, Oryza sativa
aagcttttgaaaagttgatgaattcataccttgcagggctaaaacaactcttatgttgataagagtcaaccacaatttattttgcacatactatagttggctgataaatcaatagtccttcaaatgcccattttcagctcactgttgtttaagggcctgcgtttttttcccctgcaggggtggttgtttcaactgaagagattcagtcaatggtcactgatatcctgaaggaaaacatggaagccatagttgaacagcgatatcatataaatggtttgttttctgcttcattttcattttactttgttattgatggttttgttttatctttcgatttgtgatgtcgggaaagctgggcatcatttgctcctgactttcttgttttccagttggcagcttgtgcggacaggttaggaagtggcacccctggggcgatgctaagttcataaaggtttaatacatttcatggctgaaattatggagttttttgtttaattgctactatttattactagtaactttgtgatatggcttgtactaattacttctgttaatctacaggaggaaattgataaaaggcttacagagattcttggtccaaagacagaagctgacaatgtaaagcctgtgaaaaagaagaaggagaagcccgcaaaagttgaggtttgttacctgaaattcaatcaagttttatggcaggactgtttagttattagctctgcctcatccagttttgtttctgacaaaatataggagaaaaaaactgcggtagctgctcctgctccaccatctgaggaagaacttaatccctactccatatttcctcaaccggaggaaaacttaaaggtaagatgattgttatataggatatgcaatgatactccatattcctcaaaataaagaattctctaatggccttgaagctgaaaattgttctttacgagtaggtccatacagaaattttcttcagcgatggaaatatatggagagcacacaacagaaaggacattttagagaaacatcttaaagcaactggaggaaaagtgatgacccgctttcccccagagcctaatggctaccttcatattggtcatgctaaggttgtgactatccctttcacctgtgatgtcaattctgcaaatgctggtttctcaaaatctgaaatgatgcttacaagatttttgatgcacaggctatgtttattgattttggactggctaaagagcgcaacggacattgttaccttaggtacgaaggaatagttagatgttatggttccaaaggagccttcaagtccattgatttgcccttttcttccttatatggacatactgcattgcaaaacatgctgacatgattaatatctgaacaacaggtttgatgatacaaaccctgaggcggagaagaaagaatatatagatcacattcaagaaattgtccgatggatgggctgggagccttataaagttacctatacaagtgactatttccaagaattatatgaacttgctgtttgtttgataaagaagggactagcttatgtcgatcaccaggtttgttttccttggattgatagttgactgcattaatcatatagctttttaaattgttatcactgaacgcctcttgagaaagcaacagtatgtgtaaattgactattgtatgcttgccagacaccagaagagataaaggagtatagagaaaagcaaatgaatagtccatggagggataggcctatagaagagtcactaaaactgtttgaagatatgaggcatgggttggttgctgagggaaaggcaactcttaggatgaaacaagacatgcagaatgataacaagaacatggctgacttaatagcatatagaataaaggtaaacaattcgacattatggagttactgttttctgtgaagtgtagaatttaatatatttctatatatctacacagtttacacctcatccccatgctggcgacaagtggtttatctatccaagctatgactatgctcattgtttggttgactctcttgaaaacattacccattcggtaatagtttctctctaactacttttggttgtgtgagccttaacatgttatcagttgaaattatcagttgtacacactagaatttgacatatggctgttgcaatcaccagttgtgcacactagaatttgacatacgtcgtccttcatactactggctgctcgtatccctggaccagtaccagccatatgtttgggaatattcaaggttaaacatatcaaacaatgttatgtccaagcgaaaggtatagcgctgattcttgtggagaattatatcaatcttatgatccttgatatatggttctataatatggattggatttgcagctaaataaacttgtgacagagaagtgggtagatgggtgggatgatcctcgcctgttgacacttgcaggactacggcggagaggagtatcatcaacagcaattaactcctttattcgtggaatgggcataacaaggaggtaaggagaaatgttttacccaaagacatgcttccatctttcgatatcagcagaactttttctagttgtcaacataatatactgataccattattttatcctttcaatgcagtgacaacagtttgatacgcttagaacgccttgagtatcatattagagaagagctcaacaaagtagctcctcgtgctatggttgttttgcatcccctaaaggtttagcaattggcattctctttttttttttggcaaaagttttgttatttttctctttgttaattgacgcactgatagtattttcttttaatttggtaaattttaggttgttataaataatttagactatggaacaataatagaccttgatgcaaaaaagtggcccgatgctccaggagatgatgcttcggcctattacaaggtaattcttatgtctgaatgacttaatcattttgagaattaaaaatctggtttagtggttacagagtccctttggttctgcacttctgctcaaagattagacacattgagcaatataagttcatcacttctctgattctggaactgtggtcatccctaggttccattctcaagaactgtctacatcgagcagtctgattttcgtgtaaaggattcaaaagattattatgggcttgctcctggtaaaacagtactactaaggtactagtacattatacatctgtagactctgtacttaattagtttgcttactttgtatactttgtggtctcatctatgtttgccgtctgaaactgataggtatgcattcccaataaaatgtacggaagttatctatggtgataattcagataatatcattgaaatccgagctgagtatgacccttcgaaggctacaaaaccaaaggtaactaggcaattgaaattcttttagatcagatgagaatattattctgctatttgaatttatgagatcatgatgttgtgtacaatatgtagggtgtg

SEQ ID NO: 41704 - DNA, 5628 bp, Oryza sativa
ctcgcaatggcgtgacccgaagatacacaaagtcatccactgcgaattccaagtcacgacgacggttatctgcataacttttctgccgagactgtgccacctttagattatcccgaatgattctgactttagcttcagcttctctcaggatatcagtcccgaacacttgactttctccaacttggtcccacaatagcggtgtccggcatttgcgcccgtacaacgcttcatagggtgccatttgtatgctggcttgatagctgttattgtaggagaactcggcataggggagactcttatcccaagtcttcccgaagtctaggacacatgcgcggagcatatcttctagaatctgattcagacgctcggtctgtccatctgtctgcgggtgatatgcggtgctgaaattcaatcgagtacccagctcttcttggagcttcttccaaaagtgagaggtgaattggcttcccctatcagatacgattttcttgggaacgccatggagactcacgatcctagcgaagtagagctccgctagtttgttccctccataggtggtcttcacatgaatgaatcgagctaccttggttaatcgatccactattacccatatagaatcatacccaccttgggtttttgggaggccggtgatgaaatccatcccaatttcatcccatttccattccggcacttggagaggttggagaagtccggccggtcgttggtgttctgccttgacacgctggcacacatcacatagagccacaaactctgcaatttcccgcttcatgctaacccaccagtatttctccttcaagtctaagtacatcttggtactgcccggatgaatggaataaggactttcgtgagcttcctgaagtatcagctgtttaagttctctattatcgggaacgcacacccgctttccgttccataaggttccgtgttcatcttctgtgaaaccagcggctttaccctgtttcatattcttgaggagtccatgcatgtccggatcattcttctgagcctcgcggatttgatcgagcaaggtaggcttggcttctaacgcagccaagaatccgcgaccaactatgcttaggttcagggcttccatctgttgattaagctcgggtggaatgcctcggacgttgagagtgttgcaatggccttttcgacttagagcgtcggcgacgacgttggccttgccgggatgatagtgaattcccacatcataatccttgatgagttctaaccatctcctttgtcgaagattcaggtccgactgagtgaagatgtatttcaagctcttgtgatcagtatatatttcacagcgattcccaatgagatagtgccgccagatttttagagcatgaaccaccgctgctagctccaagtcatgtgtagggtagttgccttcatgaggtcgtagctgacgtgaggcataggctaccacatgaccgtcctgcatgagcacgcaccccaatccttggcgcgaagcatcacagtacatcatgaaatccttgcgagtatccggcaagattaacactggcgaggaaaccagcttttctttgagagtttggaacgccttctcgcattgcgggctccacacaaacttctcttctttcttcaacaactgtgtcatgggtcgagcgattttggagaagttctcgatgaatctccggtagtatcctgccaaacccaagaaactgcgaatttgagtgactgtcttaggttgcttccaatcggtgacggcggtcactgtttcgggatccacagcaactcctttagcagatatcacgtgccccaagaatttgacttcggacagccagaactcacacttgctaagcttggcatacaattgatgttcccgcaactttcccaataccaggcggagatggtgctgatggtcttcctctgattgtgagtatatcagaatatcatcgatgaaaaccacaacgaacttatccaagtattccatgaacactttgtccatcaagttcatgaagaaggcaggagcattggttaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctgatcgaatagatcatcgatccggggaagagggtacttgtttttgatggtgacttcattgagagctctgtagtcaacgcacatcctcttcgtcttgtctttcttctctacaaaaatcacaggagcaccccatggggaagtactcggacgtatataccccttttctttcaactcttccaactgtttcttaacttcggccagttcatttgctgccatacggtagggtcgcttgtacagaggagtggttcctggagcaagatctatccggaactcaatttctcgcttgggcggcataccaggtagttcctccggaaacacgtctccgaactctctgactatggggatttctgacagacctatctgatgcagttctgaacttctgacagaggttggaggtgcaaagaaaacaaccggttgttctggtcctcggtacagagtgacagtgcgcctcgcgcaatccactaccccttggaattgagccaaccaattcatcccaagaatcacatccaagttctttgtgtctaacagaatcagatccgagggaaaaagaatcccctgaatttctataggaacggcagggctataatactttgccgtcataaccccgccaggggtggtgatgagcagagggtttctaagcctttctacccccaactgattttttttccacgaatggcacagatataaacgagtgggaagctccagagtcgaacaaaattgtagcagggatggaatggacgaggaacgtaccaacgatgacgtccggagttgtcagcacgtcctcggccgtcacgtgattcacgcgaccccgaatgacatccttgccaccgttgttggagcggggaggcgcttggccttgctgacgccttggcttcgggcatttgtccgcaaagtgcccgggctcgaagcagttgaagcacagacgctgctgaccttgagcgtccctgcggccttgaacaggctgcacagttggcgtagggggacggggtgcacgagtcccttgctgattctgctgctgctgcggctgtgggacgcgcaccacgaattgaggtcgaggcgcggatcgcgattgctgctgctgctgctgcgaggaggatccccctggatagggattggtgtagcggaccctctggttagcaccttgctgatttcggaagttcgccaagcggcgcttgtgcgactccagctccttgtgcttggcttccaagcggatgctcttgtccaccagtcgttggaagtccgggtaatccccagagactagacgaacggacagctcagggtccattcccgccaagaacttctcctgcttctcctcatcttcccgcacatcctccggggcataacgggctagattgttgaactcatgcaaatactccatcacggagcggttgccttgcttcaactcccggaattcccttttcttaagagccacgactccagcgggcacatgggttctccggaaagcggcggtgaagcgagcccaagtaatcggctgtccctctggctgcgtagcctggaagtggtcccaccagagagatgcgggtccctgcagctgatgggcggcgaagacgactttctcctcatcgctgcactgcaccgtgtctaacttcttccccacggcatgcaaccaatccaacgcatccacgggattgttggagctagagaaggtaggtgggcggatacggaggaattcggcgagtttggagtgttggggagggggtggtggagcattctgttgtggcgggttttggaggtggtggaggaaagcattcatcatgttggcttgttgggcgaggatttgggtgagaatggcgttggtgtctggtggtggtggtggaggcggaggtggaggtggaggtggattgccttggtggttggggttgctgccttcgggttggttgccttcaccggtgttaacatttctcctggtcgtcaccatctgaaaaccccacatagaaccagcaaacagagaagaagagctgacgattaaaactaaccacccacgactaccattattcttaaatttatcactgctattaaattggttcattaatgttcaagttgcttaggcaaacaaaataagacaggctccgacatagttatgccacacaccggcataaccatgccccacacaactcatcaagacgaacgagggaaaaacacacgcgcaagcctactaactgctcgtctaacgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcaggcctggaggtgctcttgcgggcggtgatcttctggctgcggcagacgcggcgacgcttgggacggctgatctctccttgggcgaccttgagctggtgcagctgcgcctccaacgcgtcgaggtccttcttgagctgcagattctcctgacgcagctccaggatcttcaggttgttctccaccatgccacggcgcaccatctggtggaagtcgatacgagccgcgtcgtacgcctccaccatgcgtgccagatgcacgacggtagcgtcatcctccgagctggcgtctcggaaggtggcatggtcgctggctcctccgcgacgggggtggtagcggtagggcgagtgctgcaactcgtccgggtagcgctggtgcagggtgccgatggcgaggagagcggcgttctggcaagcggcggggaaggaatccccacccgcggtgactgccagcgaagtccgctcgggagagccggagaggattactgcagtgacctcccaaccagcgtgaggctctgcatcctcaccctcctgctccgggagcggcctggcctggtaatccactccatgtggataccccaagaccacgcacatgcctcgcagctccaagacgaagccagtcatgtccaaaccacgacgggtaacgctgccggccatctacaaacaaaaacaaaagaaaagcaacattttaaaagatcagattttgatgataagtgaagcagcaagacaaagagagaatagcgggttttcacaaataataaaggatttttatttttgaaaatatagctaaggcttgggatctacggctcgtcctagggtcaagggaagctctgataccaacttgtcacgaccggaaatcacccaacaggcgttcctgacgtgcgtgtattattccttgtcccaggaggcaaggtacaccaaaagttgatacaattcagagtttaacaagcggaagcgtatataaaattattacacgggcaacgaaggcccagcacactcaaagacaacgaaagacagcggaagactagggcgacgaccacaggcgcttgacggcaggcacgagctagacaccgaagccttcatcttcagggaactcctcatctgggcttgggaaaattaagca

SEQ ID NO: 41705 - DNA, 8984 bp, Oryza sativa
  unsure (1)..(8984): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnactcttgagcccactagatggttgtaataattacttaaccagatatcaatttattaactaaaagaacaccatcctataaatacagagtgagggtgcatgggggaagagcaaacggggtaaatatgtgctaagtactaactactaacagggagtcagggatgtaagcgaggggcagggagtaaaacagagcagtagagggaggattatagtagatgagatgtagaggagagggaggaaaaccacaacatagcagcaaatgagggagcagagtagaggatgtagaagaggggggaggaaacaccaaaacaagcagcagaggaaggataagaacagggtagaggaaggagcaaagcaggatcatgtagagcagagaaagaaacagaggaaagaagagggtggaggaaagaggagaaagaagagcgtgcctgcttagtttttgtgtcaatggtgaggaccaggatgatggcgcaggtgcagaggaccaggacgatggcgcaggtgcagaggaccaggacaatggtgcaggcacaggatagccgcaggcaacaacttggatcgccgccagggatggagatgtcgcgagggatggatcgccacagcctcagactccagcgaccctctttctgttgttttctccttgatttggtgggatatggtgcgtggggaccttttcaccccaaaaattggcgcttctgttagttctgtttcacgcccagggcccatggcgccaattttttcgggctcttcaaccaatcgcggcaaaaaccacgccctcgacttcctgtggcgttgcctttagccattgtagcgcctaaggacgcaatatcgacgccgtagcggcgccttgggcataaggcggacgccataagcaatatggtaaggcgggccagacgccctgactcctggcagcgccttaccgctatagcgacgctatggcgatgccttgacaaccagcagaacattgaataaggtatcaaatatccaattgttgcaattatgctgttatgggcctcatcgcaggcagttaagagtatactagcaaatacgcagatccaattagtacttgtttgatttgatgactagctttgctctcgaatgtcataattgatgactagtataagtttacttgcatcaagatataaaggactttacagatatgcagtatatctgaagcttatttaatgcttcatacaatttatgtaaatacttaaaaagatcgacttcttttgctacttgtgtggaagcacttatgtaccttagaatagcatgatattgttgtatctccatttgttttactttcctaacattttccttttatcatgtacagtttatgctgatgggagcatatgcttagatatactacaaaaccagtggagccccatatatgatgtagctgctatactcacatccatccaggtagatgatgccttttttgggggtattagcatgtcatgatgtcctgtcatgtttgttgcaatattttgtatcatgtttataattcgtgcttctgattttggtcctgtctttaaaaatattgagcaaactcaccaatctagtataagtgaattgtcactaacttaattgttgtcgccttaaaatacacatggtgtttccttatagatagtctgcttttcctccccacatgctccattgttaagtagtaagctatattcacttgaataattatttttctttgttagaggcactatcacgcgatatacctgtggaagggtttcatcttgagagtagagatattaggcctctgtgactgattatcactattcagtattaagtgacattggcacgtggggtatatatacataaaaaagaataatatttccagcctctgcttagtttttgattctggtgacaactatatataggccacgaagagtagacggctaacttctatatgtaggcaaacttctataacagtaactttagtgtggtgaggccgcctgtcaataacaacatattatctttatatgtttttcatatacatggtgatatttattaatctatgctctatggaaaatagtatagaacacaataatttttatatcagttgggatacttgcatatcttgcttctgtgaataacaaatgcatatcacaacaatgcatatttcatggactcaagacattgacatattacaggcaatttcattgatttaactgttcagtacttctatttcctgctttgtattatttccagtcgctgctttgcgatccaaacccaaattcacctgccaactctgaagctgcccgcctattcagtgagaacaagcgggaatacaaccgaaaagttcgtgagatagtggagcagagctggaccgcggactgatccactccatctaaccatatgatgcctgatacttaaaacgctcatcttttcagtgtgtcgtgtaccaaactgcttgtaattaaaatgctaaaacagtaaaacgtgcttactgttatgtatgcccttcccgaatacgaggaaggctttggaccatgttgaggaccatatggacttcttatataacatctattgttgccagctactaagtgttaaatgctatattgagtacgaagccgtgcctaaaattcaatgagtaattcttttcgccattcaaggaattacctcgtgggctatatgtattttatgctctagttccaatatctatctttaccttgaggattaaccaatatcgagatggattcaaccggaatgcgctcagacgtgtgagtgtacttgtgtgtgagaaaaaaaaaagacagattttttcagtttgtcgtctggaatttcaatctggatgggtagggattaatgcaaaaatctgaagcagatataatttcactgatgcaattctttctgcggaaaaaaaaagctttctcccgttgagaaagcccaagatatttgtatctgctcagcccatctcagaaatatactggggccgatattttacacctgattttgggcccataactaggcctgagcccatgtagccttccgtgaactcttgcgatgtccccacctgtcagtctccgctcgctctcccgtccaaacgcctatattaacgcgccgcgcgcccccctctccctcccaaaaagccaaagccccacccaaagcggcgacgcccctctctctctctctctctctctcttctcttctcttctctcctccacgtcgcggctcgcgcctccaaatccccccccgcgaggcgagcagggcgaggcggcgaaagcgcgacgcgcgagcggatcgaggcggcggcgtcggtgccggcatccaccgcgtgcataggttgcgtcggcggcggcggaagcggggcgcgatgacggacggccaccacttcaacaacatatccctcggcggccgcggcggcaacgtgagtgctactcgtcgacttggtcgaaaaattcgcttccccctcgtcgaatcttcgcctccgggcttcgtttcgttaggattttgtggcggcgttgtctcgctcccgtggaggcggtttccgcggacgggcttgactaccggaatttgtggcggcgattgattttgtttttttttggtgtggcgggcggttgatttttctagggtttgcgcgctagggtttctgcttggaaggggggaagtcgaaatgaattaggaaaattttggtggatggactcgaatattgtaaggttggctaggcaaaacgaattattctgttgcaaatgcggcggtgaaaagcattgtatggaacaattttggaagttaaattaattgtaaatattcccaaaccctgggtttttgataatctcttcattcaatatcctttcactagtcgaatgtctcatgaaattgctcctaatatctagttggcttgcgtttggcgcacattttagcattcatcctgtggttatttcgtccatcactgcatcaatttatttaatcgcatcttatgtcctacataattatcagtattcttcaattttaaataccatttatcttcaatttgcttgctttgttaaatgatttattcctcttatgatttttttatcacatgcctgaaacaaatcactttttgcagaactaaaaatgttttcatctgttttgttcatgattttttttctggaaatagtggatgcttatgccatttcccattgcaaataggaatatgtatatcaagtttagtctgatatcaacgccaacttttccatcatcattatttgcttgcccactgttagtaacttcccttgtaccttgaggtgctgaaatcttctgctactgttattgtttgggctcttgtagaaccctggccagtttaaactttattcgggaggacttgcatggaagaggcaaggtggaggaaagaccattgaggttgaaaagtctgatatcacttctgtgacatggatggcaatccccagatcctatcagcttggtgtttcaacaaaggagggcctcttctacaggttctttggcttccgtgaacaggtaatacttcctcctgtttttcctaagaaaattaggtcttcccaaacgtgtatgtttctcatagataacttttattgagctaagatttttcttctaatttttaggatatcagttcattgactaacttcatggaaaagaacatgagaatcacaccagaggagaagcagctttctgttggtggacataattggggcggaattgaaatcaatggttagccaaattctctatattattccgttgctccattgcctttctgcaacgtttggtagtttgattgctttccatgttatttccatttcaggcaatatgcttagctttaatgttggttcaaaggaagcatttgaagtctctctagcagacgtagcacaaactcagatgcaaggaaaaacagatgttgttctggagtttcatgtggatgatactactggtggtaatgaggtatgtggtttatccagatatacatttctctgcatccaatttcgcccatattttattagatgctacttttctgtttgttaggtgcaattggttataagtaatcaatttatgtttatcaatctgaagaaatgtggatgtaacaattgtacaagctatctgttacatttcagtgtcatgtattattagctactcaactgtctgccttgtaattaaagagtgattttactgtcctgctttttcattctcatttgatggtattgcaagtaacacactcccattgttagagaaaaaccatttcataaaattttggggtctttatttgtgctgaagggcatattgatcattgttttccaccctactacatattttggagggtctttatttgtgctcagaatattattaaggtagctaagctaatcgttgacaaaaaaaaaggacagctaatttcaacttcctttccttcttttaaatgtagaaagattcattgatggatttaagctttcatgtaccaacttcaaatactcaattccctggagatgagaatcgtccttcagctcaggtgagtttgctcaacaagcatgcaagatggacaacatacacatgattttattgtgcaaatggtgaaatcctctcctttttttaggttttatggcaggctatcttgaataaggctgatgttggctcatcagaggaagctgttgttacatttgatggaattgctattcttactccaaggtgggtaaatcatataaccatagagactagactttttagaaataaggacatcattcaatgttattgtttcaattttctggaatagctaacttctccttttctattcagaggtcgatacagtgttgaacttcatctgtcattcttacgactccaaggacaagctaatgatttcaaaattcaatatagcagtattcttcgcctctttgttttaccaaaggttctgccccttttatatttttattatgctgtacttgttgttaactttgtatctgacaaaaaatcctatgacttttcaccttggcagtcaaataatcctcatacctttgtggttatcactcttgatccaccaattcgcaaaggacagacattatatcctcacattgttattcaggtgttgtattagaattcaatttgatactaacttggttacagtttacggtaaccttccaatatgcatttggtaaccattttctgtatttatgaatagtttgaaactgaagcagtcgttcaaagggatctgacattaagtgatgaggttttggctgaaaagtacaaggatagactggagaactcttaccaggtgatgtattttgtttgcgttcaatcaagtctgacattcttcatctaaaaagtggatcctaattcccggctcatgtagttttgcatttctttctacatctgagcatctgtagaacaaaaaaaaaagtagtttgggggtgtgaatcattttaaataactgcttccagcaatgttatttgttcttgtttgttttagtttcttgtttgtagtcatatgctctgagctgtatttattgtggtaatgtgctgctggatgcttgcaactccaggaatcatcagtgcactgattcccaaacttgtgattcatccgtttatcactgaattgcttgttttttttctatctactcatgactcctgtttgactgaattgcacaagctgctattgatgtgatgaactgcttctgtggcattactgccattgagtctatcattatgtattcctttgtgtttgcaactttgcatgagttatagggtcctatagcttttgctcatttgctatttttaactcctgatagactaataacaaactcacagaaagtatttgatttatctatagggtctgatacatgaagtgttctccaaggtccttcgtggcctatctggtgctaaagttacgaggccaagcacgttccgcagttgtcaagatggatatgcagtgaaatcatcactcaaagctgaagatggttgctctatccgctggagaagggcttcttctttctaccaaagcccccaacactcattctgcatgaggaggtctgttttctacactgctgagatgattgataattccatccatttgtcctgttttaagctgtagctctttatggcagattgagtatgttgaatttgagcgacatggtgctgggggtgctagtatctcatctcactattttgatctcctggtcaagctgaaaaatgatcaagaacatctattcagaaatatccaaagaaatgaataccataatctcttcaatttcatcaggtctgtgctttatttagctgattccaccatcattggtttacttgcctttttgaatagaagtatgaagctgataagtgcctttttgtaatccctttcaagtggcaagcatttgaaaatcttgaatcttggagaagctcaaggtagagctggtggcgttacagctgttcttcagagcactgatgatgatgctgttgatcctcatctggagcggatcagaaatcagactggcgatgatgagagtgatgaagaggtatttcctgcgtttaattgttgatcctacttatcatgattccatgatctgacttatcaatcctgtcatagcttggaattaatttgtttgtatcggataatcttcaacttcaggatgaagattttgtggcggacaaggacgacagtggatctcctactgatgattctggagaggagggttctgacgctagtttaagtggaggagaaaaggaggtaactcattttactcacgcaatatccctgatcagtgtctataatgaatacatcatgctaatcaacattactattccccccctccaaagaaatcttccaaaaaggaagctagtagctcaaaggcgcctttgaagaagaggaagccaaagggtggggatgcggcggaaggctcggagaaaagaaagccaaagaaaaagaaggatcctaatgcccctaaaagagcaattgcaccattcatgtacttctcaaaagctgagcgagctgtaagttcctttccaccctgcactactgtacagaaattccctgactaatcctatgtgaaacattgtgggaggatctctctctctctctctctctcacacacacaagcaaagaagggagcttacgatcgtttttcccaaatgcagaatctgaagaacagcaatccggagctggctaccacagagattgcgaagaagcttggggagaggtggcaaaagatgacaggtaacattctttgatctctatgctcgacaatgtccatgctggtcggtcaagtcctccgagacctccgtttgaaccatgtccgcttcgtgtaacttgcagccgaggagaagcagccatacgtcgagcagtctcaagttgacaagaagcgctacgcggaggagtcagccgcctaccgcggggcggctgccatggatgtggactccggccctgcttcggactgaagagaagagacctgaattgcattccagattacccttagtctaggagggcgacagacaggatacggctagtggcatctctatttccatgtaaataaaacttatgagttatctggatgtaaataaaactatcgtaggtatctttcgagtcccgttctatgagtgtcttatcgctttatcttagctatatatatagatagcagctatagtatagtagagttcttcccgccatttatgctggccggataacttaccttcacctatgtagcagcaataagcatgcttatctgcttagttaaattataaatgcgtgttctagctggagaatcacctctgttgtgttgagcttgtggagttgcctgtgcataacttgttcgggattaattcacatatacttgctaggtttaaaatcatgggtaaatacatttatgaaaacaagcgtatcagtagaaaatttgaagagttaacgagacttgtcct

SEQ ID NO: 41706 - DNA, 1612 bp, Oryza sativa
ccgcctccgcctccgcctccacgacgtagcccagggcggctagggtttcggtttcctccgccgccgccgccacctcctcctcctcctcgtgcgcggcggcgaccatggcgatggtgcaggccggcatgggcctcacccgcgtcgttgtcctcatcggcgccgggatggccggctccgtcgtcctccgcaacggccgcctctccgagatcctcggcgagctccaggtgcgtcgcgtctccaccgccttggggggaagaatcccccgctcttcctcctcacctgaatcggtgatcctggtcctgggagaggtggcggcgcgccaccggattggattttgatttggtttggttctgatgatgatccgtgccttgcggacctctctcactcgttgcaggagatactggacaagggggagaaggggaaagacggagaagggggcgggggcgccgacatgacggacgcgctcactagacaggtgcgtcggtgatctccctgtccctagatgtttcagctagtatatgctcagggatgtgtccgattcagctgttcgattgattattgcgccatttttctttgccattagttaggtgctctggcttccccaccagagccccatgtcaataggagaagcatgggatgcattttaatgcgattattgtatttaaaaatggatgttatctgtgcctatcagtatatgtatctatagctgcagtgattgctgaattattgttttatagtggcaatgattcacattgcattgagtcagttctgcttgtattttttcttatttctgggaattgctagcttcaacaatgcattagttgttcttccattatgtataagttaatattgtcatgtgatacattaggttgtggccttggcatttctacgttcacaatgaagagctgttgagtatttttggaagtgtatagtagctgttgtaatattaattattactacaagccacaacacaagtgtgtgctcataagaagcatttgcgtgtgttttaaacagctgtggtatatgcaacagtaaacatactacttcaatattcccataatatttttttcattgtcatttatgagtaaaacagtttgcctatcttcatacacatatttgatactttgtttaattttgtcaagctagacttacaccttggtccatttaggtgcgcaacttggctatggaggttaaacaacttgcttcttcccgtggatctataactgttcttaatggaggttctggtcaaacaggtcagtctagcttctgcacaacctacataactgttacttcctcagtctagacatatatgtgtgccttgattcattaacatctatatgaatgtgggcaatgctagaaagtcttataacctgaaacggaggtagtaaatcacaagctccacccattttatttgccctctttttttcttttctttcttgtagtgttctgacatgagtattacttatcgcttggcttcattttctcttgttttaaatttgaaagaattcacgtagttagggaatgagtggactgaacaataatcattactcactaattcagcctacatatttctgttgtagcttatttcagaaattggcttaattaaccagtg

SEQ ID NO: 41707 - DNA, 12654 bp, Oryza sativa
acggaaggagtacgttccaaatggaccactagcgggcaccctcaacgccttcctcttatcactatctctaaaaggattttcattataaaatggcaatacaaagcgaccacatgctagctaggtgacattgacacattgttggacttggacgtaagtgcccttaaactcatcagttgcaaagatacacagtttatactgactaaggtatatttcttccggattttctatttcagatatataaaaaatcttatatttttaaaaatatatcacttccattaaattgttattaaaatactgtaaaattcatagttgctatttcctaagaccatatgcagtggcgagttgactcgtgtaggccacgtaaaatggttcgagtcgacgactccctcatctccacaaatgctaacccgtcatcatgttgggctatcctaattaataaaaaaaaatcccaaacatgaaagcaacgtgaccataatatttaggggcatttgcaagccaaccactgtttttgatattttgtaaaaatgccacacgagtggtagtttatggcagtttttacaagtattcaaatgacagttttacaacaataatttaaacagcggtaaatttataattgctcctaatatgtacttctgcatgcatcaactcatattatgcttcggtttttttgcattatgcaagattcttgtgttctccggtgaggaagactcgattcataagttgccagctcgttgtatatttatatgaggcctcacagcacgagctcagttttgttatggctccgcttggtccatgcagtcaaatcgatagagctagacgtttagttttatctatttaataataagagatgatcatagtcgatttagataaaagaaaatttaaaggctattgataacaatccggctcaggtggggttggctgaggcccaataacttaagattgctcggacctcaacagttcataggcacacacactcggggaaaggcccaatctccctaaaagacactggtggagaaggagtttttactcccggttcgtaaccccctgtaaccgggactatgaatccgggactaaagatcgctatctttagtcccgaatgaaaaaaccgagagtaaaaatccatttttagtcctggttggtgtttctttagtcccggttggtaacagatcggttgctactttattctattcttttcttcattgtttttaatatattgattcactctatctcatcccaaaatcccaaatcaatcatccccgaatagtctccaaattctcaaatcaatatctctaaatacatcacaaaatcttaaaaaaattacatcacaacttctacaaaattcatcacaaatacatcacatattcatatcacacacaaatcgtctcagacccgaattgtaacgctccgcttttcgtgaggcgttaaaaactaattcggcaaaatcctaattgcgaaaattttcgttctttgtgtgagagtctaagtcgtgccaagatctcatctcaaatcacattgttccctctcatcgaaatcaaaatcctccacctcaaattcctcttccgattcaagtctccaaatcaaattccgaaattcagtcgcatcctttgaatcctcgctaaacactcgctcccaattccgaaaaataccaaaccctatcttgagctttccttgattcctccctgaaccctcgagttcgaatatcgaatttgaatccaaatccaaactccaattctctccaaatcagccttctctgtgaaagtctattttacctccctctggctcagtgggccgactcttcttccccagcccatctcctctcagcccgcttcacctcctccccgcacgtgcgctgcatgcgccgagagagagagagaggcatcgcctctcttcttcctctctctttcctcgctctctctctctgcttcctttctccctctcctcagcgccgatttcccgccgccgccgttcgaaatccggctgcacccccgcgtcgcgcgcgctcgctcgagaggtggccgaccggccgaacgccgccgccatcagcccttgcgccgccgacgccacgagctgccgccttgcccccgctccatgacaaaccgaccgccgccgtcatcgccgacgtcatccatggcccctgccactccacgccgcatcgtccaagaatgggagaagcagctgcttcccctctcctcaatatggcaaaggaccaacccccctttttccccccttctttttttccctttccccgaccaccgccggcgtcaccacctctgcgccgcttgaccgctcgcgccacccgcctcatctccttgaccgccccaaggtcggttctctcaaactgacatcgccacctataaaacccacaccccctcccatacctctcgcttcctctcctccatcacaccactgccgcctcgccgttcgtcgtcgttctcgccctcctctgccgtcgtgcgtgtcggggaacttgcgagcacgaggagtcgacgaggagctccgcgccgcccccatcctcgcgcctctccatctgttcttccccggccgcgccctctcggtgccgcgccgccccgccgtcgcgtccgcctcgccgcgactccatccgcgccgccgactccatttctctcgtcggtgagctccccaccgaaccccttttcccctgtcgcacgccgcgccgcgcccgccgccgtgtgtcacatctcgccgcgcgcccttgctctgtcccgggcgtcgctcgccgtcgccggcctctatcggcgtcgcccgtgccctctcaaccggtggaatgagctcgcgacctcgcgtagatgctccagctccaacgaatcgaacccccgttgccccagtgaagttttccctctttgctcgccgccgacgatcgctgtcgaaatccgccgtcgtcggctcctctcgcgtcgattcctctcgccgccacgctcccggggatccccttgacctccccctggctgccccaaggccgccggccttctcctttgtctccgcgccgtgtcgccgcttccgccgccgcctaacgccgccgtgcgtgcgccgccggtgaccatcgggtcccgcgtccccgcgtgcgcatcgcggtcgcgtactggttcggcttagcccgagcccgcgcgcccttcgctcttctcgcgcgtggccacgtcggcgtgccggcgagattggtcgccgccgccagccgccgtcgtttttcccccggctaatccgctccattgaatcgattccccttggcctcctctctcttccggtgctacccccccaatccacctcgccgctgttcgccggttcacgtcgctcgtcgccggccatcggattagcctgcccggcctcctctcccttccccatccgacgtggcatccatgtggatgccacctcagccgcctggccccgcggagaccggtcaaaggtctcccggtccaccgatccaacgcgccgccttgcgtgcaccccgctcgcgtgagccgtgtcgccgccttgtgggtccaccttgcgccggcacggtggaccgcgtccaccggcttgcgtcgcgtgggccgcgcctcgttcggccttgggccgcctccctcccgcgcgccggcccgctcgcctcggccgcgcccgcgcatctcttcgggccgcgtcccttcgctcggcccaagtccaattaacatccctccatccttttctttttcagggatttaataaatcatttttcctttgtcccataaatcaattccttattccaaaatcccataaaccatttcctttggtcccgcgtgacaatgactgtcaataatattcttgagaatattataaatttcataaaccatttctcctattccagaaactccaattaaacttctaaaaattcatatcacccaattcgcaactccgattgactccgttccacttccagtattttcataaaattgagatctatttaatggcactactaattagtctaaataggatctttcttttggtctcttgtttaggttttcgattgttgcgtatagttgcggttatcggtttttcgtcgatcgcgggttttcccgaagattcgtgaagcttcgtgaagaccttgagcaaggcaagtcaccctttgatcaattgcccctataattgaaaagtcattattattttatttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacatgggaaataggtttgtgaagccttcaaaacccgacatgtggtgtcggtgtgtttgaaaacaaaatgaattttgaaaactcgcgatgcgggggttgtgcctatgtggcactgtcccgtattcgcatataaggaccgattcctgtgggaaactcatcgaacataatcaaagtgcaaccacaaggtgaaatgggacaccctggctaagtaactagtcggttcaggaaaacctcgcatgccaatagttgggaacgccggggcggggtcggttggagccaaaccgggttcctggtaatgcaagaacgagaagcttgctgaattaccgatcgaggtggttggagtttgaattgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcgtgtgggtaaagtgtaccccctctgcagaggttaactaactgttcgaacagccgtgcccacggtcatgggtggatgtgaggtggttcccgttgcgtagatttgtttgcctgtgctttgtgaaaagttgttgtggtgtgggaatcgtaaccagaatcagcctatgtggcagatggacgatctgagtggtcagaaacgaatctgtgtgattcgggatgtctgcgggcatcatagattaggcttcccgagtggaagcagattgttgtgctgctgggcagctggactctgggagtcaccgtgggtaccagcactatgtcctgggactggtaccgagatcgcggtttcgtaggaagcggttcacgttgttttccctacgacacgctcctgtcaggtgccgttgtacggcggtatcagattagggtgtgacacgaatcacagattctcaacaaaaaaaaaagaaagaagacgaacggcccgttgcctcgccagccaccgccgcaccgcccgccgcgtcgccgtgaagcatctaggctcccggtgttaattttggtaattaatgacaagcgctaattgtggactaaccgttgtctttgagctatacattttaagttaggtccacatcatatgtgcgcatggatgattatcgatggattaaaattgacggcgcaaagcaaagggaaagaagacggtaaactagcgctttaatttagaattgatcgtggtgtaaggcgatcaaatttgctagtttatttttagtttcgccgtactattaagaggggtaatgacctagcaagagatgattacaattgccacattaggtcattgcattttcatttgtgctctctttttcatcacacatacattcacttgcaaattcactgggttcggcctgaccaggggcggtcagaccggccacatagtggcggtctgaccgacgtgccctggccggtctgaccggcggcatttgcgcggtcataccggccccctggaggccgggatggtgctgctcgggatggccgatacagagccgacggagccgtattcggtcagaccgagccgatgacggtctgaccaagccgaggccggtctgaccggccaccccatgccggtctgaccagccaggccgttggggccctctgacagggctacaacagctagttttctagccgttgcagagtagcacggtctgaccggccacatacctccgatcagaccggcagagcacagagttaggggatttcgcccccaacgactagttttggtgggtgggagtataaatactcccccaccagcagcaagggggctctctaggcacccaattcaattgcatacactccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcctggaggttgccgtctcctagacggcttgtggaggagttgcccggtgacctctccgagaagattgtggaggaggcccggcgccggtttgtgagtggtttggagttcaccaccttcggagtgaagtaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttactttcctagagatataattgagccactatcaccctaggtttgcaaaacataaattagttgcttagttagagttcaccctcaccaagcctagcaacttaggttagatttgattaggtgttatttattctttaaatcgcctattcagcccccctctagtcgacatctcgatcctgcaagtggtatcagagcttggtctctcttgattgggcttcaccgcctagagagaagatgtcgaacgaggtgaaccatgtagggaaggcttccatgtttaatggcacaaactactccacttggaaaattaaaatgtctactcacctcaaagctatgagcttccatatttggagtattgtggatgtaggctttgatatcaccggcacacccttgacggagagtgatcaccgtaacctccaactcaatgcccaagccatgaatgccttgttcaactctttgagccaagaggagttcgatagagtgagcaaccttgagaccgcatatgagatttggaacaagttggcggagatccatgagggtacaagtgagtacaaggatgccaagcttcatttcctcaagatccaatatgagacattctccatgttgcctcatgagagtgtgaatgacatgtatgggaggctcaatgtcattgtgaatgatctcaaggggcttggggcaaactacaccgatcttgaggttgcccaaaagatgcttagagccctaccggagaagtatgagacccttgtcaccatgctcatcaactccgacatgtcaagaatgacacccgcaagcctcttggggaagatcaacaccaatgacatgtacaagttgaagaaggagatggaggaagcctcaccctccaagaagtgcgttgctctccaagccaaagttgaagacaagagcaagagcaaggtgaatgaagtcaatgaggacttgtaggaagagatgatccttcttgctagaaagttcaatgatctcttgggaaggagaaaggagagaggaaggggctccaactcaaataggagaagaaatagaagacccaacaagactctctccaacttgaggtgttttgagtgtggtgagaagggacactttgcttccaagtgcccttccaaggatgatgatggagacaagtcatccaagaagaagactggaggctacaagctcatgaagaagcttaagaaggaagggaagaagattgaggctttcatcggggaatgggactcaaatgaggagagctccgtctcatccgggtccgaggaagaaggtggtgatgatgcaagctccaagaagaagaagatggccgttgttcccatcaaggaggctccatcactcttcgctccactttgtctcatggcaaagggctcctctaaggtaacatcccttagtgatagtgagagtgatgatgattgtgatgatgtttcctatgatgagcttgtgagtatgtttgaggagctccatgcttatagtgagaaggagattgtcaagttcaaggccctaaagaaggatcatgtttctttggaggtcttgtatgaggagttaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatattgcatcatctagcatttctacctcttgggatgatcttatggatatgcctagccctagctctagctctagctcttgtgtttctatttgtgatgcctcacttattgttgagaacaatgagcttaaggagcaagtggctaagctcaacaagagtttggagagatgcttcaagggtaagaacactcttgacaagattttgagtgagcaacggtgcatccttaacaaggagggacttggattcactccaaagaagggtaagaaaccttctcaccatgccactcgttttgtcaagagcaatggtaagtattgctccaagtgttgtgaggttgggcatttggtgagtgattgccccggtggtaagcctcctaagacatgcatgttcgattctcattatatgcttaggaaggcttatgatggtagtattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgcttgatagtggatacactcaacacatgaccggtgatagggctatgttcaccacatttgaagtaggagagaatgaacaagagaaagtgacatttggagacaatagcaaaggaaaggtaattgggttaggtaaaattgttatctccaatgatttgtcaaatgaaaatgtctctcttgttaaatctctaaattttaatttgctttcggttgctcaaatttgtgatcttggcttgtcatgtgccttcttcccacaagaagttattgtttctagccttcttgacaagtcttgtgtgttcaaaggttttagatatggaaatctttatttggttgatttcaattctagtgaagcaaatttgaaaacttgtttagttgcaaaaacttcattgggttggctttggcataggaggctagctcatgttggcatgaatcaattgagcaaactttcaaaacgtgatctagttgtgggcttgaaagatctgaagtttgagaaagataagctttgtaggcttgtcaagccggcaagcaagttgcaggttctcattctactaagagtatcatgtccacatctagaccattggagctcttgcatatgaatttgtttggcccaacaacctataagagcattggtggtaatagtcattgtcttgtgattgttgatgattattctcgctatacttgggtgttctttttgcatgataagtctattgttgccgagtttttcaaaaagtttgcaaaaagggcccaaaatgaatttagttgcactcttgtgaaaattagaagtgacaatggttccgaatttaagaataccaatatcgaggactattgtgatgatcttcatatcaaacacgaactttccgctacctactcacctcaacaaaatggtgtagtggaaaggaaaaatcgtacattgattgagatggcaagaactatgctagatgaatatggtgtttccgattctttttgggcggaagccataaacaccgcttgccatgcaaccaatagactttatttgcatcgtctcttgaaaaagactttctatgagctaattgttgggaggaagccaaatgtcgcctattttcgagtttttggttgcaagtgttatatttaccgaaatggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgttgtaggtgatgaaggcttgatgagagctatgaagaacatgtctattagagatgtcaagtctattgaagtggaagacaagccatccacctccactcaagatgagccatctacttccgcttcgccaagtcaagctcaagttgaagtggaggaggagaaggcacaagatccacctatgcctccaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatatttaggaacaaagtggattggtggtgagaaacaaggcaaggttggtggcgcaaggtttcacacaagttgaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggtttggaggatgcgaagcccatcaagacacctatggcaaccaacggacatctcgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaaggatttaaagcattcctatactattggcttgtggtacccaaaaggtgctaaatttaagcttgttggctattccgattcagattatgccggttgcaaagtggatagaaagagcacatccggtagttgccaaatgcttggtagatcccttgtgtcatggtcatccaagaaacaaaactccgtagccctctctaccgccgaggcggaatatgtttcggcgggtagttgttgtgcccaattgctttggatgaaacaaaccttgttggactatggcatatccttcaccaaaaccccactcctatgtgacaatgatagtgccataaaaatagccaataacccggtccaacattctagaaccaagcatattgacattcgccatcacttcctaagagaccatgttgccaagtgtgacatagtcattagccacataagaaccgaggaccaactagccgacatctttaccaagcctcttgatgaaacccgcttttgtaagttgaggaatgagttaaatgtcatagatttctctaatgtggtttgagatggtgcactatggttgcttcttttgcattttgtatatttgctcctatttgctcttatgctttggacttattgccatttggttcttcattgtgaaaatggagcatgtcacattaagggggagttttggactcttgcatgtgctctacttccttttatatgtgagcaaatcaactaaaagtgctagtagtgtttttcaaaatgcccaagtcaacataagtcaaaacttttgcaaaatcaatgaaatttgaaaactatttcttggaaaatgtttcaaaagggtccctatatgttttccaagcctcacattgctagaaaaatgatttttgaacgaaaaatgccattttggctctcttttgaagaatctagattcttgtttttggccaaaatgagattaaaccccataatgagtttgagaaggaatctgagaaaagattcaaaacaaagttggtagagaggagtatttgaaatgttttaggtattcaaatcatattcaaaaaccaaatatttcaaaagttgtttgaaaatcaaattcgtccaaaaacccctatagaccataaaaggccacctcctagcactcaagtgagttttgttgcaaatcttcataaatttcaaatattatgaatggttggcaatatttcaactcacacatttcaaaattgctccaaaaatcaaaattttattgatatttattgagtgggggcagccaactgtgcaagggctgtgcacagtcggctggggggccaggcggtctgaccggcgctatatgcgcggtctgaccggcctggtggcagcggtctgaccggccactagggctcggtctgaccggctgcaacccggcggtctgaccggacgcgtaaagctggtctgaccggcctaggatggtgggcccaggactttatcctttcttcctcatcctccttctacccgacccctcctcatcccatctcatctcttctcttctccaactcgaaaaaactcctcctctctcctctcccaaaccctagccagggctgcaggaat

SEQ ID NO: 41708 - DNA, 3121 bp, Oryza sativa
  unsure (1)..(3121): unsure at all n locations
tagagggtggtttcttggtgtgattcaactccttcaaccggtacatcactctccctcttgtgctttgctctcaaattggtctatctaaatctctagggttaagggtagtttcccccattgcttcaatctctatgaaatagacctacaccttgatgttcatgttccaatcttgtggaactttgtcctagcaatttttagaatcatttgtgtggattgtggaaggattcggttgtgctactgtcagcggcggtctgaccggcctatggccgtcggtctgaccggccgtgagacaccggtctgatcggccaatggccgtcggtctgaccggccgttggccatcggtctgaccggccttggctctcggtctgaccgcccctgacaggcagcacccccattcctccctcttcactatgtggcttctaaaattgttgcttatccatcctttgctccttgtttttcagccatgcctccccgcactcgccatggtcgtcgtgagcccacgcccgatcccgtcagtgagaatgaggaatcaagcggagatgagtatgttcaaagtgatgatgacaatatggaaaatgttgagggtgatgagatggaagtaagtgatgatggtgatgacaatgggagtggaaatggtgaagatgatgaggcaagtgatgatgggagtcctctcgattcctccatccaatttgtgcttaatttgaggaatgctcaacaatacactatcctccgtcatcatgatcaattccggaggcctaacgattgtaatgatccaagatttcatacacggttccaaaagtccgtgtatgcacaagtgtatgccaacaaagccttcgccgagcacaagtggatttcttggaggcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcggggaccctccgatgctctatcaaccgccatgaattcaaggagctcttgcacattcgcttcaacaacggggatgaccttcatgatgagcacacccacaaccccttccccattgatcacttttctcagttttatgaagaagggagaaggcacacatatggcaaggtggcgggtttgagggctctcccaagtgtgatcaaccgcatagtaagggccaccatcctcccaagaggcggcaacaatgatgacatacgcggagttgcttggcatgttattgatgccattatggatggtcgtcggtttgatgttatcaaccttatgatgaaggagattgccatctcaaaggggactcttggacaaggaatctattatgctccctacataatgaggttgattcaaagcaagttgggacaaattggtcacaatttaaaagaacataaggagtacaagcctcgtctcaaactctcctcccctagagctcctcgtgtgcgccaaccaacattcgatcaaggtgcaagctcaagtgcagcccccctcctcctcaagggtatgatccaagtgtttttttttccatccacaatatgcctactttggaatgcaacccaatgacttcttcaacccggtccttggggctattaataccctaagtgaaagcattcaacgcttatccaccgggcatgaagcattgcatgaggatgttcgtggcttgcgcaccgatgtttgcaacttgaatacttcggtgggaagattgcatactagggtgggtgtattggattctcgagtccaaaccttggagagtacccaagcttttgtctatcatcgccaccgtgatgcttctcatccttccacttcggcgcgtcctccttctcctccacaagagtgaagacctttttggtgcttgatgccaaaagggggagaatagtgtgttttatgttttgtgggttgggactagtagtagtgaggttagtcacctcatatttaataggctaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttctgctatgatggatggttggtgtgacattgatatatttgtgaccatcttatgcccatggatgaatatttctttaagttcacattgagatattgctcttgtgtttgtgatatgttgaaatgtgaaattgaattgtgcattggctccatatttgctatttgtgattgttatgcatatgtttagggggagcttttgcttgtcaatacaatatatgtccatgtgctatatgtctgattatatatatttgtggtgtttgtcatcaattaccaaaaagggggagattgaagcatttaggcccccggtgttaattttggtaattaatgacaagcgctaattgtggactaaccgttgtctttgagctatacattttaagttaggtccacatcatatgtgcgcatggatgattatcgatggattaaaattgacggcgcaaagcaaagagaaagaagacggtaaaactagcgctttaatttagaattgatcgaggtgtaaggcgatcaaatttgctagtttatttttagtttcgccgtactattaagaggggtaatgacctagcaaagagatgattacaattgccacattaggtcattgcattttcatttgtgctctctttttcatcacacatacattcacttgcaaattcactgggttcggcctgaacagggagcggtcagaccgagcacacatagtggcggtctgaccggcgtgccctggccggtctgaccggccgcaagaaggcggtatgaccggagcataagacgggtctgcgcggnggcatttgngcggtcagaccggccccctggaggccgggatggtgtgctcgggatggccgatacagagccgacggagccatatttggtcagaccgagccgaggccggtctgaccggccaccccatgccggtctgaccggccaggcagatggggccctctgacagggctacaacagctagtt

SEQ ID NO: 41709 - DNA, 709 bp, Oryza sativa
ttcctgcagccctagatgcattggctgccagctcgatccgcaccgacgatactccggcgaggcaaagcgcggcgtaaggaggaggaggaaaagtggccgggatggagtcggtcggcgacccgcgggatgggccgtcgacggagcgcgcgttcgaggggcagcccgtcccgccgtggacggagcaggtgacgctgcgcgccgtggtggcgagcgtggcgctgggcgtggccctgagcagcgtgatgatgaacctggtgttcacgtcggggatcatcccgtcgctcaacatctccgccggcctcctcggcttcttcttcgtctacccttcctctgtgtgactaaatttgccatcaatagaacattgtatccccgataattttgtagcagtggaaaacgggtgacaagcgtccatcgagaggagccaggcaatggccatagttagtgaacacattggcatagctctgggtggaagagagattcgagcaacttatcacggattgtagcgtgggtggaagagattcagtcgacgctcgagggtggcggcaaggcaagatagcaaccgtagcaataatatcctcgttcgtcgctccacaccaccatattggtggtctaaggggcgatgctagagataggagccccagcctgattacccatggccctagcctgaaccacatctcatcaagtcacgtaccgtttccagccacgtcag

SEQ ID NO: 41710 - DNA, 717 bp, Oryza sativa
ttcctgcagcccgagtttcctttaacgttcgcatgtgcaatcagagcatccccaaatatcaaaaccagagcaaatcgagtccctcagcggtgtggacgacaaactcatcctacgtgacatatatgtggcacattaacttaatgttcgtctgacgtgacaatccaaccaacaaaaagttaataaaaattatagggtccacatttcatttcatactttctttctactatcttcttttctctctcgacccggccagtcaccccgactcctcactctcgcctcttaggtgtcccaaccgttgcctgcccaccatctattgcgaacgagaacaaggacagctggcgctgcgggtgtccaactctcctctcctcgtactagagaagggggactcaagggcagtggagaaagaggatttgaggtcatagctcggcgttggagtggagaatgtgacgagcggtagacggatgattgctggccaagaagtcaccaaacgatggcaaccatgccatccttctcctcccttcttcttcgtctacccttcctctgtgtgactaaatttgccatcaatagaacattgtatccccgataattttgtagcagtggaaaacgggtgacaagcgtccatcgagaggagccaggcaatggccatagttagtgaacacattggcataactctgggtggaagagagattccagcaacttatcacggattgtagcgtg

SEQ ID NO: 41711 - DNA, 6488 bp, Oryza sativa
  unsure (1)..(6488): unsure at all n locations
cttcctccttttaagctaagcaagacgcttcccacctccctctcttccgcccgactttagctttcaaagcgggactaaagatgtttttagtcccttccttaatagtcccctcccttccgcccgactttagctttcaaagcggaactaaaattgtttttagtcccttctttaatagtccttccttaatagtggaggatgtcctcatcattctcaccccccttcctccccctcccttccgcccgactttagctttcaagcgcttaatagtccttccttaatagtggaggatgtcctcatcattcccacccccccttcctccccctcccttccgcccaactttagctttcaaagcgggactaaagatgttttttagtcccttccttaatagtccttccttaatagtgtaggatgtcctcatcattcccaccccccttcctccttccaagctaagcaagacgcttcccaccccccttccttccgtccgactttagctttcaaagcttcccacccccctcccttccgcccgactttagctttcaaagcgggactaaagatgtttttagtcccttccttaatattggaggatgcccttacagtgggtaatagtgtaggatgtcctcatcattcccacccctttaaataagggcccaggtggggttggctgaggcccatagtggaggatgtcctcatcattcccacccccttaaacaagggcccaggtggggttggtcgaggcccaataagtaataacttaaggttgctcggaccccaacagttcataggcacacccactcggggaaaggcccaatctccctaaaagactagtccaataggggaagggtggctctcctttttaaggtggcttcctccttccaagctaaacaagacgctttccaccccccctcccttccgcccgactttagctttcaaaatgggactaaagatgtctttagtcccttccttaatcccccttcttccttccaagctaagcaagatgcttcccacccccctcccttctgccctccttcaaagctaagcaagactaagctaagcaagacgcttcccacccccctcccttccttccgccctccttccgagctaggcgagacgcttcccaccccccctcctttccgcccgactttagcttcaaagcgggactatttagtcccttcccgcccctctcccttccgcccgactttagctttcaaagcgggactaaagatgtttttagtcccttccttaatagactttttcaaagcgggactaaagatgtttttaatcccttccttaatagactttagctcccttccgtccgactttagctttcaaagcgggactaaagatgtttttagtcccttccttaatagactttagctttcaaagcgggactaaagatgtttttagtcccttcccgccccccctcccttccgcccgactttagctttcaaagcgggactaaagatgtttttagtcccttcccgccccctcccttccgcccagcgggactaaagatgtttttagtcccttcccgcccgactttagctttcaaagcccccctcccttctgcccagcggaactaaagatgtttttagtcccttcccgccccctcccttccgcccagccgcccgaatttagatttcaaagcgggactaaagatgtttttggtcccttccgccccctcccttaaagatgtttttagtcccttcccgcccccctcccttccgctttttgaatagaaagttaatgtatctaaccaactattttacaggagtatctagttggcgaaggcgatttcagaataaaaaaaagtaaagtcaaaatcatttagaacttctaaaaggttctcgaaaaagaggtaattttttttgggcctgtattctttttctaggttcactaggattcttagctttctttttctaggttcactaggattcttagcggttggggcttccagttatcttggtaagaatattcagaatcaaaaaaagtaaagtcaaaatcttttagaacttctgaaaggttctcgaaaaagaggtaattttttctgggcctgtattctttttctaggttcactaggattcttagcggttggggcttccagttatcttggtaagaatattaactaaagatatttttagtcccgcccagccttttagtcccttccgcccccaggtggggttggccgaggcccaataacttaaggttacccggaccccaacagttcataggcacacccactcggggaaatgcccaatcttcctaaaagactagtccaataggggaagggtggctctcccttttaaggtggcttcctcctcccaagctaagcaatgtgggattattcagaggctcacacggtcgccgctcgactttagcgtctctgccagcgggtaatagtgtgggatgtcctcatcagctatgctgctaaaatttaaagggctatgtatattttagaatattggaattaattactttctgagaacgtaaatgtgggctagctagctgtatatacatgcatgcattggttttcctcggagcatatgcatcagatggctgtctagcagtcctccgtaagttaaaaaaaaggatggttgtcaagtactaattaatttaattagtctatcaccgacctgccaccggccttggggccttgccacgcttccggcttcgcttccatttcccagcgaggacattacactgtcttgtgggcctcataatttagctcacagggcccacatctcaactgcaaaatcctaacaatgttagtactgtacttctgtagtggtactacactacttactaccgctaattgcagtactttaccatctagtgtcggcgcaaccataccatcatgttagccgtaccataaagtctgctatcattgcgtaatcacggtttgtgcctttgtgggccttaattacgacgtttacccttggccatcgaagacaaggattaggcacaccaaacatcacgacagctcctcgttagtaccacattttttttaatcatcaggtgaacggcagctatgaacaaagctgagattttatcctgtacgtacaagtggaaattcaggtttcagatgggagttaattgaaaaaagaaaatctgcaaccgaatcgtggacttatctgcaccgctagtccgaggaggctgtggagagttcgactcggcgataccagtaggcgcacgcggcgcaccgcaccgagccgtcccgcgagcgatctcacattctcacgaaccaaacgtgtcacgagggcccaaaaaccacgcgccccgcgaggcgtcgaccgaccccaccgcgaactctcccgtcctatccgcagcggaggcagcacgcgacgcgagacgaggcctccacgccagcgagcctcctttgtttccccctgcggcctcgcgagaatccaaagttgtacttggcgaaaaaaaaaaaacagctctcgcaaaatctcgctgccgctgccgctcgcgagcaagctctaccgccactgccgcgcggctgttcttgcttctccggaggggaaggaaccccgcggggagggagccttccacccttcgcaaaagccacgcgccaccaaatcctccttttctcctcatcttccctccatcccttcctccctccggccgcgcgtcgctttcgccgcgaccgaatcggtggggtcgtgtggggggaggagaggggcgccataaaggcggctggggtcggcgatgatgagcggcgttggaggaggcagatcgggcgggagggacgcggagggcgagtgggaggtccggcctggcgggatgctggtgcagcgcagggacggcgacacgggtccggccgtcaggctcagggtctcccacggcgcctccttccgcgacgtcgccgtgccggcgcactccaccttcggtatgatcctcgcctcctccctcctcgtgaaactcgccgtgggcgattgcaacgagggtgccttgtgatcggttatgtttcgattagtatttttgatgtaggcaagctcaaacgcttgcccggaaagtgcacgacgaattgccgctcccggttagttacagcagcgaccaccatgctcgatctgctatgttgcacttgagctacggatcttgaccagtcaacccggcgattcgtcgaggagttaataagatcacatcgtccttgtctccttttccgtgaatcgaattggatgcaaatctagattcagaacaaaagcattgcaatactatgtgcttgtgtggcagggggcaggcagatggattatggtcctgctcttttaactataatatcctcttggactgtggcaagcagatgtacctaggtatatggcgacaaaaatatactagtttttaagtgtatatttgacgacatgtctgtgcgtcatgctatatccgtccaccattaggcccacactgaattactgttgtaccgctgtatttgtacacttctgttcattcatgacgttaaaactgttgtaccgttgtattgtattagtacactcctgttcattcatgacgttaaataggtgcacatactggctcaactgaggttgtgtgatttactaaatttacactattttatcattttctgtacagatggaagctcaatgttatatagttcaacgtttgaaagaagccttctcttatcgaatttttggagtagttcgcagaagcagtacatcatgatctgcttccttagaaggaactggtttccattgctttgatatgtagttaggattaattgttcactcttttgtatgaaggtgaattgaagggggtccttacccaggcaactggcgtagagcctgaaaggcagaggctcttcttccgtgggaaggagaagagtgacaatgagttcctgcatacagctggggtcaaggatggagcaaaacttcttctacttgagaagcctgcccctgccaatgtagagcagagggccgagccagtaattatggatgagagcatgatgaaggcttgtgaggctgttggccgtgtaagagctgaagttgacagactctctgccaaggtgaaggaataatgtttctccagcctcttccattaaacattaactcttcttatatcttgatgctgatacggtttttgtttttgttctattaccaggtatgtgatttggagaagagtgtgtttgcagggagaaagattgaggataaagattttgttgtcttgacggagcttcttatgatggagctgctgaaacttgatggcatagaggcagagggagaagcaagggcacaaaggaaggctgaggtacagtggccattatacatctcaacatgattggtcatggcttatctcatataatacaaattcaattactagtactggtgctgaaatattggtcatcctaagctttcaaaatggtttattttctgttgataaatagctatcacatactattactcaaacctgatttccttttatttactaaaatttaaccacacacacctatgctgatgatggaattttcctgatgaatcaacatacatctatgctgatgatggaatttttttgttccttaccatgtagtgtagcattgctaccctgtaatgataaatcttattaatgccctttataggaccatggcttaaaagccatgaaaagacaatacatacggcacatctagtaaagaaagcttgccatttagctattttctgctatgctgaatcaattatagtcttcatttgcatcacaagggtgtctcccaactccttccaggactaattctagtttctttgtttgactttgaccttcccccgtactccaatgattattttcttggttatgggtaatgaactagttgtgtggcttgagcagttccacattaagacggtccatttagccttaggcttgtaaccagtatagcacaaaactattttaacttggctgtgtggtttgaatccagcttctaatgcaaaacctgctggagcttatacttaataaatgcctggtctgatatgggatagacctgaggtttataaccatttattagtgttggtttcgagagaattttgccagattaggacctttgttggtcaagagtgaaatgctatttgtagcttcctcacttttttgttgccctattatattgaagaacaagaccagtgaaatggtcagcatgcgcagggtgcttcaaaaacattgttgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41712 - DNA, 1328 bp, Oryza sativa
gcccccttctccatccccaggggctctccgaggccacggtccgccgcatctcggagctcaaggcggagccggcgtggatgctcgacttccgcctcgccgcctaccgccggttcctgaccatggtgcagcccacctggagcgacaacgtgtacagccggtggatctccagtccatctgtactactccgcgcccaagaccaagcccaagctcaacagcctcgacgaggtcgacccggagcttctcaacaccttcgatcgcctcgggatcccgctcagcgagcagaagcgcctcgccaacgtcgccgtcgatgccgtcatcgactccacctccatcgccaccacccaccgggaggagctcatgaagaagggcgtcatcttttgctccatttccgaggccatccgcgagtacccggaccttgtcaagcgctaccttggcagcgtcgtgccgccggcagataactactatgctgccctcaattcggccgtgttcagcgatgggtcgttctgctatgtgcccaaggatacggtttgcccaatggagatatcgacatactttaggatcaacgacaaggagaccgggcaatttgagaggactctaattgtggctgatgagaggagcacggttagctatctggaagggtgtactgctccagcttatgactccaaccagctccatgcggcggttgtggagcttgtgtgtgaggagcaggcagagatcaagtactctacggtgcagaattggtactctggtgatgaggaggggaaggggggcatttacaactttgttactaagagaggacggtgcaaagggcggggctctaagatctcatggacacaggttgagacaggttcagcaattacatggaagtacccaagtgtggagcttcttggggatgatactgttggagagttctactcagttgcactgacgaaggattaccagcaggcagacacagggacaaaaatgatccacaagggaaagaattcgcggagtcggattatatccaaaggtatctcagctgggaagtcacggaattgctaccgtgggttggtccagataaactcaggcgcagaaaatgcttataattcttcacagtgtgattctttgctgattggggataacgctgctgccaacacctatccgactattcaggtaactgctctgctgttcttgatttgcctggcatgaagggccaattgcatttttataatgcaaactattaagagtaggttgttaatcctttgttctgtatgtcatttttcagtttctgttttacaaaagcaatagagcatgtataaattaataggggctttgataattttgcaagt

SEQ ID NO: 41713 - DNA, 1400 bp, Oryza sativa
cccatccacggccgccgccatggccaccaccccagccgcctcctcgcctcctccgccccgccgccgccaccaccacggcctcccaagcccgagccccgtaccagccacgagaacctaggcgacgacacccccgatttccccacaaccaagccccgcaagccgcgccgcgggcgccggagcgaggcggcggcggtggaggacttcgtgcgtggccgcctcgagcaggtcttcgcttccatccgggagcgcgaccccgaagtcctcgaaggcaagggcgacatcttgaagcgaaaggaggagctctccgacgaggagggaaaagaggggactggtgaggaagagggggagctgaaggctgtggttgaggaggaggatccctcctggcctctggacgccgacatcgggtgggggattcgggcgtcggagtactttgacaagcattccatcaagaatgtgacggtggatggtgtggagatcgattgggagagggaggtcgaggagggatgggtcaaagagatcaactgcttggagtgggagagcttcgccttccaccctagccccctcatcgttcttgtcttcgagcgctacaacaggtataaatcactattctacccagactctattcatgtgaacccatagtacctatatgttaggaccaaagtgataaacttcataaacttcaagcttctcactttatattgtcatatctgataattttgaatccattgaatcaaaagttcagaactacccctgaagtaatgcataaaaatgtaaaaatgtactatcgttttgagttgcctcagaaaattaggtgttctacttccatgacaggatgatatgtacgcgtaatgttttgcctttgtttatagggcagctgacaattggaagtttcttcaagaattggaaaaggcggctaaagtttactggaatagtaaagatcggctacctcctcgggtcagtgtgaatcatatttatagttaatacttgatgtattacggtaaggttattgaggtggttggtcatatgctaaatttaattgagttccagacagtgaaggttgatatgaatattgagagagacctggcatttgcacttcaagtaaaagaatgcccacaattattattcctcaggggaaacaagatattatacagggaaaaaggtgagtagttagttccatttttatggtaaatcctgttcacatagttaacaaattgaatggaactttgaattattaaattccttgattgctaatatgcactttcatgttaggcccacctttttcaatggtcaaaattgccactctgacaacacctgattgcctcatttgcttgtttacagaactaagaactgccgacgaactagttcaaatgattgcccatttctactacaatgcaaagaga

SEQ ID NO: 41714 - DNA, 5511 bp, Oryza sativa
ttcctgcagccctcatctcaagttgggagggggtcaggtatcaactatgtcatatattttggtatgctcatgtttttagctgtacactttcacctttgtactgtactctaacaaaacatacagttcatcaaatttctagatagaacaggagggaatgctagcttaattatctgcgtggccatcctgttaaggaggttgtaaagtcgattgtaaacttttgaggcgtagtgtaatgtcatttcacgccatagatgcaaaatgaaggcaggggggtcaacccatttgtcatcttataactcctctgattatttttcagtgacgtaattgaatttgttggatggagaacgatacaagacataccatacatgcattatagggtcattttggtagaacaatctcatcttgtggaactgctttcagatactcttttctttggttagcccccctttttttatcttgggtggcaaagggggtatagttgtgctccaaattcccatgagaatgggatggcaatgcttcccccggtctcaaaaacaagtcgcttgagaatgcgtccagtcagcataagttaagtttggctataaaataaattaaagtatatgttttgggtgtttccatctataaaaataacttgaactataggttttgggtatatgaaaatgatatatttaagtttgtcataacaagagctttaatagtagactgtccgcataagagagatcatgaacaatctgccactggttttgagtgctccaaaaggaatgcaaaatgcaatttctgatcaaaggtactagtacgaaatggaacacgcgtcatgtcagcctatgaaatcaacaattattaattgttccccatatcgaactataaagaaaggaatccgatgcaaacattcactttgcttaacaagagttactgacaaaaacagaacaatcacctctgtaaactataaaactatacagtacaatactgtcacctagactcctggtacaaattacaaagtataaacaacaactctggattgagcagtggacacaacgaatctacgcacacgatatcgaggaggaagacgaggacgcgatgcacaacgccggcgcggccgcctcgtcggcgccacggcctcgcagcagcagcgcgatggcctcgtaccccatcgtcacggccatctggagcggcgtcgcgccccgcctggtggcggcgtgcacttcggcgcccatgtcgagcagcagctcgacggcctcggcgctgccgccttcgacggcgaggtgcagcgggcggtgcccttccacgtcctcgcactcgatgtccatgcagcctgacccggcgagcagcgcgatcacgtcgcagtgccctttgatggcagcaaggtggagcgccgtcaggccgtactggtcacgtccccggacgccggcgcgcttgctgaggagggactcgaggctctggaggtcgcctcgcctcgccgccgtcatgaccagttcccaccgttccaggacgtccaccacttcttgctacacccaccgaacaacatcgtaactacaccagtataacttaatttgtaataaaaacgcgctgcttagagtacacttcttgcaaaacaatactgataatgctgctcttgaaaagtaacagaagtactgttcaaccatgtcatttcgcagacagaaagtcccatgctggccatttatgcatttctggtggacaataatggaattgcactactgtagcgtcgtcctactcctatcatgattcacgagcgcatcgacaggtcacataagccaagctacctacgtacatcctccagctggtccatgatcctccccgtcggttctgtaacttttgtacgaccagtgatgctttacaagtctacaactaaatcaatgttttcctaatttgacacaaacgtttttacgacctgctagtgcatttaggaccacacagattatggttcacattcacacatggttgcacggttagttaccaggaggaatctttgtcgagttgcaattaaaaagcagcatccgaattccctgagcttaggtacacgacagtaagaaggacagacaggtagattctagtaggagtaaacttacatagcccttctcgcgcgcgacgtccagtggagtcctcccgcgcgcgtcggtcgccgcggcgtcggcgcccatgtccaccagcgccgccgccgcctccgcctccccggccgcggcggcaacgtggagggcggtcctcccctcacggtcgcgcgctcccatcgagtccggccccaggcgcctcacctccccggtgtcccccctcgcggccaccgcgtgcagtggcgcccactgctcggcgccgtcgggcaccgccgcctcgggctccaggagcggcaggaggtgcggctgccggcgcaggatgaggcgcacggccgcggcgtccccggcttccgccgcgaggcggagcaggtacggcccgccgaagaacacgcggaggcggatggcggtggtgccgccggtagcggcgctggaggaggcggaggagtcgaggtgcgcggcggagagggaggagagcacgaggaagcggtcgcctcgggagcgcgggaaggacgcgggagcgtgctgctgcgggcggagcacgacgcggagggaggccgacgagagcggctgcacggcgccgcgcggggggctgacgaggaacttgagaggggaggaggtctggaccttgaaggcgacggggagggacgggtgcagcgagcggaggcggaggtcagcgcggcacttggcgttgggcttgaagtcgatgacgacctcgtcctccgccacctccaggagctgctcgaccgccggcttgtccgcggctgctgcggtattggcggccgggacgacggcggtgctcggcggcggcgagggagaggctggcttcgcggtggccatttcttggaaggcagagagactggtagtagcagggggtggaatcggcaggggaaggcatggaatggtggctggcttcctaggacgccgcttttgatgtcacgctggatgggcatgatgggaatgttgatcgtttgtgcatacggtgtcttgtgtggagtagtttggctttttgatggtttggcctctacatttctacaacttgtccgccacttgatgagtaatgtacaagtgaacagcacacgctgccaaattaacacagccggggtgtattgccgagtatgtaacgttatacaagcagtattacaaccaagtggccgatcgaacatactcactgactatatacaaacaaaagggtgggttttttaaaattttaaaataaatggtagggagtatttagctttggttaggaattttacggagtatttaggctagcatgttcatacacttctcaacaaaagggtgaaattgaaaccactcgtcatgaggtagtacatactcatgctcatacgtccacacacttcttaacaaaatgtagagttgaataagacgataggaagggagagcaacatgggtttatccaaaatgtttatacggtaatagagtaaatacctcaccaatatcctacttccttcatcccaaatgataagttgtaaagttgcatagataaaaatcaagttgcttttacggaaggaatacttccaacgttacaaaaatattgataacaccaaagaattcatctcacattggtacaataatcttgatataagaaaaaaaaacgaccatttctggaaacctctttgtcataagtttctagtagtttgaaagtcagtttcggggaaaagtggttcaaacaattcttttatttgattgaataggtttcctctccttgttggaaaggtatatatgtccctactatttgaggataaattttttaattcggttgaactaattagaacaaatatatgcaggtgaaaatgcaaagatttttctgaacattaagagataatagataaaaaatgcccatgcattgcaacgggtgaaagctattctaataatattattattgttatatagtttagttaaggtaaaattcactgtggaaatcagcttggatatatatatagaaaatcattagctataattaggagtccgatcatctcaagttagcaagcgagttttttaagagatttcttatatgactccttctgtgtttctaaaaacgaacgaacttaaaacccgtctcaaatacagatatgtatttattaaagtgaacgaacttaaaaaccgactcatacacgatggcataccaaagtatcggtaaaaacatctttaatttttataatagtagagattaataaaaggtacataataagctaacacgatgagttttatcttatctttttctgaacggttttctttaattataagaggataagatattatcctcttaacaattgaagaaaaaacattgaggacaaaatataaaggaattcctcgttttgctcttacttaattatgagattaattttggaactcactccatggagaggtatagtaatataatatatgtacctatagttaattcaccaacagattttagtgctaggtagcattacaaacattttaaatttctttattatagaagttacagttggagcgcgcaatctagctcatcaaccatgggccatctctaccacatgctaattgatggatgtggactgccctcaacttttaatactgatgtggactaaactcaccagttacgaacttacagtaaagtaggagatgtgcatgcaccaaatgatacttattttaccaaaatttaccaataacaaaattgaaaattttgacatagtagcagtagataatcagaccaacctaacttaactgggaccactcagggattcatagcgttcagacctataccgttttgcgcagcgaaaacggtgaattcatcctggaagtggatcgagttcaattgccccccaacccagaccgtagatggccacaccatcgccggcaggccgtaccgaccccggcggatccgactgccactcgatcgcatttatctgctgggacctgcaaagaatgatggagccaggctacgatccatccagcacgcacgtcccatcagaacgggtggcaatcggcaaatcacgccgagcaagcgagcgcgctacagttccctcgtgaaggacttcagacgagcacagcctcgcacgcgcgcgacgagaatacggccccggtcgcttggtgaaggtgagaaccccctcaatttcgttggattctagcctgcatgtgcccggctgccctctcctcttccccccatttcccttgccgtttctcgcgcacgaatctgaacaataccggggcttggccgcgtgccccgcggctcggcggcacgcggccgcaaggagacccagtggagtagtagaatactcggcttcaggggatgctgccgctacccaacaattccgtcgccctggacttatcacgcgccgtaggtcatgtgtaagtagtagtacaatcctggtaggtttaaagtttaaacccagacgttgagttccaggtcgatccaccgggcatgctcggatggatggatggccgg

SEQ ID NO: 41715 - DNA, 6945 bp, Oryza sativa
gcagcccttagcggtctccaatgggcctaaattacatggacacttccttgccttctcatcgagtttaattagaatccttataccacaatactagacatcttcacccttacctagttataatgtggcatcctagatagtaataaaataaaaaacatgtggggccccactctcacctctcttcctaagtagctcgctagtggggagaggggcgtggctgatgagcccatccacaggaggtgacaacggtggtgggacgctcacctcccttgcacgcagccggacggcgggtggcgctacttcgtcgaggactcaaggtgaacagtaacatctgcagccacgaactcgtttctattgttgtgccacctcgtacgcatgtgctatggagagacgccaggcgccgccattgccgccttccttctcgtgagcgcagggccgagctcaaccttgtgcgaggctcacacggctcacacaaccacaatagcagttgccgccgacgcttcctttctcacgggtgaactcacgctacaccgctttcttcacaactagctctctgctcaatatatcttgagctcgagctccttcatcttctaccgcagcgtagatccggaacaatctcgtagccgccgagagtaggaggccacctgccaccagttgcatccctctttatgcttgcgcgcgaaattcgccgtagccggccatctgtgatcaaaccccgcatcctgggcaccgctccctaacgaatgcagggctggctactttggggatggatgactcaacgtggacggtgacctcctgccaccgccctcagacgacggtggtaccggggtggcaagaccacccaaggcggatggcggcgacgcggaggggactacgagggtagacactaacaagggaggggatgctaagggcatggtttgctagcatgctggaggagggcggtggcttcgatggtgcggatggggatgacacggattgggtggtcggtggcagcttgtctgcatgtaggagtagatgggaagaggtgagaagtattagaaggagaggtggccatttacatgtgggctccacatgttctttaatctttttttctgactaggatgccacattagcgaaaaacaaacacccatattattatgggacctgatttggaccgttttgctaagataatgggtggagatttctagtattgcggtttatggatgttaattagacttgagtactcgacgtaaagatgaggggcagcaagtggacttattccaatggcataaatacagcttaacctggctttcacacctctgaaaagggctagttttgaactggcgcttggcccaatagcaggtgatcaagcgatccctatctaggaattgctatttagcacaactacgttctcaatatgcattttttacttttgtttgcaaaacttttagtagtgcctgcaaacttccatttgtaagtctttcactagaaactttgttgtgggccttatggaccaaaaggctaaaacatgtgtgcaactgtgctaattagccttcgtgcctctcttactaaaattgctcaatattatttgaacataaataaatatatatttgtgttttttttcacgctgataaaaatatagttgtgttaagaggtacatctcctaagggagaccggctctagagaaaaaaatatgtgaagactggctcgaaaggaagcctgtgcttatctacttccaatacatggtatatgtttttagtcagtgagatccagggcgtgatgaaggaggccagggatatgaagctgaagaaggcgaacagggactgcaatcgtattagccatattttagctaataaagcccggtgtaagtcccctacgaacttttggccggacggaagttgtaattttatttcccaccttgtgtgctatggctaagtaataaagttcatgtttttccccgaaaaaaaagaataaactaaacaaacctatagccttatttctatctatctatggtaaatctatggtaagaaaatctagtggagtttccaataattctaacaccaatggtgaaggctcgagcccccgtcatctcatggttgatgcgcccctgcacaacatgtgtccatccataggatccaccggctttaaaggtggacgacggaagcgacgaaggtgtattttttccatatcctacggtcataagatcccatcaccctcatgtaccgagaaaaagcaaagcctagtcagcatttcgctttgtagcgatactcctacactcgcaaatagcaaactacagtactaaacggtgcgtttcgctttacactcatgaagatataaattttatctcggtttccgttagcacgcttttcaaactactaaacggtactccctccattccaaaatatagggcataaccacccttgacccaaagaccaagaaacaattattatcacctatttgtcaatccaactaatacaatacatgcacccaatagaattaagcatcttgtgagtgtatgatttaaataataataatttaggagagaagagatgctaattaattgccatacatgtatgcacgccttatattatgaaacaactttaaaaagtagttgtgccctatattttggaatggagggagtatattccatgcgaaaactttttatatataagttactttaaaataccaaatatgttcatttatcagatttataataattgaaacttaattaatcatgtgctaatagctttctcgttttacgtacatcaacttaatatttatcttcatgagtttcaaacatcaccataatgtaatcaagggaatgattatggaaggttatccaaagtttgagaaaaaaaaaacatcattggacgagaacactcctttatcctttcttggagtagttttttgatatctcattagcattctaagatttcgggatcgttcaaggtaaccgtggttagccaggtccgtgacagttgctaagggtaaccgtggacgtcacatggcatcgccaggtttagtaggtctgcagaatcagagatagatcgcgagcaacctctccacttctccaactctcgccgcatggttccggtaccaaaataaaacttcagcccatctgatggtgacggggccgtgccacatgcatgctaggggtcgaagcagaggcatttggctgtgtttagtttcttctaaagttagaagtttaggttaaaattgatacgatgtgactgaatgtgtgtgtatgacaggttgatgtgatggaaaaagttgaaagtttggatccaaaatttagatgtaaacacagcctttgaaatgcggcatttccactgtccttgaagctttcgcagcctttcgctctcttccccggcacccaccacccgtcacgtgaacggagcacgccgcgggcatattctcgacccctcgatgcgttggtgaattggtggtgttgctgatggcgctaggttatctaattctctgagtaccgagtgataccgctggactgctggcaggtacagtacaatatattttccgaacatcagtcggtggtcaatgcagcttactcctaaaccgagctgtcagcactactttccacctgctaattaaaacttgtatcccgagacagagcagtcaagattcttgtatgattattttaggaagcaagaatgtaaaacctgtctccaagttgtatttactctgtaactaaaggagtactagtactacttttgtatgtgcaacactagaaatacagtaacaactttagagcgaagctttgctgagaaagagggcaatacagttaggccattcacagtgcaccctgctggtattcagcccgagcggtccacataggcgagccgccaaaaatcgccgccacgtcctagcgttggcccacaaatcgcgagcgcgtgtgaccaaacttggtcacccgttcttcggcgctatcgaggcggggcagcgtggagaaacaagggcatggcgcattgctgaggcgtggctttgccgcgcggttcctcccggcgcgcttcatccccaaatcgccctccctgcgcgcgcgtttcttctcctcccgcgctcgcctgaatcaagcacaagacatgaacagctgcattagtcattgactgattgacatactgcactgatcgactgttcatctattggaaaatcaacatccaactactgaaatttcataatcacaaagaccaaaaaaaactaaaccaattcaaagcatgaacccagatgagaacctggaacaggttagcacacactgaactgattgatggcttcaacacctgaagcgtatacatgaacacaagaccaatctagaatcgatgctttagtactaatcaataaaaaagacatcgagaacaaacaacaaatcacgctggaaagaacttgccttcctcaacagaaaaccgatctaaaaaattctatctgaaagagcagtccaagaagaaagaaaaaacaggagatcagtctctgcaacaaagcaacccaagaaactaacctcccagagatcgcggctcgtcgcgccgacgacggggagggaggggcgccggcgacgttgatggggatgggaaggaggggcgccagcgacagggatagggatgggagagagggcgccgacgatggggagggaggggcgccggcgatggggatggggatgggacgcggtgagggggagaagaagtggcagctccagccttatctgattggggagaaatctatacgtattatctgacttttggggtgcaaagtgtaaaatttggatttctttgttaatagaaagatagcaagggactgaaatagaaaatacgaggggctgaaacgaaaaaaccaaagctacgcatgaagacccttgcactgtgggagagaaatttttttagggcgtggtttcagcgcacatggcagctgtggctcctcaaaactgttgggcgcattgtaaatgccgttatggtggcatcccctgcaacgcacgagcctgatgttggttatcactcactcacctgtcaatatgccattgctttgaagcacggttttccaatactggcactccgagaggcaggttcggtagttgccaggtgacagtcgttgcctgagacagtttgggggtgcagaggaggagtactagcagaaagaaggcatccattttgttgtgaaagatctttacatttccttgttgcttcaccgaccgtgctacaggagggaaaagccggcatgcaataattcgacgtcgcaaaccaaactgcaatgcttgcagataaagccaatcgtatcagttaccgtcatactcctactgttcttgagtaccctgcctggacaagcatactatcatggtactcgtgcatggtacatgggcctttcattagctttacacaacgggattatatagtctgttatcttcttatgatactactaatgcattatttttagaaactctcatagtgtcatctcctgaacaatattaatttcttcatagttttgatctttgatccactgggcaggagtgtactgacatgcagataagtggcccactgggcagtgttgtggggttgggttcaataatgaaggataggaggaggtgagaaaagctaagctcatagtatagtcacatgtttgtcattaagtaacagaaggggcacaggaagaaacataaacaagagaaaaaagacacccacacgttgggccatccattttccacaaatcagcaccggccaccgcgtcctcttgcattaaggctaaataaaccatccattgactgctaggaaaaaccctccatttcaaccaaattgaacattttccataatgttactgtgcggagatatgatcaccggtctttaccattacatagtttttgtccattatataaacatggcagttctttgtgctggtcagaaaacgccatgcagtttttccatccccttctcactgtaactaagttaatcaaagagtacatcgacatcactagggccattttcggtgaaatgactctatgggagaaaacgacgtcttgcaaccttcacgtgccatgacaccaacaactcaaaatcctggctccgcccgtgtttgtgtgtctttctcaattgcaaactatcgtatataggggaacatgatagattcatgttgctgagttcttcttcttcttcttcttcttcttcttcttcttcttcttcttccgtaactgtgtgaattcctacttagtatataagtgggttgtttacattatttaatgaaacattatgttacctaaaaacataaataacatatgactatctttcttgagaaaatcctactagtctagtactgataatcgaaaaaagacattttttagaaagttctctctccatctcaaaataaaccaatctaagatgtaatgggacatcacccaatatgataaatctggatagagacatgtctaaattcgttatactaggtgacatctcatctaatatttgtttattttggaacgaaggggtacttcggtacataagaaaacacaccctacaaactttgaggggcgtttttctgaaggatcaaacttttaagggctagaaaggaaaagaagagcgctcctcttcgaggcttcaaaccccaaccaaacctaacaacttcgaaaacttgaacccaaaaccaaaacgaaagcgagccaaaaaagctgtagtaggcctaccataacacaaaagcccaaaacacacgcttccccgcaactccaaaaccggaaaacgaacaaatcccctcgcctcctcccccctcccatctccgcccccgtcttcccctcgcctcatccatctcccccatgtggctgccctgggtgaagacgcgcccctcctccccttcctccgccgccgactccccctcgccctccaccgcgctcgccgccgccggcgcctctgctcgcttgtccttctcctctccctccctcaaggacctccaggctctcctcctctccgaccactcgccctccccgacgcc

SEQ ID NO: 41716 - DNA, 5609 bp, Oryza sativa
cgacgagcgggacctcgccatggacccccgctacctccaggagctcggcgcgctcctcccccgcgcgcgcggtgtcaccctccctcaggtcttcgtcggcggccgccacctcggcggcgccgaggaggtccgccgcctccacgagtccggcgagctccgacgcgtcgtagccggcgccggcgcaaccgccttcgccgcctgcagccggtgcggcggcgagcgctacgtgctctgcggcagctgcaacggcagccacaagcggtacagcctcaagggcggcggcggcttccgcacctgcgccggctgcaacgagaatggcctcgtccggtgcccggactgctccccgccggccgtctgatccagatccaaaggtcacaatctcatgactactagattttaatgtttttttagctcaaacttgagatatgaaatgagctgtgtgtgtagctgttactcctactacttgttattattgtagtggtgtttttgtgtgtgacagtgcccaattgaaacttccaagttcttagcatttgctaaccaacgtttctaatgtttgattaggatttagtaaaagagttgttgtttccttacttcttggctatagtaccaagtaccgcttttttaccctctcttagctcagccttgaatggcagattgtcagtctgaatcggtttgttctatactcttattttaacttttgagtaaatgattgataaatgccactagatgactagagtagcagttaagaaagatatataaatctactagtagatgcgtgaattctactgctgttaattctcacttcctctgcaatatttggcctgatttcaaaactgttcaccgctctgatcactgagctcgaatggctggtgcgatgttgcttgtttctttactgttgaagtttctagaaagctgctactcctgcttgccagtcgccatacacgccaacggttgctggcgatatctatggtgggctgctgctacgctgaaaaagcaagcgccttgctcagaagtcagaaagcttttctttcaaggctgctattcattcggaaaatggaaagggtgcggcccgggtttgaatgcaatccgatcggtgaagtgtccgttgcataggacaggtttcagaggctcagcgtactaacctccaaagtatcatcgaactgaaaacttatgtgaaggcttaacgagtcgccagccagccaaccctttttccataaccatgaggtagtagtaccttttcaggtttaagagcttcaaaacagccggtacgagcacctccaacaaccatttcaaatctagctctccaaatccaaatattaataatggcagtgtttagttcccttcaaacttctaaaaattcagtcacatcaaatgtttggacacataaatagagcattaaatgtgaacgaaaaaataattgcacagtttgcatgtaaattgcaagacgaatcttttgagcctaattacgccatgatttgacaatgtgatgctatagtaaatatttgctaatgacggattaattaggcttaataaattcgtctcgcagtgtataggcggaatctgtaatttgttttgttattagtccacgtttaatacttcaaatgtgtgtctatatacttaaaagaaatttggcacatgaactaaacacgaccaatatctctttgatcagcttgtaaaaaattaaagagccaaatttacttttcagtcattccaacatgactgaggatttcacatgtcaatctctatacttcttcctttctccatatctttcccctcctcacccccctcgggggtctaggcagaggtgttgacgacgatagtgtgtggaggcggtggagccagcgggaggaagttgggacgacgtaggccaaggtcgaccaacggtggggatgctacctccggtgacaacctacaacacgtagatctggacgtctatagtggagtaaggcaaggaagctggtctcgagacgacgatggcgacaacatgcttctcatcgacgccgaggggagacgaaggaaggaagagttgattggccacctcattctccgcgccagttgccggttggccctcccacattgctagcgctagggggcgggctccggcatggccgttgcctcatctcaaccaccacaccaccccggatttgcccaatggctgccatcgacgcttcctctcctctggcacaagagggaagaggggagtagccatgcgaagaggctgttggatcacaattttttttgctagacttatcaaaatttaacttagagaactgttcggagagaccgttgaatatgttctaaggtacaattcaaagtctcagattgatcctaagttcctaatcttctctttccttttcttccacttccatacatgctcggaaaccttaaataccagcgagcgtgtgactcaagatgcagcgatacaaaagtgctgttcttctcttctctctcaccggctcccaaaccccaatttgttgaagcgaccaagcgtcgaacatgatcaggcagcacattgaccacccatgtggtgcttttacttgccacattgccatctcgtgccctgtgcccgcaatgcacacttgcacagtgctagctgctagttagcgcaaccgtgctccgtgcaaagcgcgcaacgcgttgatggcggcgcacggcatggtaccgtgcatcagtcaccacaccagtcagagtcgcacaactcacgccagtggccggccgctcggcgtgttgcgcgtggaagtggaaccttgcggcggttacgcttggcgtcaagggctaccggagcttggagccgcgaggggcgcaagtcccccacggcacgtggtggtgggactcggtgatccccttccccctccggcttcccaagtcccatccatccacccagtcgcgcaccgcgcacacgcagcggtaacgtgcctccgcgagggccccgcgccttgacagccttgttgattgcggctccgctccgtgcgtgctccatcattgtggatcaagtggccgcttcacagcaagtgtagactagttgtagtaccctgctagtatgtcctaatcctgctgccctatatgatgcctctctttccatgactttcacgatccactgtttgtcggcgatgagggttagagtgaccacctagccgtcaccagcggtggccgctgctattgtccttcagagcttgaggtgaaggtgttttaaatgctggctcattagcgcttgaacctcatgaatgggccggcagcctctgcgtgtggaagcattattaagtgtaccgtgcatatgtgcatgcaacacgtcgtcctgccacgtatgtacgttcacgcacgcatgaatggctgcctttacggtttgctagcctgtggtaccagaaaggcaagaactttgaatcgagtaaatttctctgttctaaaaaaagagtagtaaatttctcaggctatcgtcaataactgaacaggaaaaggagcactgcagagccggccatttactctaggcaccctttgtcccttttcctgcccttacgcttgtaattttgccactgatcaccaccggtaatggtacaactggaacactgtaggagtaacaaaggacacatataaggacgcacggatgcagtaacttgccggaaggacgcctaggattattggaagtttggaggcaggcactcgcagatgggccacaggtgggagcagccccatttgcagcggccgtcgacgttgccgtgatcctggcatgtctccctgcacttgtgggtgtgggtgcatacgaggtagcggacgttgtccacgttccagcagtcctcaccctgaacagaccacacctcgcctgacatttaaaaaagaaacagattaagcagcagcgcattgaggatggaggtggcgctgatgggcaaggggtgatgctcattgctcactggaagcaacgatgagcagcacaagtgcacagcggagcacaaggcagtctttctccaagcgaaatgcagatgaattggtgaccaactcgaagggtaatgcagcaagccagcaacattgtagtgtgttcatgtatagaagttgtgactcgtaggccgagagaaaactgaaggctcagatcactggaggtcaagcgggttatccgagacaattataggaacaagaaaactgaatattgatgatatagagatcagttctagatttatactaatagttggtattaccaatgatttggctttaatccaaatatacactatcaatattcaaattaccaaattgatatgacatattttgacatcaaaccagaatgacccataaatttcacaacttttatatggctctacccaataagcaagggatacagtccaagcaaatcgggtgtattcggatgccacttttcccaacctctctcattcgttttccacgtacacgctttttaaattgtttaacggtgtggtatggtttcaaatttgagagaatgacatatgggttcctaggctaagaaattgtagtacgacatagttgcggcattgaaataaacacatatctaagaaagtgtagcttggtaatgtgaggcaactaaccaaacacctccttgctgtctcaccacaatgccactttacattggctatgtaagaagaagaagaagaaccaagttatacatagaaacacaattccctcactagatcgccacagtaacacaaaacatccattacaatcctaaaaagatcatatcaatagttgcaaagataaataccataattactttataggcataacaccatgattaacatgtttataggcacatctgatttattctagctgtcaggagatgagagcagtcctacataaatgcatagatatacatgctccacgcgcagttgttcttgcaactaccgatcaatctgaatgatctgaccttagtttctgctagtcctgagctgcgtcagcttggtggccatggccggcatcgtcgacgaggggtcctgcttgccgcacttcctctccctgctgccaactctcgggctgccactgccactgccgctgtccgttcctaacccgatggacagcttgctcagagccttccgtgcgtcggtgcagtacttcttgctcgcgtcgagcagcgacgacacgccccatccacggcttgcggcctgccattcctcgcggctcctcttctcgccacgcggccgcggcaagtctcggccgccgctgccggtcttgttctcctcctgcattgcgtcgcgtagggtgacgaacctgcggctctgtgaggacgaagggttgctggcgccggcgagaggggacggcgcgtactgcgccggcgggctcctgaacccgcaaacggcgggcttggcgctccaggggaagaacaccatgagcccgcaggctctcggtgacatctgctcgtcgcggccgttgatgttgatgcgcggcaaaagctgcacctggacggggtggtcgttgctttgcctggccgtcggctgctgcccgtcgtgatcgcggcgcgtggtgcgtcgccgccagtgtttcgggcctctgcccgaggacgaggacggcgtggcgagggaggcttccgctggtgcacggcgggaggaccggtcattgacgaagctcgtggcgcggccgaggaagatgtcctcaag

SEQ ID NO: 41717 - DNA, 1369 bp, Oryza sativa
gttcttttgcctctcgctagctcgttcccgtgatcaaggtgcatgctcgatggccttaatggtggaggttgccgaaaggtagcagaggaaatcaggctaaaacttgcacacattacataggctaaaagcttgtgatgtgaaacgtacgcgtgtctgcattggccttgccatgtgtatagggtggttggtggccgccttggggattcgtccgcggactcgggatgcactgttcaagtgtccagggcatgtttgttcggcgatggaatcccggtgatcgccgtggcttgaggggaaggtgagagagacgccacaacgggtttagctctgttccgctattcggcccattaacatttgcttatgggccacctatcttgtggcgtgggccagcaggttagtttggtgcacgacacgactccacgcaccgttccacctagcaactgacgtcgtagtcagtagatgggtcggggactctcggagagcggttcgagggggccgtcgtttgcgaggccgcaagtcgccgtcggcggccgtcgccatcgccgcaacataaaaaaagcgagcaaacccgttgctgcgcgctctgcgcttctgcccttttacgaccgaagaggtagccaacccacgcatcccccccctgacctgccccctccacagccgccgccgccgccgccgctacggctcacgagagtaccgaacgatctgctgccacccccaacccaagtgaccaaccgaaggcggagggtagcaacttcggtctgctcatcccaaggtactagactgtttagtcgattggaggatctcccatgcccgtatttgtgtcgattgctggtggtttgggacgagatctttgcattgggcggatctgttttgtgtatcgttgttgcttgtccgcgcaggtggtgggttcctactttcgtgttgcttccttggtcctgatctgttcgcgttggtgcggtttgggttgcagcgtagttcttagttctagcgtgaagctttgcggattggtgttgtctgtagatttgtgagatttacaaaggattggcgccggctgtgctggatcagtagattgtgaccgagcagaattgagcgggctgcaacggcgtactagagaaaagaggaaccgggacaactaaagattctggtatactggtattctctggatgctgatggattggaggaagacgatcgtagtattttttttttttttgatgtagaaaggcatcaacaccttagttactttaggatggatatagataccttgtggggaaacggtatggaagatactttagcacccccaattttctcatcttgctcataagttttgtaacttggatgtcaggtgatgataatgctagaatttagcttcaga

SEQ ID NO: 41718 - DNA, 2363 bp, Oryza sativa
  unsure (1)..(2363): unsure at all n locations
atattgcaaatgtcaaaggagttgctgctgatctgagccactgcaacacaccttctcaggttctggactttactgggccctcggaattagccaactgcttgaaaggtgtggatgttgttgtcatccctgctggagtcccaaggaagccaggaatgactcgtgatgatctttttaacatcaatgcgagcattgtcaagacacttgttgaggctgttgcagacaattgtccagaagcctttatccatatcattagcaacccattaaactcaacagtnnncagtgcccattgctgctgaggttctgaaacagaagggtgtctataaccccaagaagcttttcggagttaccaccctagatgttgtcagagctaacacatttatagctcagaagaagaacctgaagctcattgatgttgatgtcccagttgttggtggtcatgctgggattactatcctaccattgctgtcaaaaaccagaccatctgtcaccttcacaaatgaggaaactgaagagctgacaaggaggatacagaatgctgggacagaggtggtggaggcgaaagctggtgctggatctgctaccctgtcgatggcctatgcagctgccagatttgttgagtcatccctccgtgcattggctggtgatccagatgtttacgagtgcacatttgttcaatctgaattaactgagctgctgttctttgcatctagggttaagcttggtaagaatggtgttgagtccatcatttcttccgaccttgagggagtgactgaatatgaggccaaggcccttgagtcattgaagcctgagttgaaggccagcattgagaagggcatcgagttcgtccacaaacagcaggctgccgctacttcttgaagtgtggagaatgactatcggcatgagagaagataataaatgcagaaatggttctcaatagcttttagttttgaaggcggaatttttcgtgtctagttgttgcttgtttagtctcttctgatcacatgagggcgtggatgcccaaactgttgcctgttttcatgagctatttgacccttgtgcctgcatcttgatgagatacacaaactaaggaataaagtagtttttgattgttgcctgatttatgttattatatataccttctgggtagtgcaacatggcattgcgccattgcctttggcaaaatagcaacctcattgatatcatctctcactgtgtcactacttaccaatttcatgccaaaattttctgaacagctagggcgaggagctgctgctgcaatgccatggcacgtctgtttctactgaatccgctacaagcctacaactctggtaagaaaacaaggcaaaccatgttgaatttatttcggctgccatagtatgttcgttggattgaaatctcaactgtttgaaaagcacaaaaagtccatttcgctctacatgaaaagatcagttctatcactaaataatctacaggtgttggaagaaaaagaacggaataaacaattgtgcccacttcttcctcgatcaagaattcaggatcatccagctttagccttactcgccaagaaagcgtccagcttgtcgttctgcacccggccgaggaacctgatgcagatgggcggcgtgacgtcgtacctcgcgagcagcgcgtacggtatggagaagaggccgtcgccgcagatgagcccggacgccagcaccggcccgaacacctgcgatcccagcttgtcgttgcggttccacaggaacacgatcaggctgccgatgcacatgtcgatggacaccgccggcaccagcaggaacgacacggccatgccggtgacgctcgggatgtacggctcggcgcgccacttgccgtgcgcggccacctcccgcatcgcgcagacggccagcgccagcacgaagaaggtggcgctgatggcgaggcagtacttgggcagctcgaggccgccggcgccgagcacggcgatgccccggtagatcttggccagcggcgcctggtacgtcttgttggggttcatctcgtagaagtggtggaagacggtgaacacggccgggttgacgacgcaccccatcgccgtgccgatcacctggctcaccagcgtggcccgcggcgaggtgagcgtcaggtagctcgtcttgaagtccgacatgaagtcggaggcggtggagacgatggacgacacgatgccgcagatgacgaggctcccgacgatcccgccgttcttgatcccgatccacgacgcgaacatgagatcaccagcttgttgtactgcgccgagaagttggtctccgcgacgcccgtgccgtaggcgttgcagaaggccaggacgggcgcgaacgcgtacgcggcggcgacgtggt

SEQ ID NO: 41719 - DNA, 3695 bp, Oryza sativa
tgtgtatcgtcctcagcgagatcgcgacgagctggaagatgccgtcgccgaggatcattgctatggcgcaaaacaccttctcgatcacaacaaagtgaagtctgactgattcttgatgcacatcatcgacgtcgtcttttttttttttttgtctaacaacaaatattcgatcattggtagtaccttgtatccactgaagctcttcaagttcgtctcctggagatcggcgtcgtaccagattcctcttttgctccggatgtacggccgcatgatcccccaggagatgatggacccgaagagcatcgagacgtttatcaggtgaggactgatcatcccgattcccacataagttccgttcaaactgatgtagaaactgcaacgcaacaaacaacgaaacacaagtcactcaagccgatgatcgattaatttctccagcccgaataaaaactttgcatgaattcagtgttcgaattcgtcggtttcctcggttcgttgcctagctcaggctcggctcagcttacccgcgattgaaggcgctgagcccaaacgttgggaaggaagtgaagccgcagtttggacctccggtgtagaaccactggaagatggaccagaacaagctcgccaacgacgaccggagaacgagcgagacttgcctcctgtgatcacaagtagacgtagatattaccgtaaatcatgtgacaacatggctataactcaccaagctagtgataatctgctcacttcgcttgtctagcgccgtgaggggtatggaagctgttgatgaggtgagccgtcgccgagccgcttgggaacgtcagccggtggcggatgatcattgtctacggacggatgaaccagtaaatcggcgaagaatcagggagctatgatctcttcttcttctttttttttttgtatttttaggtgcgttcgtggatcgtaccttcctcatggggacaatggcgaggagaccgacgaagctaacgaggaagaagaaggccatcatccgaccgaactccggctcactgacgctcgcgctggagtcgtccccggtgctcgtcttctccgccgtcttccgatccatggccagcagatacgatccaaacccacctaagaacaggccagccgccagcgacgtcggcgttacgacggcgagatcaatggaagaggcaatgcaggaagaggcaagagcgcggcgtcgtgtcgcgcgcggtggcgtaccgctgtatgtcatgctggcgcaggcgacgacgcaggtctggacgacggcgttctcctggcgggtgaaggggcggcccggcgagccgagctggtcgagcaggcgcgtccaggccttgaggaggaagaagccgaggaggccggcggagatgttgagcgacgggatgatccccgacgtgaacaccaggttcatcatcacgctgctcagggccacgcccagcgccacgctcgccaccacggcgcgcagcgtcacctgctccgtccacggcgggacgggctgcccctcgaacgcgcgctccgtcgacggcccatcccgcgggtcgccgaccgactccatcccggccacttttcctcctcctccttacgccgcgctttgcctcgccggagtatcgtcggtgcggatcgagctggcagccaatgcatctactgcgttcgatcgtgcctgcgcatgcatgcaagtgatggtcgatctggaggagggcaaggggaagaggagaacggaggaagaggaccgaacgagtgaacacgagaggcaggaaggctacatatgctttggctattcttggcagagcccaagaggcaagagatggtaatgcaaccgcgaaatgttagatttggaggtgtcactgctccttcgcaccctcttggctcttgccatgcatgaagccagaagcagaatctcgattagccggtaaaattcgagctccaatcattttttcgctgatttcaatcaatttttgataaatttcgaacgaagttcaacagttgaacagaccattcgaaatgatggctcgagatggtcgaaattcgtggagatcgtgacccttggctagaagttactcaaataccaacagcgcaacgttcttgccatgcaaataagtagttcaattaccagcggtgcaatgcgagggatgatagtcccaaaaatcagtgaatcgtcgtcatcttggttgttttgaggaatggtactcaggaaaagggaatcgtaactattgtgactttcatggatcctcagaccaaacaactctagacattaaaacaaaatgtttctataagcaatcatgcatgctcaggtggcgctcacacagatacaatgcaaataagtctaaaaaagcagattccatttcttgtgtagcttttttggagacatttctagtgtggctacgcattctaataagggtttgtttacaacagaagaaacagaaacaaaaagggataaaacagtagataagtaacagaattttctttgttgccaaggacatccctagtggtagacaaggctaggaaaacgtccattgctcatgcaatttattcttctcatacttctgtacaaaggacatctaaataattgttgtgttgtactgcaaagacattttgctccatctaattaaccaactgatccctcaagcttcaggttcataagtgcatccatctcatgtgcaaactcgtaaggaagattctcgaaaacagccctgcagaatccaccaatcatcgctgcaacagccttttcatggtctatccccctttgttggaaataaaatagctggtcctcccctatttttgaagtgcttgcctcatgctcaacacgactagaaatgcaacccacctgttatcacgcaagttggaacagaatgttagtgtaaatgtaatttcagccatattagataaagaaatagatgatacgcattttaggcataagtatagtactggaggctcattagttacacatctgtattcaaaactgcaaatacatgtaattgcagattatggaagtgcttgtgcataggacatgcgtgcacagagataactcatgtctagctcaagatcacaatgggccatcaagaataccatgagaaacattaactgctggaactaagcgagtagcctagaggtgatggtaagcaacttaaaggtacagtgatattgcagaaagaatgcatgacactattagacaaacgaggtcaacccagcggcttctatgaggaaggcagcgcaaaggaggcccgagcgcttgttaggaaggccgaaggcggctagggtgctgaagggcggaaagctaaaaggtcatctaaaggtgtatttgaatgggagcatgatgaaacctgaagcggtactaaagttgtgctggctatacgccatcagtgtcatataaatgttccagatgaataagtatgagatttttcctgcttttgaacatgaaaacgtgcatggcaggagattttctaaccataagataaattggactaaaccaatagtttgactcttatagtttttagccagcataaaagttaaattcagtaatatggaatcaacggcgaccatatttcttctaatatatggaacagtgtgtattcccaaaaagggtgtcattaccatttactttgcatgtcaatatattgaaacttaaatggagaagactgattgtaaccaaggactacgaagattaatatgaaaccctccaacttgcaaaattatcaaag

SEQ ID NO: 41720 - DNA, 1278 bp, Oryza sativa
  unsure (1)..(1278): unsure at all n locations
tccacggcgcgtgcacggcctccgccgggatccgtacgacgacgggcacgccgccccgagcttggcggtcgcggcggcgcagcagggcgagaagaggggcgtggacgacgcggcggctgcggccatggtgcggcggcgtggcgaggccgaggcgaaattagggatgcggatgggatggagagcgcaggaggggtgggttgttgttcggtggtgtggacccgtgctacgtgagcctcagccgcgcgtgaggccggcgcgggtgggcgcggtccacgggaagcccggcgcgatgggggcacggtcgtgtggcggccgagaggcgtggcgcggcagtggatgtggttcgcgccgcgtggcgggccatgcggaaaacgccgtggttttgtgcgatttctccccgtttcttggcctcgccactccgccaccgcaaaaaattccaccgcacacgcgacgacgaaaccgcctctggctgggggctttagaccttcaacggtgcccgttcacccgcgatccgacggtgggggagcccctcgccgtccagatctcagcctctcggatcggacggagcgtgaggtcgtcgggtcacccaacattttctccacacgcggcgactttctagcaaaaacgcagttcgtttaacgagagtcgctcacttctcgttcaggttcagcaatcgcaatctcgtctcatcgtcgccggccatggcggcgtcgtccttgctccggtcgctctcccgcatctcgcgccgcggctgcgtgggaggcgcggggccgagcccgttccaccacagccgcctcccgtactcgccgttctccaccgcggcggcggatgcggtggagaggagggggttcgcggggctggggccgacggcgaagggggagaaggcgcgggtggtggtgctggggaccgggtgggcggggtcgcggctgatgaaggacatcgacacgaccgggtacgaggtggtgtgcgtctccccgcgcaaccacatggtgttcacgccgctcctcgcctccacctgcgtcggcacgctcgagttccgctccgtcgccgagcctctcgcgcgcatccagcccgccgtgtccaagtcccccggctcctacttcctcctcgcccgctgcaccgccgtcgaccccgacgctcacacggtgagacccccatagcagctctgggttggtgtgtgcggccaaatggccactggttttacagacgtgcctgcgtggggaatgcctgtttccaacattcttggaggagtgantcaaaatgtgggaatgagggctg

SEQ ID NO: 41721 - DNA, 1783 bp, Oryza sativa
taataatggggaaaatagctagagaacgctgctgaacttgcgtatattcacgaattcatctatggttcgtcagattctatgtgatactgtatttattgtttagtactccatccggcccaaaatgtagcaacctatctagtagagtactaggttgctatattttaggacgaaatagcttttgcctggaaaagaggcatggtacttcgtgaatattcaccatctagtgcatatttagggtgcagttttcatttaaactttacaaacccactggatggttaatacatgaatttcctataccaatttttctctgaaaagttgtttcacctatttattcatcgtcctttgacctttagattgattgcgagacagttactgaaggtgagaaagataccttgaaaccttggaaattcaaggtagcgtatgataagctggtctttgcgtgtggagctgaggcctcaacttttgggatacgtggtgttactgaccatgcaatatttctccgggaagttcaccatgctcaagaaattcgcagaaagctccttctgaacctgatgctatctgatgtacctggtatgccacagaaacacaaaacaactcaaatcaagatatttgtgttacttaggtaatttgtcacattgacaactatcacacactcacacttcactggcacaaaggaatcagtaattactcgttacttttacattttgtttgtctcttgatgaaatttgcaactacattaacctgggctcttattgctgtttcttgtttttctctgtttgattgagcagaatttagaatagaactattacattttaggtatacttgttttttacaaaataccttgtgtgctgaaatctaattttgtttatatcctccttattataaccaattggccaatgttatttgttaaaacaggaatatcggaggaagaaaagcgcagacttttgcattgcgttgttgttggaggtggtccaacaggtgtcgaatttagtggtgaacttagtgattttatcatcagagatgttaaacagcgttattcacatgttaaagattatatccatgttaccttgattgaggttagagctgttggcatctctccctctctctaaactttgaccacacttaacaaattttgtttcattttattatttcaggcaaatgagatattgtcatcttttgatgttcgcctcaggcaatatgctacaaatcaactaactaaggtatgtaatctctgtctaatctagtgttgtactgttgtgccattttaagccatcatgtaccaagactccaagacctaaaaatatgtgtggatcgtataagaaagctggcagtgaaatactaaaaataacttgtgatcatccaacagtcaggtgttaggcttgtgagaggcattgtgaaggatgtacaacccaacaaattaatcctggacaatggagaagaggttccttatggtttgctggtatggtctactggagttggtccttcatcattcgttaagtcgttgccatttccaaagtcaccaggtggaaggtattgtaaattggcttgaccgtatggagtttcatgtatatgcatcatatactgaatgggatttgattatatgcacctgcgcaccttctgtactttgaggaatagggatatatatatatatcttctacatgtagttcatttgtgaatcaggtttcaccatgcactataagaagcttctactatctataggcttttggtatccacccaattactggtgtaacatggctatctacatctttggtacctgtgatag

SEQ ID NO: 41722 - DNA, 1500 bp, Oryza sativa
tagccacttttttggcaactttaccaaaatatggtaaggttgaaaatggcatcaaagtgaacaggccctaatttctgttctttctcatacaaatactttctgttgtttgaagtagatgcactctctcatatgattacttaattcaattattttctttagaagaaacttccaaaacagtatcatccctcattttgtttaaagaaaaccaagtagttccgcaggtttgaggtaaaggaaaacatgcagggtgtggtataagaccctctttaagttcagaaaacgctttacttaggccaggctaagtagtaacttaaaaggctaaagggtttaacataaaccgaaacaagatctttcggtgaaacaattcccaatcctttcactatcttggattattgatatcggttagaaagaaatgggcatcttctcgtattagatatttatacattctactgcacttgtactctggaacaggttgcagaacgacaaggcaagtatctagctcacctgcttaaccatgtcatgaaagctggaggagggcatgcgaactgtgagatcgacgttgatctaggtcctgcctttgtgtataagcatctggggagcatggcaactgtcggaagatacaaagctctagtcgatctgaggcaaagcaaggctggttactgtttctgtctgtaaaaaaaacttgcattgttctaaacttctgacgagttaactgaaattgtccctttattgtcaggaatcgaaagggatatctcttgcaggatttgtgagctggttcatctggcgctcagcatacctgactcgtgttgttagctggaggaacaggttttatgtggctatcaactggctgaccacactgttatttggccgtgacattagccgtatttaggtgcctgtttgtagatatctgaacgatgaacagtacagtgcatcctttcccacttctttttttttgtcagatatgtgtaatttccacagaatttttttcttaaataacactatcaaaacaaaccaaggaagcgagttcaaactttaaatactgatgattagtatcgctatctggagaagtctaagaatcatggaacgtccgtgcaacttatcaccatcttttaaaatccgtgggttctggcctccatcgcgattttgtgcactgtccacttgttcaggcttcatttttacccagagctgacttaagaagtacagaaaacaataactagagtgattactatctgtgaagaccgcatgtgaacaatatggttacttgtttcatataatttataaaatccttataaacctttacaataataaaattatgacatcttgaagtagttaaacctcaaaaacagaatccaagcaaaatttgatgtatgatcactctatcttcatatttaaacttcaaaattaatactgtactgggtacacatctacacatagaaaacataatgtacggactacaaacggcgcctgaaaatcaacatggatttaccttctatttagaaa

SEQ ID NO: 41723 - DNA, 5532 bp, Oryza sativa
agtcataactcatgagcctcgttgtccacattggtgagatccaaatcttttcaggttccaatatgctgcttcattgctagagttctggtgacatgtgagtaattgttcacccagtagagctgcagcagcttgcaatagcaccttcatttcgcgccaggaggtagccctgaagctcttcacagctttgcttagagattccactgtttcatccgtttaaatagttgtgacaactaagacaaaaagcaacaatgttgagatgaactgtgtttggttctataatatgtttagcacattctttgaacagtatacacagtgatcttgtgttttctaattgaacagactcaatgcattttcattttacatcttggggcagttctgcagaaaaatagcattgaatctgttcatgtaatactgcaaaagagtaaaatatttacatggaagttattgaggtaattctgcaagccaaaaaaaaaaacaattaactggcttatgtgtgagcttttggaagatatgtaggatagatgtactgaaaacccaaaaacacagagttgtctcccttccctgccaagagcacctaagcaccacccaaacccttccgagtttgtttccatatgccaatctactatccatgccagtcatagatgcagaaaaatacctgttactctcggctagagacaggcatacaaatctggaaaatcaaccagacctctttgtgacagctggtctgggagctttgtattttgtccgaaatggaaatcaatcagaagaaatctcttcaaattctcttctgccaagttccacatgaaataaatgttacatggtcataaaatagaagtgaccaaagacaaacatgatatatataactcacatgtcatataaagttcaatactatgaacttccttattactacgagctaagcaattttgttccaaataataaacccctttctatgcacacaatcagtacttaaatgtattaagctctttctatgttaaatccgttcctcaatatgtagttccaaaaaggggagtaatcccatccccacaaaaagtgtgctattccttaaaagcaagcaagtaatataaaggttatcacagttacacccaccactgctcaatgaaacagcttccatggatcataaaattcacggcgatggcaaagtttaccttgtctattgaaacaatcaatgcgtgagtattttcattggaggataaacaaggactaaagatcaggctatgtaccttctcccaagcaacaaaagacaattgtgtccatggatccattctctgggtattccttccaacttcaatatactacattattgacctgttagttttctatatgtctgaaggagcttattgacacaaataaaaacacaatgtttatgcctattatttgatgcacaagaataccattgtgttggatgcacatttcagcatccaatttattgtcatggaaatgcagttgaaccattcattacctttcgaatgcaaaaatgtcttgatcaataactttccataaattaaacaggtacaggctacatgagaactaaacagataaacatttcagtgcaacctacgggggaaaatgaaaagagaagaaaaaatgttacactacaacacaggagacatcacccgaagaaatgaaatgcaatagttgaaaatcagcgagcatggcatgcagagtttagatcaacaccacaacacagaatgttcagtttatccttcgcctcttgttccgttggaggcccccgccatcagcatccaaagaacccagggcactgctcctccctctcctcctcagggatcttgatgaccccgcgttacttggttctcctgcactctcagagataccagcatccccctgtatcactgcagcagtgcttgagttagatgcttggtctgcagaaggtgctgcaacaacatgagttctgtcaaatgttgactcgagatttggaggattcgatgatgaagccgatgcaccatattggcttggtccagttatccttctaaaatcactcatggcagatgcaaatctttccgtgtcttcatacccaagaagggtaagtccacgcaaccagtcaattccatctggtaataatgagctcggaccatttctggatggatccgatgcattgtttctgatcaaaccactgtcaggggaagtggatccgccatcgggagggttagggttgtctgcttctctcagcaaccgtcttgctctcatccttgacgccaatctacttaggcgactggtgtgctgagcgtgagcagtgtcaaccatttcctgcacagctgattcaggcggaccttcaaacctactcgcagtattcataatctgttggtccagaaggcgcctccatgatgacaataacccatgagcctcaccaagccttcttgagatcggtcgcaaatggtgaaactgctgcctgaagctttcgagccgatttccatgtggtcttggtgggatagtaggacctgtttgtttcccaccttccacagccttctcggcatccaaacatgaattccctctcccatagatcggagtaatattcgcctcagtcacctcgcctttgcagactgggcattccttgtgattggaataaacattgagccattggtacaagcaaggccagcagaagagatggccacaagaggtgaccaccggctcgctggccatatcgaagcatatattacactcaaatgtggcagcgctcctgccctgctcctccgattcctcggaggcgcctacttccgcgccatcggcagctaccttattatgttcaacagtatcattcatcggttcatgctgcagcactgggactgcggcagcatcacgcccagctgggtaagcttcagaactgagtggcggaaggtccgacctaaaccgcctcgcacggagccatctgcttccagtctgctcgagaagccgccagtaacgggctgcggtgtcagggaggaaagaggacgatgccgtcgacgaagacggccggtcctcccaacctagcagttcgctggcacgcaccagcggcggcggggggtggaggccaaactcgaggtcgtcagggagctccgagaccaccggagccggaggcggcgcatacggcggcaggtgcgtctcggaagcaggcgggtcgtcggggttgtacagggagtagacctcctgcagcggaggggaaaggtcggcgtgagagggggagtacgggggatgcgacagctcgggcggtggcggcggcgcgtcgacggaggctgcggaggaggacggggaggagggcatcggggtgctgagggcgaggtcggagccgaggtcggagcggcgcgggcgcggggcgcgtgggaggccaaggtagaggttcagatccatcctcctgctactccccgcggcctcatcggcgtccatccgacggcgacgagctccagcttcctccggacagcaccaggtcgccggcttcagctccccaccttaccatagtaggtcgtctcccccaagaggaaaaccctagctagagacagaggcactgcgcgggagagctgcgttataggttgggtagcagtaacacatctccgccggtgctcacgccggcagattagcaggcggcgccgccggtaagcggcggctgaggtgggaggaggagagggagaaccggagaagagaaggggagagagagtagcagcaatgtggtgccaaaaagaggtgccctttttattgggtttggttaccgcagcagagaagaataggtttgcggcttgcaagttgctgaaacgtgctagcgtcaggtgaacgtgggttaatttgggatttggaaagccattagccgtagaaagaaatactttttacctgtgttattatcttgcacgttataaacccatctctctcttaatagcctaaaagaagcaaatgaggtggacccagttgcagtggctcatgtgtcatgtgctgttgctgttgcctttcagcagtcagctcaaacaattttacagctaaaaaagctgaaaaggtaatagtcatgattacatacgctgagggaaacaaaacaaattcacgatgatgatttacatttaagaacaacaatcccgtgccaatataaagcttgctaagacaaaccatgcagaagaactgtaacatcgggttctcctgaaacaatgcatcatttctactttggcccgctttagttcgcacacaaaaattttacaccgcatcacatcgaatgtttgaacacatgtataaaatattaaatataggcttaaaaataactaattgcacagattgcgactaatttacgagacgaatcttttaagcctaattgctccatgatttaacaatgtgttgctacagtaaacatttactaatgatggattaattaggcttaataaattcgtcccgctgcttactggcagattctgtaattagtttttttattagtgcccgaatgccctatacgacaccctatataatatccgatgtggcacgccaaaactttacacccctcgatctaaacaccacctttgttgattgagacagagatgccatggtaaaatgctactcccttcgtttcaggttataagatattttgacttgccgcttcaaatttgatcaagtttatagaaaaaagtaatattttcgacctaagataaatttattataaatatatatttaattattaatttaataaactaatttggtaatgtgaatattattgtatttgtctataacgttagtcaaacttaaagtagtttgactttggtaaaccacaaaactgaacaacaaaacctaaaactggagggagtataccacaaaaaaaacataatggacaacaaaactctcacagtagccattagccaaagaagatgtcacggatgtagacaaattgaacagttgttgattgagccagagatgccatggtaaaatactagcaccatattggacgacaaaactttctcaaagtagtagaaggaaatgtcacgggtataggcaatctcatcatggtaggaaaacagcatctgaggtaagttgctctacatgttgtcatttgccccgatgcgtgcactcttctgctgaatagctccaccagaaagttggtgttcattgttgtgggctaacaatgtcaagaatctgcaaacacagaggaaacaaaaacgtgcaagtgtctggttaattaacttagagttaacaaggaatatcttgtggatagaagagcaaatgcaacggaaagagaaaccttattggtgaactgttgaaaaacttgtccttccatcaatttctctaattcctgaggatgaattaatgagggagtgggcatcataaaataaaggtggtagagagaggaaaaaaataaatgtaagtgagaaaagttatattcgtatcagtattcagcagactatagtaaaaggaattaattcatcgaacgtgcccatttgaagcttctcaactactggtaggaaaatgaagtcatgatggtggaataagaaacagaagtgttgtactataacagtgacaatgttcattactgcaaaccattgtcctcaataggta

SEQ ID NO: 41724 - DNA, 25640 bp, Oryza sativa
acgatgagtattactatgattaattaaataaggtagaaatgctagcaggttatgaaatttgtacagggagggatgtggaaccaatatacaaaattgactagcatgaagcccatattctgcttacagtactatccttactaactatttgtcaactcttacgaataaccactctccaaatgccacttacgattgtccttacatttttgccaccggagagaaattttcttaacaatttgcccctttcaccgatgtggcataccagcatggactgaggacgtgaatgtcctttttgcccctgccactccccttcatctcattgagatcatccacagcggtgcacgtatgcttctggcttcctgcttgcggggtcacctcctcattgagaccatccgcggccacaccagccacgctgtctcatcaagcctcgtcaatcatgtgtcagcggcaagaaggttgtgcactgcatctgcatcatcttcttcggcaggccagataaccgcgaggccctcaaactcactgggaggatggcggagcaccccggtgcaggtcgtcatgcggttcattgatggcaaggccggcaagtgaggagcacgttgaggtacaaggagaaggtacatccgcaaggttgaaggttgtcatcgacagccacaaggagaaggtacatccgcaatcaatagcagccaaagaacatccatgcacgcacctaagtgttactgctacctaatggcttgtcactacacagcagtgcagaagatggacgagaaacagcggcggaggtgagctcaaatctgaaaaggaaagggagagaggggggaacacaagggaagggccatgggtaaaatggactttttgtgtctcttgtccacattggctgtcctcactagcatgcttaataggtgaaagtggcaaatgattaagaaaccttctctctggtggcaaatccgtagagaaatgtaagaatggcaaacggagagtagccatttataaaagtggcaaatagttaaattccccattactaaatgtgcatgccaatattttactcctatactgtaggtctgtaggattgggattaggttcagataattatgaaattgaagtcgatattcttgggttgaaatgctggactatactaacatggagacatttgtttcagctaacaaataaagccagaaatcaagtaaaagcaaaggattcctttttaaaaaacacaaatcatggtatgaaatagtcaaacataggcaatacctaaagatcttaatccattcttgtcaacaagccagcttggatcctcaacttcaagagattttgcagagtgcaatgtgtttggatattgtgtgggacaagtcgtgtccgatactacagacaaaaaattgagcttaacataaattttcttggccttcaagattcacaatgaataatattatagcccttataataaattctagagaaactaatttaaattattgattaaaaagcatagcatatggttacttcttcttctttttttgcgaggatagcatatggttacattgtttacaactgaaggtagtcatgatctataaagttttgagttcaatcaattattagtgaaaaccaaatagaagaaatggagagttaacaacagagataagtatggtgcatttttacataaagacggggtttgatccttgtcattaggacaatttgttgcttcttccagtgacctagagttccttgctgaaaacaatagaaggcacaactgtaaattccagtagattattttagaaacatgttagtaggacagaacaattgacaatttaatgaatgactatatgataagataattcaggcccttatatatgggcaagtacatgccctgcaggacttttaggtgtacacagtcaaatgctcatttacagtatattgatgtaattttatgtaggacccctctattttaatgatcatggtttcaactcaatttccatatatagcaggactatatagctgttgcaaacaactgtattgagtcaccaaaagctagagcacttacaaatttcctcctgaagagatgacttgctaacttcttccagaggtattgtcttctggcaaaatttatctgttggcaaaacgatatttagcacaaatactggctatcaagataataaatatattcctctaaaaaagggagatgaagatatttggtggccatttttgtttgcataaaggcaatgcataaatgatagttataatttgtgctgtgtttagtactgttcagcctttccctaatctcaaaccaagtacaatagtaaaattgccaaaatttcaaaacaaaaggtcccccgcagacttggacacttggagtgtgataagcagtttatcacttgctatatttttttaagacgtttggtttattgagctatgtttaaaaatgcggctggcaaagaacgctggccaaagagagaaaaggcagtacagggaagcttgttgatttaaaatacacaactaagaagcaacagagggaacacggcagtttgctacagccccctcgcgctacttgagctactttcagatcgcagcactagagctatatttagaaactaccaaaggatagcactgagtacctttgtgatttttaaagcatgccaccgagcaactgcaagggataatgaaaccgtttgtaaggcccaactgcattacacaatagagaaaaagaagccagagaaattgaacggaccatgctcttaattggtctacaatatgacatgtgctcttttgccacatatgtgtgtataacatgtagccctggccccagttgtcatacaccggactgtggcaaatgagccaatgccattcaactttagggcaaaagagcaattttaccaaacaaatctacaggacacatagaagatgtccaaccgtgattgcatcgctgaacaggtatgttagttcagtagtccatttagtttcagggaatcttgaaaaacagtttgtttagataatcatatttggcaatcctaaggttacatccttgaaacaattgtgcaagagaagtcataaagtatgatatgtaattctcttgcgtattcaagaaaaaataagcaaagtattacagattattgaatgatggacgtttgcctctgaatactaattcaatacagcttagtaccaaaaccaacactgacaccagatatcaggagaaaggtttacatgtcttgttttgctgctgcctttttttttttttactcatgcaaaaccactccagcagcaagctaccgagtcaaacccaaaatatatcaagctaattctgatgtaggctcatattctaaaaagaagctaatgcttccaaccattaatcatcaatctactctattgacctagcaaacccgtactctcttttcaagcagtaagcagtgaagtaatcgatgtgaacacagcaagtaggacattgcactaaaaccgtaacaagtgttcttcaattcaattgttatgctagctagtaggccattactgagcaccatgatcgaagcgatttcccaaattttaaggacagtggtatgcgacgacgctacccatggaagctgtaagcacagaagggtggagatatccggtggctggacttactatggcgtgcggcaagcggagcacttgtacttggacggcgcctccttgcacacgtcgcagctcccaccagccatctccagccacctcccctagcccctagggattcctccaggcgcgacctgcacccccagacccgtctcaggtgtcctgtggctgctgcgggagcggcgaaaggagaggaaagggggaggggacgcgctgaccttttaggtgctttcagctcgtgcggctaggctcgctccacggcgcgcgacgggcgccctcggccggcggcgagcggaagagggcggcggcgccgcggcggcaaaggtaacgggatatgcgagtggaggaatgggtgtggccgggtggctccgttctatgcctgggccagtttagtgggctggtccagcccgcgtggccgcccgcggtggctgttgcggaataagttcactttgggtccctttatttgtcgccctgtccgatttcgtcccttgaccgcaaaactggatacgacccatcccccaacttataaaaaccaggtaaacaaggtctctcggcggttttgatagcggttttggctgacgtgatgcctacgtggctaatttgactcggtctttatttgacgtgacactgaggcacttacgtggcaattcgatccggaaaaataataaagcatgtgggacctacatgtcattttcacacataaagtaataaaaaatagtgggacccgcatgggccccacatgttatactcacccctcatcttcttcctccctctccatctccatctcccctccatctctctcctttcctctctccagcggcctctaggcgccacggctcacggggtgacggggaggtccggcggtggcggccggcgacgtgacagccgccggcggcggcgagctccacctctcggcgcagccgtgcagccgagaggtgagtaggtgatctgtgagcaattagcaattaccagttactgacgaaaggtgagtaggtaaaggcattattagcaaaaactgcatctatcggaacaaagttcattccggtggtcaaaactcaaaaccccagcgagctgaggtgtaagagcgacgtcgccggccgtcggatcgcgggagggggggctacgtgctggcgcaggattagatccatgaatccatccgtgccgcctacgccatcagacagccacgcgcgcgcagggtcagaaacgcgcgcggctgcacggctgcacgagaggtggagctcgttgccgccgccggctgtcgcgtcgccagccgccaccgctggacctccccatgaccccgtgagccgtggcgcctggaggccgctggagagaggagaggagagagaggggagatggtgagggaggaagaagatgagggggtgagtataacatgtgggtcccactattttttattactttatgtgtgaaaatgacatgtgggtcccatggctttattatttttccggatcgaattgccacataaacgccacgtcagtgccacgtcagatgaagaccgagtcaaattagccacgtaagcgccacgtcagccaaaactattatcaaaaccgccgaggaacctcgtttgcctggttttcgtaagtttggggacggttcgtatccagttttgcggtcaagggacgaaaatcggactgggtgacaaatagagggacccaaagtgaacttagtccggctgttgctggatcgtccaggcttgcaaggccctggcccatctatataattctaagagttcctttttttttcgaggaaaataggagatgttttctgatttccaacaggaaatggatgatttatttgaaatttcagcgtttgaaacaatgttttaactatgtattgagttgatgactgcttttgctcttcttgggtgtggaatataggatttcgcactaatctgtgacattttccccgcgtctggaatacgcaattcggtatcactttactgtattcttagtttctttgtgtttatcagtgatcactggtccataatactccctccgttttacaatataaatcattctagcattttccacattcatattgatgttaatgaatctagacacatatatctatctagattcattaacatcaatatgaatataggaaatgttaaaatgatttacactgtgaaacggaggaagtagctcgcaacgaaattggagaaataatgtgaggattattcgaagtaccatcacgaaaatgagccatttcctggttcagttcgtatatttttttcacacgatgaatgattcactcgtgctcaaaccactccaatactaggattacaaccaatccacacacacaccaacaaacaaaacaaagctatgcaacatgccgacgaccatggacaaatcttatatccgataccggaccagcgggtccttgaactgaagccgcccattatacaccctccacgcaaggtcctcgagtaaaaacgagtgaaatctccacccatccccatcatcgccggctccatccacctcgtcgtcgccgccctcttctccggcatccgtgaccgggaccaatggcgagatgacactgtccaaggggagagtgatcagcacggtgactgacaagcggtcagcctcggcgccgtgccctgctccgggtgcagaagaaacggggcgagccatccctctcactttcttcagctttccattgctccacacctagcacgcgtgccataaaaaacaagaggcattaaggcaaattcaagcaagttgttactgctttgatgctgctcaaagagtaaaggaaacaacagacatgacatgatggtcactttgtggtttctcttcaaaagccgagatctttgactcttttttaaggtcctttggtggattccaaaccgagctgtgaggcagtgatgcaccggttgatgcagacatggggcctaaatgggtccaaattgagtggtgacgcacagcctatactttagaatttgatgccttcgcaaaataaaaatggatgctttttagtacatgtctatgcttcttagagacagactctgccactcacgaacaatcaacacatcttttttctgtggtgaacgaccagcaaattcgtagctgtaaaacctgtaattaattttacacgtttgccatttgtttttttaatgcaaattacaaactgaatcaataatatgagtgtctacatgtcaatcatttatgtgttatctgtgcaaaaattaatgctctaatgtccttccgtttgcaaactagtcaaaatgagacatttgcacgcaagtacctgagcaatgttgccgatggtgacaaggagtgcgccgtcgcgcgcgcctacggccgtccactcgccgccgtcgtccatcacccagctcgccggcgccgcctccttcccggacgcttcccactggcaatggatgcccacgacgtacgggtacgccttcgccttcccggcggccggaggcgccgcctcgccagcggcaaccttggagacccacatcaagcacctcgccttcctcctcccttccgcgaacggcgcctccccgaagcccacctcgggacacccggacatcatcgccaccacctgcatgcccacgtcccgcatccgccgcgcgtactccgccgccgcagccgggagcgcgcccatctccccctcgtcgtcgacgtcgaacaccagggcggggtcctcggcgccgtccgcttcctgctgatcctcctccgtgaatccgagcgtgaggaggttcgacgcgcggcgcgcggacgcgtcgacgagggagagctcggcgagcgcggaggacggcagctgggaagggacgccgtgtccctcgaggtggaagtaccccacgtcggcggcggcgtcgagacgaagggtgccgctagagccaagcgaaacgagaggcggcagcgacggcggggccctggagcgagaggagagcggggagcgtagaatcggcgccggagaggataggagcaggcgctggaggatcgtcgagagcgcggcgtccgtgcccccacccgcggcgccggaggacgggagcgcgtggtggtggttcgacggcgtcggcgggggagggcctgggaacacgctccctcctcctcctcctccgttggcgccggacatggatgacgctgcggcggtggaggaggaggcggccatggagacggcggccggagcggtggactcggactcgaccgacgtggaggagaaacaagtttttggtaggaaactgggaatcgtggctggtgggaggcgttggcgccttggcggcgtggcgtgggagaggaggcgatttattcgggtctagttggtctgtcagtgtgggcccatcttacgcgagagtggtgggccaccttaggagattgagccgacctggaccggcgaagcaggggatgggccggaacagggctttattcctgacctcaactactcccacaaatccctcttctcagttctgcttagttagcttgctttttgtgaatttgcaaataaaaatcctccaaattttcagttgtaccttgtttttctctcaaaatgtagcagctcgtactttttacttctacgagacaatttgtattcttttcggtggttcattatctctgcactagcatgaagaaatggaaacggaatagcctcaattagcttctgtgcttgagaatttttcacatttatagcccataaactaggaaaatgttgaaccggataagtgaaggaaaaggaccaatagtccaataccactccacagcgactgacaggtatatctatctcgaccattggattgttgcttcttccacatagcccggcagccggccatgcgtgtcgttcttgtagctttcatactgcgaaacaccttctgcaaaatgaaaaaaatatgtcctaaatacacgagcaacgacgtctgagaaattgtcaagtaattcaagaaagcaaccgtttgccttagcagtttaagagctgaccccagtgattagttaggagtagctttctatcgctgaacacaaaatcaaaacgcttcgtgtctccattggacggagagaccagcacgagacgtgaaaattcgccatccttcagagatcttgccacgtcgtgggacttgtcggatacgcacacgtacgtgcgattaatctggcacgacgatctcttttctcctgtcgtttcaatatattattatacggtcgaatggatcgacagggacaaatggcattgtagacggtgacacaaaatgcagggaaagaacaacatgtttggcgaatcatgcagagccgagctctcttttactagtactagtacatttcaaggacttttgcggctgcgatgcttaaattatgggaagggtgtccattctattatcgtcttttagtgccctgttagaatcttgcatagtcagtatcatgtactagcatttgctattttattgcccgtgtgtatgctgtagtctcggctgttaaagagaactgtttgctttgtcttcatgcacgggcgatatttgagaaatttgtagttgcagtcctttagagttgatatatattggcctttgataaaaagaagtgcagggacaaattcgtttttatgggagaccttcccccggaaacaagcttgtctgcagcgatgtgacgctccagtttcatgcgttttggtgttaggttggacaacatctccatcagtgacagacattatacaagtagaatttctttacattaattcatcattttccagcgatatctttatggttttgtaagccattattacctactagtatcttaaataatcaagaagagaatgatctcttctaccggaggaaaaaagggagaaaaatatatgcctcgcgtgcttagtcgttggatcatggattcagaggtctagattaaaccagcaaccgtgggctactccaagaagaatggttagcatggaaaattgttccctcaactatggtttgagtttcattcacgtcccccaacagctcaactgtaaaccagttatataacatcccctaattactaacacaagtgcaaatcaagtctctcgacgctttagacaacggtttcatcttacgcagcatcatgtgactcgttgaccaaacgttcatctgacgtggctggaaacggtacgtgacttgatgagatgtggttcaggctagggccatgggtaatcaggctggggctcctatctctagcatcgccccttagaccaccaatatggtggtgtggagcgacgaacgaggatattattgctacggttgctatcttgccttgccgccaccctcgagcgtcgactgaatctcttccacccacgctacaatccgtgataagttgctcgaatctctcttccacccagagctatgccaatgtgttcactaactatggccattgcctggctcctctcgatggacgcttgtcacccgttttccactgctacaaaattatcggggatacaatgttctattgatggcaaatttagtcacacagaggaagggtagacgaagaagaagggaggagaaggatggcatggttgccatcgtttggtgacttcttggccagcaatcatccgtctaccgctcgtcacattctccactccaacgccgagctatgacctcaaatcctctttctccactgcccttgagtcccccttctctagtacgaggagaggagagttggacacccgcagcgccagctgtccttgttctcgttcgcaatagatggtgggcaggcaacggttgggacacctaagaggcgagagtgaggagtcggggtgactggccgggtcgagagagaaaagaagatagtagaaagaaagtatgaaatgaaatgtggaccctataatttttttattaactttttgttggttggattgtcacgtcagacgaacattaagttaatgtgccacatatatgtcacgtaggatgagtttgtcgtccacaccgctgagggactcgatttgctctggttttgatatttggggatgctctgattgcacatgcgaacgttaaaggaaactcagaccccggtgtgagggacctacggtggacctttcgctggttagcattgctccataagtaggtccaaaattctggaaaggtgtcctaaaggaaaatgtatactttgactcccatgattcatgtcctccaactacaaaaccgggtatatcgactactccaactccaattatcaaaaccagttttggaggtggttttggctgacatggcgcctatgtggcggtcttgaccgagtttttgtcctacgtggtgcttacgtggcattagaataaaaaaaataaaaaaaatatgtaagacccatatgttattcacacaaaaaaatattgtgggacccgctgtcatgtgggtcccacatgtcatccactctctccttcccttcttcctccccctctctctctccccccggcctttctcttggccggaatggcggcggtggcggtcgagacgacagcggtggcggtggggacgaggatggcagcagccaaggagtgcaacgctgtggcgatggggaggaagaagggaaggagagggaggatgacatgtgggtcctacaatacttttttttgaatgacatatgggtcccacatattttttatttttgtttttattctaatgccacgtaagcgccatgtaggacaaagacttggtcaagaccgccacgtcagccaaaaccaccgagggacattgtttgcaccggttttgatagatggaggagtcgatatacccggttttgtggttgatggacatgaatcatactcgggcaatagttgagggagtcaaagtatacttttttctgtcctaaaagaccatttgcagcaactagcaaggcccaaacgattacatgttgagctagcaggccaacttctactgtaccatatggagtaggaagagtatgaatgtgggccatcaggcccagaaagaagagattttttactgtccagcagaatttttggtaccgcgcggtactgcaatcgtaaccgtccattcagccagatcaaacgacccacaatcgtcggtaccgcgaggtacgggaatccggtgcggggtacctccccctttgttcgcgtgtatggaactggtggaagggcagaattggattttcgcgtggttagtcaattttcgtagagacggtacaagtccccgacccgataatctgtctcttcccgatccccttccgtcgtccctggcggcggcgcagccaatctcgccggacttcgcttcctccctcactgcaaccagccgtcgccaacttgcccattcccaacttgcccttcctgtagccagtctaggtccggccgccgccgacttctgggagtcgatctatccctggatgacgacgacctcaatgcgcaaacaagaagaggtgaccatggcgacaagctcagcgtggcgaatatggcctcgacagctcatccgccgacaccatcgcaagcctttgttcgtggaatcgccatcgctgtggtatgcattggatcgcgagcactagcaaccctggaaggaggggacagaaagaagaaaaaaacgaagctagatattgagatgtctgaaaggcgtttggccatggatcgcacaagcaagaagaaattgggcaagcaaagaaaagagatcgaagaatttcagaagtttgtttatgggatcactagttgtaatagtgtcccttttattcaagatagttgacaatttgttcaatgaccgccgatgttgattttgtttaagatgaaacagtaagcttaaggtctacaacgaaagaacagtttacacatcagaccaagaaactacaaactttcagaaaatctacttcttttttactactattacattcatactttcagcaaaatcaagtaggttcattacatatatcaaaagacaaggaactaggtccagaacttggcacacaacataaatcaaactcagcctctcccatcaacatagcatattcttccaatgaatatagcagcaaagcaatgtttcgtatttctttcctgctggacattgctttgctggtcgtcgtcatccagggatagatcgactcccagaagtcggcggcggccggacctggaccggctacaagaagggcaagttgggaatgggcaggttggtgacggttggttgcagtgagggaggaagtgaagtccggcgagattggctacgccgccgccagggacgacggaaggggatcgggaagagacagattatcaggtcggggacttgtaccgtctctatgaaaattgactaaccacgcgaaaatccaattctgcccttccactagttccatacacgcgaacaaagggggaggtaccccgcaccaaaaattcaaaaattctactggacagtaaaaaacctccagaaagaaatttctccaccaaggccgtcagggcccataccagcaatacaattctccgatcagtggaaaacatgagtataaaaatacaaaattcggccgaatcggccagcatgcttcgtttgccatgctattaattagtcaatccttaactcagttttaaactcagcccaggtgagttcgaattaccctatcataatttataattttaccagaaaaaatacccgtgagttacaacgggtaaacgctattttaatcatattattgttggtcggtttaactaaagtaaaattcactgcgggaatttgcatgatcgaactgtaattagaagtccaatcatctcaaattagtatgcaagtttttaaaagagatttcttatatgtctccttctccttctccttctgtatttataaaagcgaatgaactcaaaaaccgattcaaacacggatttgtatttccaaatgcaaataatgaacttaaaaactaactcaaatatggatgacgtaccaaagtaacagcaaaaacatattcaatttttataatagcagagatatgccctcgttttccatagtacgattcctaaattggtaaaatgtatgtttttttaccaaaattttctataagaaattatattaaaaattcatatcaatccatttaaaaaaattttaggtaacgtttaattaattatgtgtttaataacttgaagttagcatagctcaactgattagattacatttggttaaaccagttcacccggttcaaattctagatttgaaacgagtgttcgtatttacggttaattattcttttaagggtatgttatgcctgtgtgttcatagtggtacagaaaatgcactgtggctaacccacttctggttaagctaaacacacctgctgaaccatcgagcaatcgtgggcggcacgcacggctgttactctgcacaagacaaaaccagggaaaaaaaatctctccgatccggatactagctgtttccctaagatgcgaagcggttgataagttgattcattccattttccaagcatgactacgacggaagagcagatattcacgtgtgaccaaacctacacactaaaaagaaaactaccaagccacatcacacttaagaaatgtttgcacatttcctcacaagagaaggctccagctcaacggaaaaaaaaagcatgcctccccccaaatcccaatcagtaaagggtttgcttcagcaaaagaacaaaaggaattatttcaacaatactatatacaaacgaacaatcctaatgaatgatagattacattatcgcaccatgttagagacgttttgctggcggcgatatgatgcacactacctagaacataatacgtctctaaacaaaacgggaacatgccaaggtccaaagaaccacacataccttcagattacttatagaagtaaaatcgaatccatgtaatgaaatcatcaagaaaggcactgctacagtgctatttaacctgaattatattcatcctctgccaaagcagcgactgatcgatgggtggcacgtccaatccctgatcctgtcaacacccaactcaaacgcgggcgtccttctccttccctcccggtgaagctgacgcagtgacactccaggttgcgcgcgcgcatgcgggcggctgggaagggaagccccgtctaatcaggaccagtgtcgtacgtggtccttccagcccgcatgacggagaggccatgtcgtttacgaaccaccatcggatgggtacaaacggaaccctcctcgtcccggctgcgccctgcccgtcccttggttagccggcacttgttgaagatctcatttgcgagctcatccagccatcctgatgaacttcacgcagaagaaacttggctcaacagcccgaagcgtatgttacactcgatcaactaagaatagagagatgtttctctgtaatcctgctgctaaatttttttgttagatccccacccatagagtactaattatagtattagagcagcagcattgcagtttgtacttgctaagttgctggtacaacactacaacttgctggctgtcctggtcataggtcaaaaaccgtactttgctcacagtgtccaaaactgcacctgttcacaattgatcagcttctctgaaccgaggaatggaagttgaaattaaagcggtgtctctccaatcatctcccggcggggccatggatgaaacagtaaaccagcgaaagaaaagcatcggtctatcagatcggaataggaaaaggaaattcagattcctcacattaccacttgcacttgggctaccagactcggacggccaatggcgttttcttttctgctcccggtcgctctctaatttgcccccaaattaaccaacgccggttgcgtcccaggacagcacaagtagagccaatcggtcaacaaatcatcttacaagacaaggaaaatgcaatagtaggagtccattagcaaagtgccggtgccatggacatcgctgtaatggcgaacacgattttcggacgatgcaaattatcttctggccggtaggcagagcaaagaaaaacagctataaaggggccaaaaaccaaggttcctggagatcacaggactacaggaaccgatacaaaaacagtgttttccttcaggaaagctacaagaatagtgctagtgagagcggcgacagaattgtcattactacttcgtattaggtggttggcaatctggtagaccattagaattgacagtagtttagctccaaattattgcgtcaaagttctcgacgggttgccgtaggtccgaggagaggtgcactctgcttgtcatttcaaagttacgaaacagcaaattcgtcaggttttgagtgccttcaaatagcaactcgtcgatcagaaacggctggacaagaagtcatattcagctggctagcacggccttgctggtggccttatttcctatttgatcgatttcgtgagttaataattcaagattcagtacgttccaggacgaaaaataccggagatgacgaagaaaagtaaagtacgtgacacccgagaccaccggaggtgtatccttttctctctggcattttgggctattggcgtaactggaattgaagtgtcaccccacaagtacagcgacgccgttgagccgaaaaggatattgcaaccgaactgcgagatgtataattgatccagattatagaacaattgatcttgtttgactgaatcaacatacattagtattactttttagttactggctagctcggtcagcctggtcaatggactgcagagctcttaggcctggtttaggccctgtttagtttcaaagttttctttttctaaatttccaactttccatcacatcaaaccttttatacacacacaacttttctatcacatcgtaacaatttcaaccaaacttccaaacttcctaggctgtgtgtttagttcagcgcaaagtttgggttttggttgaaattggagatgatatgactgaaaagttgtgtgtgtatgacgggttgatgtgatggaaaaaaactgaagtttggatccaaactttggatctaaacacagccctaactttttcttcaaactttcaactttttcatcacatcaaaactttcctacacacataaatttctaacttttttcttcaaacttccaattttagtcaaacttttaattttggcgtggaactaaacacaccttgatttttttgactttggcgtgaaaacgtaaccttcttctgtagtcataacgtataatcgagcgatgacaatgtggagatggtatacatttgcagaagcaaactccgtatcttaggctaaggaacatatacatgtttactgaagaaacttggtcaaatgggaataactaatgcagtggaatgcaacagagtaagagacagcccaggaaatcagatttagttgctacaagtagcagtaacaaataactcgcttaacaacagatggcccatggtcctgtcgatgcatgagaggagaacaggagaagcgacagagcgacaccaacatagcggaatcaccaacatttctggcattctattgtcgctttgtacgcccggacaatgcttaccctgaaagtttcttgaccgaaaagctagccaggtaaccctttcataaaaatataagaaaatttcgttttcaaaagaagaagaaaggttgaatggtgatctaggccttgactccactgtcaccaggatcatattcatttatttctgaaaccaacccaaatcatattcaatgctataatatatagttcctccgttttaaatacacgatgccatcggcttttagacataccgtttgaccattaattttattaaaaaagggagaatagctactttagtctctaaagtttctatgtatgatcaatttagtccctaaccttttaaatggtctaaaaaaatccttaacctttgtcataaggtctagaatagtccttaggtccaccaaaatcatcatatggatatgccatgtcatcattcatataaaatatatgatgaattgtctaatttactcttatgtatatcatagaaaaataaatataagggtgaattagacataaccataggaaaaaaatacttatcttttcccccttttgaggtatatttttgctcttacatataccatatatttttttaaccttttctttttgtttttttattttcatatgcgtaaggataaattggacaaatcatatagattttgcataggaaggtgacatggcatatccatgtggcgattttggtgggaccaaggactatattagcctacatgacaaatttaaaggacttatttggagaatatgaaagattaagaactaaaatgacccaggagcgaaactttagggaccatattagctattatcccattaaaaaatattgaaatttgcaaaaaaacataagtcatgcttataattaatataattaataataaaacgaatcaaaacaaaacatacaatattttttaataaagcgaatagtcacacttcatgtaaaaatttgacaacattatatatatttacaaacagtgtttcttcaggtctagaagtctcaaaccggcagttggctcgacgtgtggtaccaatagtcacaaagctgcaagaactccacgtctcgcatcattctaccaaaaataaacccaaaggaggaatcaaggcctcaagggccaactgcttccctcgcaaaagaaaaaaaagggggccaactgcctcatgtgaaaacgtcaccatgtaatcgtgtaatgtgtatgcatgtttgttaattctctgctccctcccagccaatctgtacccataagccaccacgttgaccataatgatttagtaccatatacgataatacgagtagataaaccgctatatggggtcgcgcggagcaaatctgctcgtcgccgaaatcaagtatagtaagcataattaagtttcctaaccagcccaaaattttactaaatccgttctggagagaacacctaatcctcaccaaagcttaacagtattgtgccgcagatatacacagtacttaataatggctcccatgagtggcgtgctgtaccacgtttctgcatgcctcgtattggccaagtctgcgaggctttgaattggtaaggaataaaaccctccctgtttccgatccacccgtccaattaaatcatgcttagtggccgattcaacgcctgatcacggaggagaagggagggggaagcatcacgcgaaattttaagtgtgagatggcttcccctcaccaaatccccagcctccctctatagctttgctatgctgactacttcctcgccatctccataaagcttagcttgcccctctcgctcgcgtctctgtctctcacgcacgcgcaccgtgcagagcgaagaggagagggggctagctccgggtgccgtcgccatggccaaccggcgcaagttctcgcaggcggggggcggcggcggcggcggggtgttcgacccgttcggcacgaaacaggccgtgtcgtcgctgcggaagggcgggcggctgccggtgtacgtggctggcgtcttcttcgtcatcttcgtcatcatcatgtacggcgaggacatccggtcgctcacgctggacccgatcgcgcgcgcggggacaacgccggcgcggatcgtggagccggtagtgacggaggagcgccacgtcgcccgggtcaaccctcctcggcgcgaggtctcgtccgcggagaaggccgccgcgttgccgctcgacgtcgacgagaggccgaagctggcgacgccgacgccgacggaggcggcgaaggaggtcccgaaggtcgagaagatcaggaagccgaagaaacccaagacgacgaagaagaagccgaggaagccgcggccggcgaagaagacggtggcggcggcagccgggggcctgctcggcgtgccggagacgtgcgacctgtccaagggcgagtgggtgttcgacaacaccagctaccccctgtaccgggaggagcagtgcgagttcctcacgtcgcaggtgacgtgcatgaggaacggccgccgcgacgacacctaccagaagtggcggtggcagcccaaagactgctccatgcccaggtacgcaaccacgacgagccaccaatcacaatctgtaatttgcaccgggcgggaaagcatgcgccgtttcttctgaaatggaaacgctccagccagctggacacgcaagtataaacggcaagttttgaatttgtacgaattgattcaggttcgacgcgaagctgttcatggagaggctccgagggaagcggttcatgttcgtgggggactcgctgaaccggaaccagtgggagtccatggtgtgcctggtgcagtcggcgatgtcgccggggaagaaatacgtcacctgggaggaccagcgggtcgtcttccacgccgtggtgcgtactccgcccgtctccatccatccatccatcccgtctttaagattcgtaccgagctgctcgcatgatgaacgtgcatacatacccatccccatctgtctagtctagccaagccagccaacggcgggccgggtccacgcgcgcgcgcacggctgctgcgactagaccagggagcagttggtgtgtggtggtggcggcggctagctagaaccggtgaaccaacttgtgctcgatcagccgccgggtcggtttctgatagtgtgttgtcgtggcctgttgtgttctgaattgtcgggacgcgtgtgtacgtgcgtgcaggagtacaacgcgacggtggagttctactgggcgccgttcctggtggagtccaactccgacgaccccaagatccacagcatccagcaccggatcatcaaggcggacgcgatcgcggcgcacgcacagaactggcgcggcgtcgactacctcgtcttcaacacctacatctggtggatgaacaccctcaacatgaagatcatgtacgctaaatttacgttgcacgatatatcgatcgatcacaacgccgtgccgtgcaaccaacggcgatcgatcgtgggatgacagtgactgataggggtgatcttgcaggagaccgggcgggcagagctgggaggagcatgacgaggtcgtgaggatcgaggcgtatcggaaggtgctgacgacgtgggcgagctgggtgaacgacaacatcgacccggcgcgcacgtccgtcttcttcatgagcatctcccctcttcacatcaggtacgtaaaccagcctacctaccttgttacaattcgcattttttgtattctaccgtacgatcgatctcaagtatttggagtatagctggcacgtacgaacgcacgattgagcaatcaattaagctagtgtgtcagtatatctcaagtctcgacggtagtacggtagagtgggaaacgccaaaatcttggaacttttgcatgcaaaaacccaaagtaaaggtacgcacgcttgctgttggcgtcgcactgccaaagaaaaagaacgagacggcatgcaccgcatatggtgcgtgcgtgtgcgtcctgcagagaattttacacggattggtggtggagtgggcgccccgtctcggccggctacgcgcgaccgagtcggttcccgtgggcgaaacgaacagtacgaatcgaagcgggcccaggccaatagaaagagacgagtcacccggccgcctcgagccagattgtagttgtgcgcgcgcgtggaaatgtcagagaccctacatatgtgtcttgacttgtggtggtaattataaagattaaaccgtgcaaacgattcgtgttaattagtgtcaggcgactagcacaccgtgagcaccggacgcaacacatggattattcgtcattggcgttggccatgagaccgtcccttaattacttcaacgtggccgcggtcctgctataacatgctaccgcgacaactgtagcaaaccaactcccattaatttacttatagggtttgacatttcagttagtggcgtatcatctgtagactaaagtagagagagtgagtatctaacacgctcacacgggatgccttgccatgccggccagcaaatgactcctgccagtacaccatagcacggctaaccgacacacagctccgttgctgaaaagcttaaaattatctgcaaaccccaatggtgaccacacttgagcagtttgcacaaccacaccactgttgaaaactacgcttttatatgtatcacttggagcggcatcttcttagctaagctgtggcttctttccagttctcacttagcacgcactttctgcgcccaagaatgtgcgtcacataactgacccggtctgcaaatgtccaatcaaatgaggttactatcgggcgcccctattattgtttctgcttgttgtggccatctcgcatttcccaaaattttaatactcctactcccctactgcgccatgggtatatatgcatagttgtgtgtacctgttcgctcacatgggtaggagaattatttgcacatgagtccgagatggaagcttctccgcacgatctttttttcccatttggccgccgtttgcgagccgtggatgagtgaatcccacgatgacgacgacgatcccagacctgcaggacgggcaccgtagttcgtgatgacatattgaaaaatactagtatcatcgttgtgagggctcatcatcttgtgaccggaattctaggatctcggagtacagaacgcattgaaccacggagcaagtagataaattatctaatctgacacatatataggggttgaagattagtagaggggaattcaaatctggttggctgaacctagctactacacgtcgcttgtggttgacgatttgcttttcttcttgtgcaattcagcttgagagttcctcaaccccgtgttctactggtggagaattcaaacttacaagactgaacaaaaagaaatggtggtttgcaattgatatgtgtgatgaaacataaataaggcctggtagatcgatgcccatacgtgtattattgcgtactttacgatgaagggacagatgctgctttgttagtatcggatcgaacagaaggttgtgctggttactgttgcggatcgatgtcaattaggcttgataaggattggcatggcccgcggatgacgccttacgaaagctctccctctataaaaacttttaggacagtcccaacccataacactagatatggtttcaactctacatcatcaagaaactagtactagacactactcttctaatgcaaacaccactattccgtacttcaatttaatgctacttatctcacatgatgtcttggatgttgtgtaaaaatcatgtctcatacaagatatggtttccttctctttcctcatttattcacttgccacattattttttgttctacgtggcaacttatttaattatatggacaccatactagttattgggttgaaaatccctaatattaggaacagtcttatcctgaaactgataggtgcttagggtcccgtgaagcaaaccactttgatttgtctgcgaattttgaagtcaatgattcccttttgtatactacctccgtcccacaataagtacaatcatgagttttcgcgcccaactttaatcgcccgtcttatttaaaattttttataattagcatttttgttgttataagatgataaaacatgaatagtactttactcgtgacttatatctttagtttttttaaaaaaaaatttaaataaaacgaatggtcaaagttgggcgcggaaaaccatgactgcatttattttgggacggatggtgtaggaaagaggatgcgagaatatggttaactagtaaccggacaaaattgccgaggttcatgtcacatctggtaaacaaacaaatcaccggggttttatcgtcagttaattactagtagtattactgctttccttcttggattaggaagaaggccgaaaaaacatttgccgtgtccagctgtgtgatctcgaaagttgttgactattccgagtagggattgcgtctacaactgaggaacctacgcttttggcttctttgggttcggaggcatgtcacgtcaacagatacagttaaaagtttggtcaaccaaagcacaattactccgtactaccgatatcatgtactccctctgtcccataatataagtaattttgagtttttgcttacaacgtttgaccactcgtcttatttaaaattttttaaaattattatttattttatttgtgacttattttaatatctacagtactttaagtacaacttttcgttttttatatttgcaaaaaaaatttgaataagacgagttgtcaaatttatcgtgggacggagtgaggactacgatccccatgcttatgctactatgcataggtctgctaaataatttgcccatgatttcaccgttatcaaactgacaaaacttacatcctggtcgttaattcggtttctgaaaaatctgttttcgtggctctgcagcccggaggtgtgggggaacccgggcgggatccggtgcgccaaggagacgatgccgctgctcaactggcacgggccgatctggctgggcacggactgggacatgttccacgcggcggccaacgtgtcccgcacggcggcgacgcgggtgcccatcaccttcgtcgacgtgaccaccatgtcggagcggcgcaaggacgggcacacctccgtgcacaccatccggcagggcaaggtgctgacgccggagcagcaggccgaccctggcacctacgccgactgcatccactggtgcctccccggcgtccctgacatctggaacctcatcctctacaccaggataatgtccaggccgcagctggtatagcaaattccaagaatttacggagaccggattactcataggcagagctggttggttatacacaatcatcgtactgaaaagagatttttcttcttcttttcttcacattcttttctggccgtttcacctgctgtcagaagatgtctttcatttgttctttttcttcaggggttaggttaagtgggaagagatcgatacagtatatggttatatatatggctaatgggatggccatgcttgcgtacgttacgtgcctgcgtgcacagatgcgctgtaaggttcctgaccaaactgtacattggggaagaaaaggattaaagcgaaagagatgaacagatatggtttacagagaaacggacggcttcatgcgtccagctgcagatcgagtagtggtggcctcgtggggatacctactgcctacccatgagtccatgacagaaaactctgctcgatctgttcttttctccgggtattttttttccctacttacacacgggaaacagatcgaaaaggcactttcagttgatcatttcgatgtaaagcctgaaaatcatctacctgaaagttgagtgacaaaaagaagcaccacctgtcaacagttgaggagggggactacagctccactacgagccgtccatgcagctgaggcatgcaagcctgctgcttcttagtttcctgcatttttctgtatgcgtttcgttgcggtagcaaagctcgcgtatcctctttgtcgtggcaagatgctgctgctgcgacaggtaggacactggacacgccacacgtcgacgaggccgttccatgtatgcgaggagcaaagttgctgggagataaagcacggggcgtgctttgtcttctctgtagaaataaagggactgtctatatccgttggcagaaaattttacctcttatcttttaaattttaggccacttttatcttttaaattttgtaccatcggatatgctttaagatttgtgcagagacattaaccctagctctcctcccgttcccctcgcatcgctcatttcgccgccaccatcacgcatttctccgctatgcctgatcccctgccgccaccgccccatcgtgccgccgactgcctccccaagccgtcaacgacgagatgccccgccaccaacatcagcccaccgccctcttccaacaccacagctccagcgtcgctgccagcgcctcaccgcccgcccgatccaccgcccaccgtcgggctgtcgtctcccccggccatctctatagagccggcgaactcctccccttcctcctccccctcccaccccaccccgggacactaacctgtagggtcctctaccggagtctaaagtgtcgccagcgtcagagaagaagaggaggtcgccggagttggaggagaaggccaggagcatgaatattgaagctaatccagtgtcccaaaa

SEQ ID NO: 41725 - DNA, 2380 bp, Oryza sativa
agcagatcagcctcatttattgtgtaagatcaggcgcgatatggtgctcggcgatcagcaaggttggagtagctatggcctatgagcacaggtcactcgacgatgcgtgaatgcgtgatgcgtcctgtgcaccaaactgaacagatatatagtcagattaacgaatttaacgatttggccggcccttttccatttccagtcctatgttcatatagctgtggagtccttgtgcaacgaatgatatcagatgcgacaagtgtaggagcgtgtgtctatgcagtcgaatgtccagaaaattgtccattttgccaacatgcaggtttcagaattgggaccattaaatggaccattagttctactaggcccggcccatgcaggtttaagaattgcaacagtggggaagccacagcttcagtcatcagtcttataaaaagaacaagggattactgaagactcaaggccccagagttacataccattcaggcattcaccgactggcacatttaactgctagtgagagagtgtaaggcataatcatgttcctaaaatacacaacaaactatactactctactagtagtatatttctgtgaggaaaatacactaccattacttaaacttgatcgattttcgtttcccaacgattttaagtactacatttgctttgcatggacctaaggaaagccataggaagcatgggccggcctgatccatactaattcttctaggcccggcccactatttcttccccggggcccgagctcgtttataacctagagaacgccccctgaagctgctcgccgccgccggccgccttataaatctatcctcctcaaagatccctatctcttcaggttcaggctccaagcaagcaagtactccttcatcttactcctagatttcatccatcctttgcgttgatccttctccaagatagattcaatagtagagttcccgtctcagtctagccgtattgttttgttttcgctgtaaattttcgttcgatttgtcgtgtactgcttgtggcggcaactttatcaagaagggccatgaattaacttttggttaatcatggactaattaggctaaaaaaattcgtctcacgattttcatgcaaactgttaattatttttttatctatatttaatgttcattcgtctcacgatttccatacaaattgttaattactttttttctatattatgttctatgtatatgtctaaagattcgatgtgacgtttttttagaactcgcgaaaagaaaatttttgggtcacatcggatgtttgaccggatgttggaagggtttttcggacacgaatgaaaaaaataatttcataactcgcttggaaaccacgagacgaatcttctgagcctaattaatctgacattagcacttgtgggttacggtagcatttatggctaatcatggactaactaggctcaaaagattcatctcgcgattttcccctaactgtgcaattagttttttcatttatctatatttaatattttatgcatgtgttcagagatttgatatgatgtttttgggaaaaattttggggactaaacgaagccagttggaattttggggactaaacgaagccagttggggtagttggggtgcagacaggtgtttcgtgtgtccacgtctcgaaacaatcatgcagaaacatcgttcgctgggttgcagcacaagctcgcacagcaatcgtatccttatgtattgcgtccgttcgaccgttccgtttcgcgaagaaagtacctattaacatcatgagaaactgaacgctaaagcgccctttgagggcaagttcaacgctctattgcaatgacatcagtgcatcactttcctcttggtgacagtgaattcaaaacagaaactgcaagtggcatccgttgctgtgagctaagttaacgaaaccatgtaggagtagtaataaactaactgatgcacatattaactatactattaatgaacttactaactgatgtacagattaactaagaaattaatcagtttcccaccgcctgaacctccggaccagcagcccaggcaccggcgggtgcaatgcaatggaatgtgcacgtacgggcgcacggcgcagtttacatgcgacgaccgagcgagccctgtgcgtgcatatgatcagacagcatcgctcccggcgacgtccggtttggtggtggccgcggccggagaagcgagctcctgcacagagggcagctcggccgcgagcggagccacgcgtccacgcactccgggtggaacccgtgcccgcacagcggcagcgccttcaccttctcgccctcttcgaactccccgaggcatatcgagcactgcgcggcgccgccgtcgtcgccatcacctgggctgcagga

SEQ ID NO: 41726 - DNA, 10707 bp, Oryza sativa
gtcaccgatgaggctgaacctggcgcggtcgccgcagcgtgcgacgaggagaagccggagctggtggtggcgggcatcggcgtcgtgtcgcggccgtagcggtggcagtggcacgcccagcggaggtagagggagacggcgacgaagcagacgaggacgaagaggagcgccacgaggagcggcaccgcgcggccgcgcaccgcgaagttgccgtcgtcgacgtcgccgtagcgccaccggagccccaacgcctgggacgacgcgtcctgcgctgccgccatgctgtgcaacgtactcctacgcggctgagccaaagtccaaacgcagcagccgcacgcacacgtcacgtattcacgtagtgtcggtttgtgtcgttcgtcgcgcctcggcggaacaaaatttaaggcgcgcgcgcgtgcggttcgctgcacgctgcgacgctgcgttacgtggctaacgcgggctcggcgatccctgtccccagccggtgctcaaaatgcgcggtgtgccggtgagtgtgtgatatggtggttcctagcttgtttcccttttacgtttgacgaaggctagtcgttcatgggccaagaaatgaggcagcgactgttggctcgacgctgttcatgtagagtgggacacgacagttaccacagagattcccaggaatgtttcacgtaccgattggttgttctcaatatgcagatttgtggaaaaacagaggcctcctgcggttactttgaatttctggaagcatcttaatcggtgttattattcttcgctgagttttgtgtggctgtcgttggttcgtgctgacatgcatggtactgcttgctgagctactgtcacatgtcgggattatgctagcagctgaaagaaccatctaggcagagtagtagtcctatttgattggtttgtgcgggtcagtttcatcgttatgacgggtttgtctagatacacaaatgaccaattcagattgtagccaaaataaatcttatcaagttttaataatgctaaaattttagcaagatgacaatattactaaaattttggtagtatttcttatgtgttaaccaaatttagcaaactaaacgtagatatttttttaacaatataaaaaaaaaggtatggttgaaaatggcatcaaagtgaagaggtccaaaatttggtgatatattcacttctccagttgtccgtgtagaccatattggactcttgaaagtttgcacaggagccacgtcttcacagactccactagctagttctgtgaacatacgtgcaccactgcatgaagtgaactcgttcccattttctcccacagtcacaggagcaccacgatcggcatggcactgacctaataacaacaccctaacccccatgggccaggcccaatctgaggcgatgggcattgcaaatagagccgaaatagatgtaagtggatatacccgtaaaccaatttatagatcaaattagtaggtaaccgtgagttaatttataggttatccaataattttatttataaatagattcacgggttgacctatttacatcctaagctgcatcgatccctccaatgccccaccatcacgcttctaccagttgggtaaaaaaaaaacacaacaggctgaacagcttacgtgttgggcctagtttagggtcaatatacagaatccattatatgccattgagtttgtctcatttctatgattagctattgactttgtcacgttctacaatataccatcgacttttgcttaacttctacgatttaccatcaccatccggtcagtctccgttagtaatatactacattttttttcaaataaccaaaataactttaggacacaaatatccaaaattagaataaaaactctaaaatcgttatttttgcatacctttttagaggcatacgggtgatcgacccaattgcatggaaaaaatgaccacatgcaaaaatccttttttatagtgccacctaggctcgcacaataaaatttaaatagtttttatgacttgtgaacaaaatttttatagcaaacgtttcacaaaataagatttgtttgggcttttttttaagataaagaaaactttcagactccaaggggttcgtttggaacaaataaattaatttagatgaaattttaaagataggatttctatagaaataattcctatgtggtcatttgaaatgaaactaggaatggctctcctaaacccctttaaaattctttaggattacctcaaaccatagaaattttggtggatttttgacataaattcgaaccttctggaaaaaaaattcctttgtgtctatctcttttctgattcctatatttatcctgtgtttcatccaaaaggtctttttcgcaggtttttttgtgtgtttttctattataggatttaagatgggctcaaaggcacttcaatcctactagtgttttttttctaccaccccgtgttttaaaaatcctgcgttttaaagtagttctaagggcccctttgatttgtaagaaaagtataagaaatttggaagattttaatcctatgggaaaaaaattcctatggaaaccatatcgtatcatatcatatactttgaaattcctatggaataaataatcctatagagattttggaggaaagttagtaagaggttcaatttcttggaaaaattcttttgagcctatctctctaatctgattcttacgtttttccagcggtccaatcaaatggtcattcctgtgttttttttatgtatttttcaattttctgttttacgcttgtattcctatcataatgctgtgtttttcctatttttttttattttttcattgctgggatttaaaggtgcctaaaatatttcaaatccttgcatgagtgtgatgtgacatgccgagggatgtgtgtgcgtgtgcaggtataatataaaagaaaatgtcaacattgtagccggacccgcggagacagcgtcgagccactcgagcggcatggaagggcaaaccgtacgctggagcaaggaggctatctagacaagtctggcagctatagcaagctagccggtcctgatgaatcgaggaataccagcctactgcctttgcctagaaataattttaactccctaaaacatcaaatcggccgctgcgtgacatagcatcagtcctgccaaaatctttgcctctgatcacacgggtggacgtcgccatcctcgttaatgaagccctttattcccgcacagcccaatccctgcagcctgcaggcatgatgcaaggcgtaccagcggacagcagatacacagggggatgcaaaggccggattcagctagcgctcgtattttaactcgggccgagtttagaacctgtttgattggtgaaataaaaatttttagtagtcacatcgaatgtttgaccggatgttggaaggggttttcagaaatgattgaaaaaactaatttcataactcgcctggaaaccgtgagacgaatcttttgagcctaattaaaccatcattagcacatgtgggttactgtagcacttatgactaatcatggtctaattaggctcaaaagattcgtctcgcgatttacatgcaaactgtgtaattagtttttcattttatctatatttaatgctacgtatatatgtctaaagattcgatgtgatttttttttggaaaaagtttttagggaactaaataagaccttagttccaaattttttcttcaaacttccaacttttccatcacatcaaaactttcctacacacataaacttccaacttttccgtcacatcgttccaattttaaccaaatttctaattttgacgtgaactaagcacacccaaaatttcggtatgcttgggtgtgcttagttcacgccaaaattggaagtttggttgaaattgcaacaatgtgacggaaaagttgaaagtttatgtgtgtaggaaagtttttatgtgatcgaaaagttgaaagtttgaaaaaaattaattattgtagctacagagttatatacaatcgtagtttggtactcgtagtacgatattggaaggttttctcgataggtcgatcagcaagaaattatacctttacagtcagtactatctgcgtctggttcgtggtcgtccgcaatgacaccgtcgtcggcttgccgcgctaggacgagcgcaggtgtgttgggagtctaatttacaaaattccaatgatttagaatgatcacttctatttaatgtcaaatttattaatctactgtcatgaggatgaagtcattgtaatcggtcattttaatttacttgctgccgttcttccttttctcttcttcctaatctttcggttgccttcttctcttggttcttgctgacgtaggagaagtagagtgcgtcaacatctcttttgataattttttgatcacctcacgattagcgtcggtcgattggacgacttagcttttagggttttaacattgagagagtttgagagtccccgcgaattaaatttcaaaatataccgtttatttaatttttttaaggaatatttgggatgaaaattttttttttgcgaaaatataccgtcgatctcgcacaatcattgcgcgaaaataacggatgcgtgacgtcgcaggcggtatcgcgtgggctatgtgcgagaccgcgcggtcttacgaaatgaaagagcgaggtcttgctgaaacagtctgcgacagtattaaccggctccatttaattagtgatcaagtacataattaactattagctaataataattagtgattaattatcgtgcacggtgcggtctcgtactttcaatgcgcaataccgtctgcaatgtcacatccacgtcattttcgcgcaacggttgtgcgagatcgtgcgagatcgacgttatattatcgcaaaaaagtttacattcgaaatattttgaaaaaaaaaatagatgaacaatatatttttcaaatttaattcgcttccctgctacctctcctccgctttatttattttgtagggatactggtagaactcaggtgattaatcttctgttacctaggttcgattctgttttacactaatcatacaaaataaaactttatcttatatttttttcttaatatataggaaaggcaacgatggttctatcttttttttaattatttttatcggcagtagtgaacccataaatcaaggcaccggcgtgacaagcacacgatcaagcagcaacgtcgtcgtctcgcggccgcccgaccggccggcgccgtggcctggtgcgcgcgacgcgattgcattgcatgtgcacaaccgtacatgtgcggcaccggcccgtgcagcacgaatgcaggatgcaccactgcacacggctaagctaagctgcgggggcaggtagggggccagattttccatgtcgctactccgtgccagtgccactgcagcgtcgtcagcgactctcaggcgcgcgcggccacatcatatcatatcatatcatatcacgtctcgtctcgctctcggtgcaggcggtcctaggcgcgcgcgcgcgcgctcgtacgtacacaggccggaatgtcacatggcaatctcttcacggcgacgcgacgcggtcggtccgtacgacgacgttgcgcgcgtccgggttctcgctggcgagctgggcctgacagaactgactgttcaatgtgttcatagactattctttgtcacggaagagagccgtgcctccgagacgaccatagcaagttcggtgtggagtaggagtactagaactaaaagatcatcaggtgttccaaattggaaattgagattttcccaaaacgaaattaagatgaggtccggagtataataacgcatggcaaagcccctatagctagactcactaaacatgctcattgccgtcagctttgtgacatcttaaacacacaatcacccacccggccaggagtttttcccatttaatggagaagcttgaagcaatgaaattgttggcgtcaaaagtctaaaatacatgcagtcgtcaaagaacctggattaatttgcaatgagcagatttttttttaaaaaatactaaccggttttcaggcaaatcgactaagaaactactactactctagacatgaaggaaaaaaataaaaaagataggtatttctagtcgcccctaacccgaaatatacataggggcacctaggatcagtggcctggtattaaatatattttagaatagattttgagtgcctccaaatttgttaaagttcagttattttattcatccgttggatgataatacaatggttgccaacacctcctaattacacttatttaaacaaagtcacttctttagatacatggttgaaaaatatgttactctaaccagaaaaaaaatataaaattacatgaaataaacttatagctaataaaaagttataaaatttacgtgcattttttttaacttagattaaatataaagtaaaaaaaatcatatataacgacaaatttgtagttagatatatgcattgtggaattatagatgactgaaaatgtataactccttaaccgtatgaaatctatcaaatccctaattaaaatagaattgcacatcatgttccaatccaattaacgtaaattgatggagagaaaaatatcacgtactctccatttatcatatataagcatttctactctatccgttctaaaatataaacaacactatcaccttctggcagttctagctacttcctaccttaccagtgtattttgaggtaaattacaaacacccccttaattagccgcctccgttgcctacttgcctccgccctgcagtgatctgtcatgcatggcttgtctctgcctcccatcctctatctcctcctctttgcctagcctccatttgtttaagctgatcgaggcgaccgcgcgatgtaacacggcaaggcatgcacgtacacgcgcggacgagaagctctgactcgttgcaggctagaatgctacagtacagtagatagctggtacgtgttaagaccgagtttagttccaaactttttcttcaaacttttaatttttttatcacatctaaactttcttacacacataaactttcaacttttctatcatatctttccaatttcaaccaaacttctaattttaacgtgaactaaacacacacttaatcttccagaggcccggaaggtaggagtagctatatagcctattgttgcaagcagagccaatatatatagaaggaaatatatacctggtacgtacgtactcgtcgatatggaagctaagctaagctacaccgcgaagcggctgggcactgttcatgcatggccatcgaccgaatagaatagaaagtacacgtacttgtagccactgtgtcacagcgacttccatttccaagaactgtactcgcgcacgctcggttggaagcttgtaggcgtacggtatcgggcgccttcgattcaacgatttcctcaaagtgctataacatccttccaatgatgatgatcagagatttggatgactcgagtcttgtgcaaccatgcatgcgcatatatgcatgtgtcgttaagttataagctcgacagtgaaatcccatcttgtttggaagccgaaggttttccaaaattcgttgaactttcttaggataattatggaagtgataattcagtgtgttcaactctttcgcgtttattatattaaaaaatagttttttttaaaaaaaatatgtgtttcaaatcccgctaactctatttgaattaatttctctcaacgtatatatgtgtggttacctattatcctagtgatcacagagccagaaattctaaaatttataagtagggaggtgtttgctgcggtcatatataacttgtctcatactcctatttgcttaaactataataagctagcatttgcttaagcaaaaataatttgagtacgatggtaattcccgatagaaatgaatggagggatcgtccaaagtaatgcttccaagagtagaccacgctaataagtcccataagcgctcatggagcttatatgacccaatgactgaaatatttttttcaatgacagcatcggctacgtacagggcttcaaatatccaccaaacacaagtctgtacaaggtaaaacaactggagtagacagaagactagaggtgaagctagctagaaacgaataaagagccattattctatgctgtctctttgccaccatctccggggatgtgttacctcccgggtggtcatgtgtacaaaggggtgaatgtgacacaggtaccaatcatgtgatcatgtatttcacaaaggcactcaataaaaagggattgtacggcttccgaagaccctagctggctaggcttcttttcaccaaaaatatagcgggctttcgatcactggtactgtatgagtgctagtaaaaattaaagtcgagatctctagagactagagctatcccatccatgtacgtacctcttcatgaattaaagcatgtattgtgaactaacaatgtcaacattattcatgaccgaatctgtttatttcatctctcgctgtatagtacaaattaggactttaattttgcaaagttgtagatatatgtattaattaattgtttaaatgttgtgatatttttcttaaaaaatataaccattcagttgatatttaagaacaaaaaacatgaatctaaacgagtgcacgtgcacttgagtaggtacggagcacaatttttctgcccactgcactgatcatcagaaataactaggccaattacgaaaacattgcctacgtttttttattaatagaagaagccttgcgttgatcctttttcaaacgtaattaaactcatcaatttaaattaattaaactcatcaatttaaaatcaattcaaaccctggtcttaggtgggttgactgtaaccctattttcttcttaattgattggcagagttcctatcccttttctataagaattcaaagcatcaaactatgagactagagggggaaaatacaataacagtgcatgatgtatttcttaagaggggaccgtctattgtccaatataaaaattcaatcaaattaaaagagtagccagcttacatcggactcatgtaagatcgtaatctaatatatatttcctggtcctattacataacccatgatatcttcattgtacatttttgtcacgctctcgtcaccaatgaagtcgctaaaggccccttctctcttccccacctcttcagcaatactcccatgtgccccccttttcttctttgtcggtgattcgtcttgtcgcacttttcctgtctgtagtggcttatgcgacacactccctctactacatacctaaacatacttggtctttctcaccttctagtggaatctaccactgcctcatccagttcaattcattgcttggaataatataacgacgccctttaatttctctgctcacctttaggttttagccatctagatcatccctacaagctctagacacacacttcatgctgtgtctcttcgattggcgtttttaatttgttggtgtcaagtcttagagtatgaatctcaacaccaattctcttatttttcctctttattaaccgatttggttcagtgatatcactgaaccaccaaatcacttacaagattgaccaaatcacttacaagattggccatgacgatggttaatccaaataacatattggcccgggttccaacttctaccctcttagggtaagttatgagcacgagaattacagaatctaggaacaaagtaaatatcaaaccgtacttgacaaagctttatcgatcaaatataagaagctttatctgataaaacttcttgtccagttataatttgtactatacatggttaaaaaagatcacgcggagtaacagaaccatgcatctatgtgcttatactctcccatgcgattgtacgcgcgcagtatatatatgcataccgcgcgtctcctcccagcaagcggaaatagctccaggggctgaaacaaacccagcacatttgtgtttgtacgcgcagctagctagccacgagcgcggatccatctcctagctagcgcaccatctatggatccataccacgactaaaacatgcatgacccacgcggcttccccatccacccgcagccgtaccacctccaccccacggccggcggcctcggcgagggcaggatgcggggcggcgggcggcggcgccccggcgccaagctctccaccgacccgcagagcgtggcggcgcgggagcggcggcaccggatcagcgaccgcttccgcgtgctccgcagcctcgtgccgggcggcagcaagatggacacggtgtccatgctggagcaggccatccactacgtcaagttcctcaaggcgcaggtcaccctgcaccaggccgcgctcgtgcagcacgaggagggctgccagcacgccgacgtcgccgcggcgttctccgccgccgacgccgatctggcccttgagctgaaccatcgccacggcggcgccggcgatgatgacgccgggatgacgacgctggagatggcgccgatgcaagaggcggtgggctacggcgacggccggctcatcagatgatgcagcaagcgctcgatccagcggggcagctgatgatgggcggcgctcatcagctgcctcctttgccttgctgtgtcttcgtccaggagactgacccctcgtgctactcggtgtgcaatgtccacggtgaggaggggctgcagga

SEQ ID NO: 41727 - DNA, 940 bp, Oryza sativa
tggtgaatcataccataagaatagcaatcgtgtatactccggccattaaaatgccgtcaaaattcagttcatgcatatacacaagctatatatcaccgcgagaaagaataatactataagagagtgtaactaattctagctgtcagtccattgtgatccggcctgccctcccttcagtgagcggtacaaaggtctggatcgcttgaagccgaatatgtcagtgattcggtaagttttgggtgtatcagcttcagcaatggccttcttgaactctgccaaatgttcgccgccgaagacttgcacgcttacagttttcctttgaggggcaccaagtcttatatgctgatcaaaaaattcgatgaattcttctttcttcagctctcttagaagagctacctgcagaacagttaaatgcacaactctatcatatgcttcctgtaaataaattttaccaagtttaatctgttcttgattttttttttgttaaccaataacttgttttcattaattcgatacattttttccaacaattaactgtttgctgaaaacagagcactaacctcagactcgaccctgtcaaacttgagagttcctgcctcaatctctccccaatagaagtgggattcctcccacaaatttttgaatttctccagtttcgaatcgacaagtgattttacattcctctacaaaaagaatgccatatgtcaataccccagccgcattgatgtgtaaagaaccacctagtagtaatgtgctccaactgagtacatctagtgatcaaaatactatagagcatactatatcactgctcttttatcgattacaacccctccagatattgtatacaattgtgcatgtggaagtttaccgcacagaaatgaatgtttaaaagaacatgtgagcacttaaggaagataaaagaaaggaagtttcatgaaag

SEQ ID NO: 41728 - DNA, 5461 bp, Oryza sativa
ccgctcaccttaaagaaagacctgctatatagccaagctgctcaacagttcgcagctggttgaaggcaggctggctcgcaattaaagcaaacagttgaagtttgatatttgaaagggcatcgtccagatgaacctgaatataaacatgcttagcatcctcacatgcttctttctacataacatcaacattttttacttttcaaacttcaaattattgagacatcacacgacttgtaaaataatagccctcattagaagttaattttcttcccctcaaagaaaaaactgaaaatggggccccaaaaagctagactttacatcttaaactcatcaaaactcacaaattgcatccttgtgctccttttttttatgtcaaattttgtactcacaacccacaaatcgcatcttcaagcatatgccctagttctccaaaaagtatcaatagaacataatcaaacctgtccttctgattcagtccggcaaagccactgaaggaaacaatgtgtcatgtcccttgtgctggttcagtcacaagcaacctacttcttaacttcaatcagtgctaagcgaccaagagtgaagtgtctatgaattctgttaattctataaatttttaatattcttatttcagatttttattaaatttgacagtctgtaagcaacaagattcctgacaaacaatactagaaaaagagtggcaatgattttgttgcagggtatgtttttcaagaatagttaaagagcaaataggagacgatgattcattgagtagagcgatgattatatccatgagtctgaccctcccatttctttcaggggcatatagtaaaaaggagtagcacaaatgacaggagcaaaaccaagtgtcaccacgcacattccatataaaatcacaaacattagttccagcaaaaggaatttaatttaattgacttggatctgaagtggaataaacaaattatatgactatgggcagtacatctgtgaaacagataccttttgactagacaagagatgcccccattgttgctcgtataagctacagttattgacgaattctttttcattctaggcgaaattgttcaggaatttcacactaacagattgttttgatcaagtaattgtactttgaattagttttatggttgaatttgagtacttcatattactttgcatgcaagtacgacatgtaataatatttttagcaattagaagtaggtaactctcaagtctactgaattttaggaacaagttcaacaatttgtaatcaatttggtcaccattagttctgaagttactgatcatggatcagtagttgctttcgttaatagtagttgcattgcatcccttgcactaaagatcaagccacagggacatttacctgaatatattggaccactgatgaattttcattcttctgatttaagccctcaatttggtggtagcattttaactcattttcaagcatgataacccttttaatcagatattgtgatggagacattgatttgaacacagaattaggggtattgaatatagtatcttcaatctcctggacaatagatgttgcctcatttggttcaatgttccctacaaggagaaaagttaatcaataagtatgactggaaattcatcctgttacagtccattgcaaatatatctacatgatgaatcgactaacaagaacttctgcctaaccatgaatatagcattccaaaaatgtcttcgatagcaaatgtggcatgaactttgcaagagaatctggttcaagcttagaaagagcctcaagtttctcagccaaaggccatttctgatcctccaatatcaacgagagatagtatgaagcttgagagtatggttggctgaacttgaaattttggtagtccttgacagcagtttcctgtggtggtaggatgaaataaatcaatgaaacaaaatgacattgtattcaaaagatcctaattggtccatggcagagcctgttatcctatatttatcaacagaccgagaacagagctcattacaaacaagtacaagttatctgactatcttggataattttctggcaggtacaaaacaatacagcatgcagaactgaaaacattaataagattactaaattaggatatggagtaagaactgttatttgtgatgtttgctttcacccgtttgtctagattgctgcgttttttaagaatagatttgtacccaaatcttctgcacggcaagttatacatgtgatgtaaggctgccttgttttcacatcaaatccgtaacacggtaaacaccaagcaacaaacaagaacaaataaatcttaattatgtactcagagtatcatataatcatcctgtgtgttcttggttcccacaatatcatgtccataagttgaaaagtttgacacaactaagctttgattgtctaacaattacaagttgatagataacagttgcctaatgaaagtaaaatccagtgatcgaaaaaaaaattgatgcacacaaagttaaaacaaagagaacaattaaatattgaaacctaaactccaaaataactaaatctacttaccttcaaggcacaaaacctgttcggtttaacttcaaagttagatatatgcttcataatggcatctagcagaatccgcattttgtcattgtaaccacctactgagaccttacatagaaagtaaaaatgtttttagttctaattcaaactgtcctaataaagcaacctcatgatgcatgacaattctatcagacagcataacaattttacaatgaattttttttttggctggaacactccttggaaactaaatgagaacaataaagtagttcactgactaaacctggaatccagcagaagtgcgatatattgaatagaataaaccagcaatttgagcatcatacgctgcaaaaggcacaaacattttgtaaatttatgtttgaacttacagttggtgggagtagtaatacccaaatgggttattaatgtacggataaatatgctaatatttacactatttgtgaagtggtgcttaccatatgcattcaagtaatcagctaacaaatcaacaaagagactcgtagaaatgactgcctcgggggaatggcttgttaacggacagtggaaatcaattataatgtgaacctttggagtggagaacagcatgtcaggcttataccacaaccgtgaaagtggtgtctttctcaatattgctgcatattttaccctgcaaacatttattttgtaagagatatttactatattcaagattcagcaattcatttagaactgtgctaatgtggggaaaaaacacagatgaggtgatctgaatccaaccttttcatgcgcttctttgagcgataaatcttttggaatgaaaatgttaggctttgggatacagagcttctcagtaggagctttttgaatccattgctgccaaagtagaacaatcactgacaatatgttctagcatattatctctatggattataacaagtgtccacattctaacagtatgtaatgtgcaataagataagaggaaaactctagttcaaaaaatcaagattattcaaaaaggacaaacctgtatcatggaaggagtaacattttcaacagaatacgctgtactataccatggctcaacagaatcagtagatcctttgaactttttagattcccacagtatcctggagacggagagagagaaatattacataaaaggaagaggaaagtcacaatatttagcttcatatggtatttttaagtgccaaactggatatctgtcagcttgtcagaaaataagtgggcaagtaaatataatgactaattttgggcataactttctaaggtcgcatatctggtagaagttgaaaccagtagggataactttctaaggtcgcatatctggaagaagttgaaaccagtagggatggcaaataatgatgcataattcttaaacctattaccactttttacttcagaaaagaacgaattcagaaatgtttgtgtgttgagatacctaaatagtagatactgtaaatagataggaggaacaaacaatgctgccatgtgaactgcataaatgtaccttactctttcagctgacaactcatcaagtatcatatttattctatttggagcatacttggacggtagtgatgctccaaccagccattcttctggtgggaataactgcaagcagtccaaaagatctttcatattgaagatagctaatggactacagatgaaaggtgcatttctccaacatatgtcagtccaacagagaaaatttagacgatagaatagttggtaatcggtgttatcacataatgctttgctggaggtgtatcagtaatgaatagaattgatcatatggaatagcaaacgatacattatgtacttaatgaggtattgagaagtatacccgcatggttgagacagtatctgtcacatagctgattggatggactttgtcctgatagtggaattccgtttcatttatcgccacaagctaacacatccaaaaacatgttaccatcacatttagtttatctatttaaatcatcccaatatgcttaaggcatgcagaaaaagattgatactataaataagtgaagttgatgatgagatgataaattgaaacataatgaggtcttgctaaaagaaagtacgactcatgcaaatgtttctttttttttggagcgtgactcgtatacaaatggttgtagtgtatcattaattgatagagtctattgtccagaattagaaggacatctgtcctgaaccctcataagttttcaaaactaacaggtccaattcaaatggaaaatataccatttgttaaccaaaatttatattcgttatagaattcactgaatgattaaaaccagtaaaatattccccaaaaaagtcaactgacgttgctaaagaaaacttttcctatcaaagatatgcaaagataagaaactcaattatgtggaataactcttgtttgggtaattttggatctctcaaggaaaatatcagaatgtcatacaagtatcagaacttctaaccataaaacatggatttacacattgcgtaagtccatgttcttttcaattacctcatcaaagatccactcatggatcccattttcttttagtagaagaatatatttgaaaaccaagccaatgatgtcttccatgtgttctgaaatcattgcatgtgcacgcaagaggcttaaataataacaacatgtgcttaaaacaaaatagccatgttagttctaattaaagatagaagctgaccatgaccagcatcggtgagcctcatgctaattgaaaaaaaggagtattgagcactgtcactgccctccccggccgacaaattcatagcccatcctaaagtagtcaaaattgagcatatgtcacatgtagaaagaataaactagagtgactatgagtagataaggaaggcaaa

SEQ ID NO: 41729 - DNA, 2094 bp, Oryza sativa
  unsure (1)..(2094): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtctcggcagctcttggctccgcctcctatcctctcctcttcccctactctcctctcttctctctctccgcctccaccagtctccccctctccctctccaaaccctccatagctataggcagcagctgggggtgctggcggcgttgaggcattcttgaatccggcgtggtcgcttccccagatccatcttttttggatcgtttcttcgggcgatttggaggagcaaagaaagccctcccaaatcgcagaaaggagccgcctttgcgaagctcctgctgccttctctgctcgttgttcctggcctgggatcacatatccccgcaaggaaaaaaaaggagccgcctttgcatttattcttttggccccttgggagatcgccctcgtcaagatttggtgggaagtgggaacccaattcgctcgcggttctcacttctccttgtgtggaaaggcgccgctttggctcctgtttccccccaccgctcgctcccgcgccgctcctctccctatatatctatctctctgactatcttgttcacatacgcctgcgcgcctgcctaactttgttttacttcgatccatccaccggttttcggcatcccccgtctcggcatttgatcgttgcttagtcgcttgttgatttgacgcaggccagatcgctgtctggcgcttgttttattttgagttgttgcggtgtgtttgctgttcttggttggaggcatggctgcggcggcgaacggaggtggcgcggcgctgttcagcgaggaggagctgcgggacgtcagcggggtgcgccggtgcgaggatttcgtggaggtgacgtgcgggtgcaccagccaccgctacggcgacgccgtgggccgcctccgcgtctacgcttccggcgacctcgaggtcagctgcgagtgcacgcccgggtgtcgcgaaggtccgtgctcgccactgtgcatcatcagtacaccacgtcctttttgcttgcttgcttgtttgtctcgttgttcttgatttcatgtcagcgcgcgcgtcggtgcacgggtggtgtttgatctctttggttgtggcgtcttgctcccatgactggacctgcatgcaatgccggctcatgcgcctcgccgctgcctgcgcccagcgtcgcctgtttcttgtactttgtaccatgctcctgcccatgcattgctagtctggctcgcgggactgtcgatttcggcaattaaatcatccccttttctgcaatctgcatgttcatgatgtatctttttttttagacatgtccatgatgtatctgagcgtaatatcgcctgcatcttacctttggtttaggaccattaggttcctcttcttctgtggtacctaatgcacgtaagttgaattttgacattgtgtactccctgcatgctggggatgatgaggttcccctctgttcagtggctgtgttcaatcactcacattacattgctacgtctctgtttagtatgaggttttctttcgtgtgagagctagcttgggccatgttctggtttgtagttgcatgctgctctcttatgcaaatgtgtgaaattgataattgcgatcttgactccaacataggatgcttgcgtttgatgagagcggaatggaaaacttactgttgtgttgtctctgttctaatgttgttacctggtggctatattttttttgtttccgaaagctgtagatgctgcattcagtttctctatccccgatgtctgtatttcagtgtgtgtccgtactgtgctgcaagtatatt

SEQ ID NO: 41730 - DNA, 2653 bp, Oryza sativa
agttacatgttgtacatggcatcgctttgttgtcatatttctctatcttctgactgtatccaaatgcaagtaatatctttgtactagtatagtactattacaagcattgtacaaaatcttggtaatatatgccagttgcaactattatcatgctttttaagcgcataactgccatttaagttttgtaagttgaaatttgcagacaagttgacgccttctgcctttgagaaacactctggaagggagactgctggaaagtggaggaatactgtgtgggtcatggttcaaggagagaaggttccattgtcaaagacagctctgctgaaatactactcgctgtctcacaaatctgctaatggttctaacaaaggccgtaatggtcgcctgtcacaccgagatgagtttattcactgtacggaatgtggcaaggagaggaggtttcggctccggtctaaagaagagtgccgtatttaccatgatgctcttgctaaacctaactggacatgtgctgatttgacaactgataggtatgtactgtcaccgcttgtgttagttaacagtctagcttgctaatatcaagctatactgtttgccgagatatatgatatgttcatgtcattgttccaaagttcatgccaacctactgtcgggttcttatcgtttttctttttgttagtggtattgcggatacttcttgttaagtgttattattggagaacagctgctacagttgtgctattttattttattattattttttgctttacatgtccatcctttttttttaaaaaaaaagaacacattgacataattgctagttttcttatatttctgtgctttgttagttgatgaaattgacacgtgaactaaatattggtggtgcgcataccctttgattgctggagtacacttagtgtccatatgcatgttacttttctgagtttctcaactggtagccataacaatgatagtgacacaagttaatgaaaatccagcactccagccgcaggctttgcaatccaagatggcaccccatgtatctctagttctctctaccatgcccatgattggtattagcgtctctggtagctgcctgtttcaagcctgcaatataacaactatgaattattgatgcactgcgaaatatttatgctaattaccttaatcaatgttttgcacaacaaaattgtgcacatactccctctatctcccaaaaaaactcaacttaggaggggatgtgaccccatcccctcctaggacaaagggtagtccaaattcattgtcctaggaaaggtcacatcccctcctaggttaagttttttttgggacggatggagtagttggtaattatctgtatattataagacactttgacttttttctaagttaagcttcttctagtttgatcaagtttatagaaaaacataacatttttaacacaaaactaacttactatcaaaatatattcgatgttagatttaatgaaactaatttggtattgtagatgatgctaaattttactctctccatttacttttgatagtcatatttcatctaattctacttatcatccatctaaacatgctactagttattcctcgtaaacaagtgattcaataatatttatatttctcgatgctcatgtagctaatcttgtgtggaagaatgtagagtcatgcattaaatccaagaaagtcattaagatgatatattgttggattgaaatatacctattaaaaataattttttcagatttggaaatatgcttatcaaaagtagatagagggagtatatataattggtcaaagttcaagaagtttgatttgaaaaaaaaaaataaaacgtctataatatgaaacagagaaaaggaggggaatttagcccataaatgccctacagtgtctgcatgatcaaactgcaattgtaggaaactactaatgctttacagttaacgtattagtagtttagtactatgtctttggttttctactatctactgtgggagtagcaaagtcgaaactgctgccctgtagtgccgtctgttggaactgttgctatgcaagtttctcgccaaacacttccagatctctgcagggtcatgtactcatgcggcctgtagccacaggacacattcagtactgtatccctgtagcattcagtagcatgtagggaaaattttctaggatcgctgaagggtgctgttccttcagtaacatgagtacatgcattctaaatttggctgcaatgtttacattaaattttcctttaaaaaagaagcattgctttgcctagtgaccagtagtgtacttttatgcaccgttacctgttctgtgttccttccatcctcagtttgacatttcttggttttccatatttcatatatttgctttgttcttgtgtacatttgcatatatatataaccttgattgatcccaccagggtcacctgcggcgatgaggaggagcgcgcgagccgcaaggtgctgagaggctgctcccgctccacgtcgtgcacggctgcgtgaagtgcgtgtgcttcgggtgcgagatctgccgcttcaccgactgcgagtgccagccctgcgtcgacttctaccataactccaaggagtaggaggatgaaacaatgcatgaaacaccaccatgggacatgg

SEQ ID NO: 41731 - DNA, 3495 bp, Oryza sativa
aaattctattcatgttcattttagtacattgctggggaagtgaatcggttgccattggttgaatctttgtatgcaatgcaatgcaagggggtttcggcgtctaagggtgtgttttggatggagggatatgggtagataggatatggcggcccattttttgtgggtgtttggttcctgggcaggggtgggatggggcggcccggggaggaatattccccccagatgccggatggggggatccggccgaattggccggatgcagccgcccgagcgctcgggcgagtaggggtgagcgacatgtgggtcgcgtcacccctctcaccacgaggcgagctcggcggctaggcaaggcgacgaccgtggaggcgagctcggcggcggcggcggctagggcgagccggcgacgagagaggaggtgagccggcgacaaccggatctaggggggcgccggcgagagagggcgagcggcggcgtccaaggagagagggcgagcggcggcggccggggagaggatacgaggcggcgggggagagaggaagcgcggcggtggggttgccagcgagaggaggcgagcggcgaccggcgatttcgagaaggcattttttttctccttccccttttatttctttctgcttttttatttctatttagatttttttagtagattgatatttgttgggtgagaatttggaggggtatactcaccacctgtaatgaaagggtgattgcaaccactcatccatcccactccaaccaaaaaaaaaatggatcaccatatccactttcatccctacaactaaaaaaactggatcgccgtattcactccaccaaacaaaaaactggatcgccatatccagtaaaatatagaccatcatatcccatccaaccttgaccggaaaccaaatacaccctactaaaatgcttgagctcgcgatggatcgcttggatggatgcgctccgtgagctttggtagaaatgtcgcgagcggcatgcgcacgtagcatggggatgttgtccagtgatggcgatattattcggggtccccctaccgcggcagcgctggttgcagggcacgtcacaccacccacgcggcgccaatgaggcggcggtcgtggctgccgcgcgcggcgcgcgcgccgcgggatcattcgcgcggccgcggccgcggcctcgcgctgttgcgcactaggcgtctgtctgtcatacgtcgcgcgacccccacgtctttgctgcctttccgctgtggattggttggtgttcgcgctctctccactgttgcgcgcggttggtggcccagagaaccggcgcagagagcggccgcgggagtttgcccttgtcaacttgtcgcttgtccgcgagcggtgggggtgaagcgacggcgtctcccgaggccggtgtcctgcacgagtgatgaagcgacaccggcttcgtactggccggtgtgtctcaaccctggtgcgtacggacgcgctgtacgatggttcaccagctcagagacgtgccatgtactgtacgatgtggctcaccggctcagagacgccagagcagagactagtactccagtactagtaggttggtttcgcgtataagacggaacaaaaagcggttagtaccgagtacacagtgttaacgccggctcttcctgctgtgcaactacagtggagggcgcgcgtccgggctccggggtaaccaccacgtactacttgagcagtggaaggcacgcgacggatgtgacaggaggcacggtggatccagcaagagattcgctcgcctgtcagccactgtacctataaatcatttatagtcaatttatacaccaattaattaacaccaattagttataaacatatattactttattaatatttgatcccacatgtcatatacacattgcgtcttagagttcgtgctacagctagctactccctctgtaccataatataagagattttgagtttttacttacactttttgaccactcgtcttattaaaaaaaataaaattatatttatttatttttacttactttattttattatctaaaatactttaagcataacttttattttttatatttgcacaaattttttttaataaaacgagtagtcaaacggtacaaacaaaaactcaaaatctcttatattatgggatggagggagtacaaatctatagtcagcttctcttgtctcttctcttttatcttgtaatgtgcttatagttggcttatagtctgctactacatgctccaatactactagctacaacatccatcccaaataagtttatttataagtttttatgtccaacatttaactatttattttatatgaaaaaaaataaaaataataaggccctgtttgtttcagcttaagattattgtaatctagattattaaatcagattactctaagctggattataataacctgacataaaataagctacgagttgtttgtttctctagataattagaggcatctaagcgtagtgggtctttagccactcaataatctagaaaaggctcctttaagagaagattattggattatagtaatctggctttatagattataataatctagcataataatctacttgtttgttttagcttacttctaataattcatattataataatcctaagctgaataaaatagagcctaaatcgcacatacgttggacacataaaccacgaataaatttattttggatggaggatgtagctgccactgccaagatcaaatactagtacagtggtacgagtactgcaccgggagctgtggcgtctgggctggctagatgatgcagccgagtttgctgacgtgggtgagtttgtggctgacaaaactctcgcgttcgtcaaaaagttgtcataaaaaaggcggttcactctctcagcctcgcagcatcgatggtgtgcggtgcggtggaatctcgccatgcaccgcgtcgcaacacacagtagttgcacaattgaagcctgcctctgcctgcgccagcagagcatacatgtaccgatcgatgtactgtacggccacacccacacgggactacggatggaccgacatacatatacggatcaccagccagcaattgttacctgctaaagcgccaaggactctgctgaacttgcagcatggatcggcagcctcagatgcgtggatctagctggacatgcgcgacggagggagacactggccaagcgattttctagcagatgcacggtagtgaactgtgatcatggagggaccgtcagggtctaatggtacaactgtacaagcgtacaccactacaactagctacaacgactatctgaacctctctctcctaacaggaaggtgcccgctcattaatgtgtgaaaatttttttacgaatgcccatgtgaggatgtctttctagtaaaaatatttcttttactatatcatgaacaaaattaaatttatttaatgtgctttgatcagctgttatgattttttttcaattaccttcgcagc

SEQ ID NO: 41732 - DNA, 18593 bp, Oryza sativa
agtgggttaagcctacaacccaacataggataaatatgtccattctaaattatctctctaattaagtaaggaaaaataaaatagaggttgtagtatttttttagcaaattaccactaaactgaagtgtcatgtaacaaatatacatttctatattattcaatgctaaatgtgaggaacttacgatgtaccatagcaagttttaccaaaaagaaataaatggatatggtcttttaattcctatcaggaattgacttatatattgccgaggccacatcatgtctgtttcactgctaagatttattggtgcaacccacgttcttggtatgattggtatgatattcaactggccacatttttatttttaaaatgttgtctataaaaaataatgctagatggggtacatgttatgatgtaaaaaaagaatatcatttcaatatttttatttaatttatcagtgacttcatagatcatatatataatttagatggtataatcatcttaagattatttatttatctcctaaaaagatcatttattgataaaagcatcaatatcaaattgtatgggtaaatagctcctatatacatattgagaaataaattaattaagttgatagaaaatcgttagatgtctaatgggatataagtaataggtcaaccaattgtataaaaaaatcatgtgggatattttgatttttagtgagaaattttagtagtttcttttatttagtggacgcctcaatacatatatgggtccagaatataatttttctattagcatttaaatatagtcaatatttgtattaaattattgatttcaatagaaaatataatagttcaaatagatcataagagacacagggacaactagctagacctgatagctagatccgtttgtgagaaattatttaagcaagacaagtacaagcaacttataagagcatttatgtactttaacgcccacagggatggggaggaagggaagaaggttgagatttttctttaaaaaaatagatctaataatgacgtaaaattatgtgtctagaaaccaatgattggatatttctttgacttaagaccgccatataacggtttagaaacatttatagaatgtttaatggactttaacacgtatgatgtctacttgtgggatttttttcctataaagataattttaattttaattatgatatggataaaaaaacggagaaaggaacggagggtgcgtacaacagtcggtacttgcgtgcgtgcacatgccgcaaggaggtggggatggtgggaggttttggtttggtaaaatagatatagtgatatactttattagagtatcacgtattgacttagatgtatttatagggtgtcgcgtagcagctcgagagcgtttgtagaaagtttaataaatttttagtagtctctctgtcgtaaaatataagtgattttaaaatagtaggatgtgttttatccgttcaaaatatctatattttaagacagaatatataaatagatagacaggaagacagatagatagatagttgtatgatctccagcgaaaagttaaccaaaaatgcatccgattgcaattgcctgaccagtgggacactgggacttagcaaaccacaaaccacagttaaacaacgacctgtgcagttctgtttaaccaagccaagccagctgccagtatccctatcacaccagccaccggctagtgggccccatgacatgagtaagaggaatatgggccccacctgtcagagagtggcagagagattagctctgttcgtgcagatttctcagctcacctttggacccgggctatcctttgaactggctatgcggctttccttcgcccttaccctgtctctctgcctgcatgcatgcagcctcagcagcgagtgatgcatgcacaagcatagcacagcaacctgccatcttctcctttaaatacgtcatcgcttaatttccaaggcttccgttttctcctaaacataactgcgtagcaggcagatctcgtcggcatcttgttccagtttgacagttacagtacagatcgacgtgtagaataactgggagaaggaagaagacgatggcgactatgaagttgggctccaagccggaaatctttgttctggaaggcctcacatggttatcctgaattcctcgtttctttctgttgtgttaattttctgtatgttgaatttatttttttttctagttcagaattctcttaaaggatctctatcatatgttgagtttaagagatctgatagttgatgttcatttactaaccatatcagtaatcagtatgtcaactagtgctttaaaaccatgggtacttctgtgacagattgtatggagatgcgtaggttctcaaacaatgtaaaacacaatcaaattaatttctgcaccgtaacgtaacaacagattgagtttcacgcatgaactatgtcattcccaacctctgatccatgttgttcactggcaaatcggctggaaatctttcatggcacagtatgttcatctgtttgatataacacattcacgtcccaaactcccatgcacgcacataggtcgattcagattatccctcattgctaatctatacacgtcaattccaaacgcttacattctgtttgatataacacattcacgtcctaaactcccatgcacatactaggtcgattcagattatccctcattgctaatctatacacgtcaattccaaatacatgcttaatcttaatcttgtcaatcgccaggagatgcatgacggagctggagagtgatgtcgtcgtggaagtaggagaaatgtcattttacctccacaaggttagcgcaattattctctaaactaatcaccgtgaattaaaatatcttgaattgcattgagctggcctggtcgagctgacgtgtagcagttcccgctgctgagccggagcggtgtgctgcagcggatgatcagcgagtaccaagcgccgcaggaggacggcggcggcggcggaggcatgtgcacgctgcagctggacgacatcccggggggcgccaaggcgttcgagctggcggcgaggttctgctacgacgtcaagatcgagctcaacgcgcacaacgtggtgtgcctccggtgcgccgccgagtacctgcggatgaccgacgactacgccgagggcaacctcatcacgcaggcggagtccttcctcgccgacgtgctcgccaactggaaggactccatcaaggcgctcgagacatgcgagggcgtgctccccaccgccgaggacctccacatcgtctcccgctgcatcaccgcgctcgcctccaaggcctgcgcctccgacgccgccgcgtgttccaccggccacgccgccgcctccgcctccgccgtggccgtggccgccaagaatgccagctacgacgcgctgtggaatggcatcggctcggggggcacgccacggggcgggggcggcgcagcgggcgcggcggcggggtgctccgggatggactggtggtacgaggacgtgtcgttcctgagcctgcccatgttcaagcgactgatccaggcgatggaggggaaggggatgcgccccgagagcatcgccggcgcgatcatgttctacgcggggcggttcctgcccgggctgaagcggaacaccagcttcagcaacgccagcttcggcggcgactgcggcgccggcagccgcagcatcacgccgcgcgccgccaacgtgtcggcgccgtcggagggcgaccagaggtacttcctggaggagatcgtggcgctgctgccggcgaagaagggcgtcgcctccaccaggttcctgctcgggatgctccgcacggcgatgctcctccacgccagcccgctgtgccgggagaacctggaacggcggatcggcgcgcagctggaggacgcctgcctcgacgacctgctcgtcccaaacctcggctacaccgtcgagacgctctacgacatcgactgcgtgcagaggatactggactacttcatgtcgtccacggacgggctcgggaccgggtacacgtcgccggcggtggtggaggagggcagccagcttggggcgctccatgccgggagcccctcgtcgctgtcgccgatcaccatggttgccaagctcatggacgggtaccttgccgaggtggcgcccgacaccaacctcaagctgcccaagttccaggcgctcgccgccgtcgtacccgactacgcgcgccccgtcgacgacggcatctaccgcgccatggacatatacctcaaggtgatcacacacgtcgctctatctagctagctgcattgcatttcgatttcatctcgtgatcaacacacgtacgatgatgatacggcgtccatgcacgcagtcgcacccgtggctgtcggagtcggagagggagcagctgtgcaggctgatgaactgccagaagctgtcgctggaggcgtgcacgcacgcggcgcagaacgagcgcctgccgctgcgggtggtggtgcaggtgctcttcttcgagcagctccgcctccgcacgtccatcgcaggctggttcttcgtgtccggcaacgcggcggcgggcggcgacggcgctccgcagccgcacccggggggcagcgccatcgtgcctaagggcgcggcggcggccgggcagtccgacgccgacgcggaggccgacgaggggaaggggaaggagctccccgccgaggccatcaccgacgtgaaggcgagggtgtcggagctggagaaggagtgcatgagcatgaagcaggagatccggcggctggggaagccgaggagatcgtggagcctcctcaccaggaagtgcaggttcgggaccaaggtgcagcaagcgcagcccaccatgagcagcaaatgagaggcgcctcacgccctgcctgcttcctgcctaacccaagtatgaaatcagtacaagtactaatcccttcaattttgatcctatagtctctgagctttgctgtaccgagctagttaatgaaatgcaataagatgcttatgtttcataggataataagctagttttaggccttgaacagagtccttcaatatgtactgtcatttctgatgtatttcagggatttattcttaatatttatatattaacaaagaagaaaaatagttagtaaaccaaactgtttcctgccacaaagaatcaatacggccctaggaaccattgtgatcatgcaggatttcaaaaggaaaacattaactataggcacatctgaacctaggtaaaaagctcttgaggtatccataaaaggccccagtgaacatatattacattaaggcaggaaaatcctttagctatatgctgctgtaaaatggaataacttagatacgaacaacataggtgtagggatgtacaaggcgccaccacagaacgacacatcctattctctcccgtccatcgaagcagctctatcaaaaggccgatctcatagcaccacgagctgcctcacgtttcatctcagcagccttcccacttccacggaaatacatgtatacttgctgcatttcaaacggccaagttcagaatgacatctcccaggagaaaatgaagacagcattgcagcggaaattttattgcaacaagaacaaaatcttaggggacagcacattctagttgggagtggagacatcaatgcaaatagaaatgtatatattctgaaggcacagcatgacgcatgatgatgaacggcagaatgaaggagtgttgctgaacagacaccaaggtgttactatttggctttggctaagatcaagttttataaaactcacctggatgacaacaacgctgagtagtgattcaaggcagaacagtccaaatccaatgaagtaaaatatctgtcgaaagaaagtgtgaacaatgttgatgactcaatcaattgtatgagacatgccaatcaaataaattaagcaaagcatcacgaactcccagagtcccagtgcggcagtgcttactcactgaggcaaaaggtctgttaaaaaaatgcaaatagggtcctcccaagatactaaccctgatatctcaaattaacttgaatctagaagaaaaacattaagtaaacagtgagacttacccccacaatagcattgtttcctatgacatcaatagccggcaaaatcccactgtggcaaaaaaaaaagggagaggcaattagagaagtggtatttataaattgaagtagagaaaatggacagcctgcaagttgaattgctacaagtttgtaacaatttagagcatcaatagcagtgatccaggtattaccctaacaattaacaccatcacctaataactatgcaaatgccacgtaaaagcaacctagaactgttgcacaggtacctctatgagccaaatactaatatatatgctaaaactgaagaataacaaagtctcaaagcacttttaagtcatagccactaagacactatccagtgctccaatgttgctgcttaaataaaatgtatgtttagttaaataaaataacagaacacttacgccagagactttcctttgaaaggaaatgggggagccacagcagaccagatgcagaacagtatatggatctgaaagggggcaaacactgttagcactgcacggaatatctgcaattttgcaaccaatagtgtggcaaaccattaatcttatactagatcattttaaccttacagttaccagaaggtaagggtcttaccaagtaaaacaggaaaaaccatccaaacttcaaagcactctcagtcctgcaacatacattgtaacaatacactatgtcaaatataagaagaaatagtgtgcagaaataacaaaaacacaagtatattcacaacctcatcgcattgtaaagggggcgataccataacacataggctccaggtacaccagatataaagtagataatggctagcaaccagatcataacacctattgaattgaaccgcaggattagtttgaagtgtcagtgcagatggcagctgatccataagataaatatatagtaaggtactcagtcagccatacctgcccctttaatccatgctgctgtagttgcaattatgttccagaaaagacatgccgccaatcctgcatgacatcaaagtttgcacaataagaagcagctttgtagagcaatgctacaccaacatgcaaataggtactagctctcacaaccaaaattcagtccactaaatagtgcttctttttacaagatgccaagtattgttagcgttgctttgaaaatctttttacagaaagacatttagcccagctacaaaacagggtagacaccacatgcttatgcttattaggcttacataattactgcaccaagaagataataactatttttctcaaaagacacaggttgcaacttctatttttttaaaaaagaatctcttaattggatatataagtcaagattagagaagttcattgatatcaaaatgtctcaaagtaggcacgtttttctcatgtcactactcacttctggcattgactcagcagaaattcattgattggacagtaaatgtagtgattcaggcagtattttattcacaatgtttaagcaaaaggatataaagaattgtggttccaccaggtattttagttcttgtgacagctttcccaacatgagggaacaaaaagagagttaaaacttaaaactaaaactaacacttacccaacaatgaagaaaatgcaaggtattgcatcctttgtaggtggattggtatctcatttgaaatgtcatgatgaataatagggaagaagggtggccagtttttctcttcaatgacaatcccagctgaaaaataaaagaaagagttgaaaggcagaagcaacaactaaaatggaaaatagattgcaacagaacaaacataagcacaaaattagcaagaatagccttttcaagaaagacgaacacaatgtactccctccgtcccaaaaaacacgaatctagactggatgtgacacattctagtacaacgaatctggatagagatatgtccagattcgtagtactaggatcataggatgtgaaacatccagtactaggttggttttttatgcgacagagggaataatatagcataaacaggagcatttctaaattgtacaacaagggatacttgcctacaaatctcattatattgcaaagtgtaacttaagtctcaggctctaaatctaaaattagctatagttttctagtcaacttcctaattaaccaatcgacacaaatatcatgaacaactgtttcctatcttcgaatattttttgttagaaacacaaaaacaaaaagattacacgtactcagctgcgagaaaaaaatatacctctggatgcagcttcttctcttcttctcaattcctgcgtatcagggaatcacaaaaaatcaggtggtgtatttaaagaaaatacaagagcatgcttgtacgcaaatctagggtgttttaacctccaatcatgtgaaacttgttggatcaaatttttactctatgagtaaaactcagcacactcacagattcagcattctatacacgtaattctcgtgcgcaatattttatgaaaagaggagatatctagatgaaatcatttgataatgttagtttgcattagcacgctggtatccttctgtttatctaaaaaaacagccatccttcttttcaaagtgctataattgagtgtatagatatccatgttttgttcatcatttcaaaccaattgtgcaatgtcaatgattcaattaatggttagatcagcgaggtctattgggtgccggatctttgtgtcaaatccatgccagctaaatatctttcacattgcataatggttactagttcaatactcaatactaacacaatatataggtgcttcccaatacatcataggaaaaaggttaggaattaggactttggccaggggaagttgacaacttgattcattagaatagttttttacttcatcaaacattggttaaaaatcacattgctcatgaaaagatcaattgaaaattccaagtttcaagcataactacagaaggcacatacgctttcccgtttgtttagctcagcctcctttgcctgcagttctttctcctttttcttcatgtcctgaattacatacgaacatactcaatgcataagcaaccaaccacaaatacagcaacaaaagaatatatggtatcaaacatccaaaccaaggaatagtgaaaccatcattactagattaattgtgttcttcagccttttaaagagataagataacaaaaaatgaagcatgcaactgttgttacacactaacagagtaataatatcagagtgaaagagctaagtacagtatgattttctcacgctgaggtacagaacataacttgtaaatatagtagcacgtagtattaccgctcaatggaaatacaagtaccttggttgaatcaagaggtatgtccactgtggcaccacgatcattatagaacccaggttcgtgaggaagaggtggcatccgagagttggaagctggaggtacacttccaccctgcagaacagggtacatttaaaaatgaaacaaacagatagttgaaggaggctgctaaaattagaatattcagccaactctgttatccctttttacgcctattggccgaaagctcaaaatttgacagtttagaaatcctagatggagcatgtgcacgcatacgcacaattcacatgattatggactcgctgacacgtgcatatccagcaaactgagagtaaactgactgcaggcttacgacactaaatgtttatactggcagagacaatcttcaatctcctaatgttatagacgatctgaaccaaacaagtgtgaactgccccattttacggatattttccaataattctaagagtagaccgaccattttcacaagttatacatatcgattgcaccacatattccctcgtaaaaccagaaacataacgtcccaacacaacctaagagccaatcttcaatccgagcatcatttctcctatgaaaatgtataacaatacaaggggaaaagttgccacgcctcgcgatcagctagcaaatagacaagcaaaaaaggccgtattcgcgccatccaagtccaaccccctaacagcggatcctaaatcactaaccctagcgccaacaactcaggctgatccaaagcaccccacatggcgtgccgcgtgcaggaccagacgaagcggccacggccagaaaaccagcacaacacatgccaatccgggacgcagctcgactaccccatccacacaggcgcgaggacaagcttctccatgcctagatgaagcaaggaggaggcgcgattgcgacgcggagggggggtttagccccccgacccagctacagcctaacccagcagctcaccgcgaaggggttgacgtcgtcctcgtcgaaggggttccggtcgtacctccccgccatagctcccctccaccccaactcctcctcctcctccggaagcggccgcgtcggtggtttctctctccggcgagggaaggggaacgcgcgtgacggtggcgaccaactgctccggcctccgggcttccgcttttacgtaacctagtgggtttggaatttgggatttgttcaggaggggcttattttagtggtacttcctgtctccgctggtgctaatctctgacctgtgggattcttcgcgtacttgctcaccggccgacaggtggggccaggtgaccggtgggcggttgagacttgagagttgagactagtcggccggcaaagaggaacggacggggtggtggtactgcacaaatgcaacaagattgtcagcgtttgtgttagtacttgcaagtacgttcttaatttggagctgaaatttgtccctcatgatagtagtattagcgaaggggatctgatttaattcacggttagtacgatcggcgggttttgattgacctgacaaacctgtcaccaccctaagtttaaagaattggaagtttctaaatggaacacaaatttgtcctgacgtacccgcttagtaactgagcaaaaccatcgccagccagaattggtaaaaaaaaatacagacgagtgttttcttaagaacgaaggaaacagggcttaggaaataatcaaatgatgacaagacagtcatcagcacccagctggtttgaatttgaagtcaaacggggaatgggtaatgcgttcaaaccgtgccaaactctgtcttcaaaacttcaaccacttcgttgatggtgaattgaattatcaccagattccagattacacgggcaacagtttcattacatgaaagaagagaatgaatcaccacgttgaactgacatcaaccatttttgaacttgcttctccctcatccggggctgtccatgtaacaaatgttaattacagattatgcacagccaagctcacatgtacaacaggggactacgccgaatcaaaagccaagtcaaaacacaattacacagctcaattgcaaagctatggcaacaagctacaaaaactgtatggcgctggcgcgttttttgccaaaaagaatgatgtctagttatctactctcactgtgttgtactagtatgaatgaacctccccgcttgtttcagatcaccaccaagtcttgcaaagacaggttcagttcttgggcaagttgtgctgattgaccaccccgcctgcaccagcaaaatatgaaaccatcacagaatgtcaggaaaggtagctccaacaaatgacgtgggtagcaacaaaaataaacaacatggtgcacacgaacaactgtcagcaagcttaagaaaacaatagtctgataaagtaaaggataaagcatctcatacagggaggggaaggaaaggaattacataatcaacgggtgtagaacttgctgaatcttttgcaaatggttaaaacaccgactgcaacgttgcaacctgtgacatcaacgaagtcagcaacagtccagttcatcttggcataggcagagcaataggttataggatgctacaaacactgcagttctttaaaacaatggttcctaactgaagtgcagggacagaacccacttgtcacctcacatccagtgtctctttgcaatttgcaggttttgcggcgtcctttaaatagcattcccttgaataacattaatgcacgtacctctgctcagcctgaatatcaactccaactgctgaatgagctgacaatgttgaacgaataactggtccaaagatctttataagatccaacaacaattccaaagaaacaatggcatgcctacaaattgaaattaaaggcaaagtaaccataagacaaagttactactaaaccaaacattttctaatgtaagatgccaatatctccatggttttgtaaagaaaatagatccatgaccttgcttgcaatagaatgaacagactaacaagaggatagacaattcaatttaacagcagcatcttgtgtctacatgtgtgcacagagcatgtgcgcttaagttactatgtatcacttggtccagtcagacaagaaccaacatgcaatggaatagagacatccaatatatcacctttcagccttgctggtcagtaaccccgcaagaacaggcagaaagcttaagaaaatgtctaggttgaagagatcaagtttccccttcagagtactaacaacatcagctagaacctgtaaaaaaaagggtcaaaccattagcagctaaaaaatatgaagtacatgtacatccaagaatatcgcacggcatcttgagaatacttacagcattgtcaggcaactttgccactgcagcaatcgctcctttgataccattttggtcaaagacatgacgcatcatctgaagacagttaacattaatatcatatgctgatggagtgatggctatgatatatgcaacttttactagttttcaaatgctttcctcactgactattccccactctccacttgtaggataattagtagatggtgggaaaagtgcatgccaatgcataatttacatacaagtgtagatcactctcatcttatatcaggctatcagaaataatggattcaaagctagctgattaattttagggtgttgcgggattgatcaacaatcttcactagagctgacttcaccttcaatttataggtgtgtccacaccaattgtctttaagaaaatgccaataaatcatttaacgcaagtatcaaagaaaaaggtaatgttcaattctaagttgtctaattgtactcaatagactaacaacgataagccattttccctgtactgaatagcctaaagaacacagaagagcttcatcatatgtataatctatcatgcaatggcatgcaagattggttccctgtttattggatacaaaaggtcaaggaaggaattctatggtgcacatgagctggtaacaaacagaagtccgcaagtaaaaagatcagagacaggacacacctctaactttgtcagccgagattttacggcatttataaattcatcatggttctgcatcaaattgattggaatcatcgcctcatcaattgttgacaagtccttctcatatgcctgacttggttctgcctgtccattacaaccattgcaaaatataatgatttgagtaccgaaaaaattcgtaaatgctagagagcatgaacaaataaaaatggagcaaaggtaaagtcatatttttctagcccatattctgattttatttctgaaaatactccaatctcccagaagtacttaagtccacaaaacattacattatgatttatgacaatctggtttctaacaatactttatcccttctacttctatctccagatagaatgtacttcgcagtaaggggaaaaacgaatacagaaatttacattgtataatatgcaagaatgagtatgtatgacatgtcccagaaagataaattggtttaagaaaaatgtttgagattatcaccaaggactttaggaaaatagtaagtacagttcttaaacattcatgcattcatgaatgcaccaaccaaccagataataaggtcaaattgctttgaaattaattgggcttaaaattatgggtacatactgaaaaggaggaaggaccatcagatctcactgcacggtcaccacaagaaccagttggtggtgagcactcaacattagtagcctctctcttttcccatctctcaacaagagactttgtttttcctaatggcacagcaactgcaaaaggagttaaaagtaccattaaagaactaattttagcacaagtagataccgagacaatctcttaacgtacacacacctcctctgacatatttgaccttggttgtttctgtagtagaacatggtggctcagaggctgtagcaggaaagagtttcatcgtcaatttgccaaaatgaacagaactgcagagtgcaaacttagaatgtaggaaaggatctctaagacttactatcatttgactgaagttgatgctccaacgacactgttctgtccaatttttctgtcatttgtgtattatcacctttatccatactatcaactttatccacattatcatattcttctttcttgtaatatggagttagtccaaaagagaattttaagccagagaaaccctcagagcaaacatcaggatcagttagcatggattttgttgagttaacactatcacccacaaaactattaactgaaagtttccttgaatgaacaggagcatggaaatcatctgcaactgcagctctccctctgattcctccactaatgctgcctgctgttttgtcctctaaaatgtctctaggcataacgacaggcacagaaacagtctgtggtgtagtgtaaatatcttttacagatactgactcagcaagatggccttttttaacagttgaagaattattagctgttcccgtacgggatgctagcgaggcatccctctgtgcaaaattgcgctccactgtttttctatttgtgtatggactatcagcagctttcatgcgcctcattggagtagagctctgaatagatgatttgaaagaagaatcaggtcttcgaggagttgcaccactcttatctctcttggttttatccatacttgctggagtcaaatttgagccacgaattccactttcagctactaccagaaagagagagagagagagagagagagagagcatcagtgtgaagtatcgaagtaaaggtacttcaatacattatacataatgagagacaaatgggtgtttgaagcagtaccagtccctgtttccttgaccttgtacagattttttggatgtgtcgttgctagagcaggaatggacttggcagtggtatcaatcgttttcgaaggattgtcgtctaaagaatgtaccagctcagcaaagaaatttgctttgggcaaaacaccaagagcatagggcccaatgagctggatgaaagatattgattagaccatagaagaaatacatcctatgagacaaaaagtaaaactcaccgatatatcagcaacccaaacaccaactcggcattcgtggtaggagcatcccaagagttttccttcataaatactaaggtcagccaaattgctccatcccatgtcaacaacgtcatgacatcttactggctcccaagagaatacctaacaaagtgctcatatagttgaacagggaccaaaatattgtacatcaacaacccacataacaaaatcagatttacctttaggctttggtctaacccacagaatagggtttttccatctgggtgaaagaccgtagagcgaacaccagtagcctggaagagaagaatgtaaagaatatcataacagaaagatgcatttacccgtcatgcatgtttgaatacaggaacaacagggaacagggtaagaaagtttaaactagatgtaaaagcatccattaaaaatctctaaaagaaccaacccattgaaaaatgtgacaagggaggtcataaaccatttttaaggattggaaacaaaatttatccctagcacatctttcgtgaagttacagtggtgctaaatagaaaggagacaatggatgtaaaacatgggcaccaacgaaatcaaatgcatgcgtacaaaataatgattgttataatttgtctctatggtttaccaaaatattgtgttaaacatacgcaacaattagcctggtattacaaaaatgtgtaaagcaagtacctcgggtccagcagaaccaatcaattcaaaagtttcaagatcccaaaacttaactgttcgatcagctgagcctggaaaatattaatgaattcaatgagtatacccttaaacttcttaaaacttcacttactgcacatagaaaagcaataacacattatatttatttagatcatatatcctgtgtattctcaaaaaattcatagtatcatactaaaccagaaacaatttggtataacaaacttcagcattagctttatcaatgattatactgcaaagaaaataaagatgctgtctccaaaagtctctgttttacaaataactgccaaacgagtaggtacctgttgcaagcaaaaattcttgcggatgaaaatcaatacaccggatttgcccactatggaacttgaagtcatgtagaagctttccagctgtcaagtcccacacttttacaatattatcttctccgccggtgacaacccatcgtccatcaggtgtaaatctgattgttctaattgctcctctgtgacccttatatgtgtgaatgcatccttttttctttatatcccagatcttaagatctgtatctgaagaaccagatgcaaaaaactcgccaaatggatggaattcaacagaggtgcaacttgatctgtgcccagtaagagaccgcacaactgcatatcaagacaaaacattaataacatatctagcttactaaattactaagaagcacagttgttatgatctatgggaacactattaagttatgctttcaatggttatccacattagccaagcacacttcttttatccaaatacagaagcgtagagcatagacattttgacgaagatttgtgagtttcctaaaatcgcagccactgaaaatcagaaaaagaacctaatacagcggataccaagcatttgtatcaaaatataaaataagtttgtactaacaactaacaagtacattgatagtaccactatcacggaatgtaatggctatgttttctataattgtttagaaatgaacagacagttacaacaaagcaaaaggcaagtcattaaggtagcacaatttctaggacttataaagcaataagccaccaaccacacccatggttcaaggcgctaggcactagagggttagcagggctgacgcctagctagcaggtgcctaggacaaactaactagtaaaacccaagaaattagcaaacatatctctactattataaaaattgaagatgttttttaccggtattttggtacgtcatatgtatttgagtcggtttttaagttcgttcgctttggaaatacatatccgtgatgagtcggattttaagtttgtttgcttttggaaatacaaaagaagtcgtataagaaatttcttttaaaaaaacttgcatgctaactttcgatggaagtcagactcctaattgcagctcacgatttactaaaaataagccgtataacaataataaaattaaaatagcattcactcgttgcaacacacaggcattttttctagttacataaaagttggataatataacactaaaatagccacctaatgcaccacctagtgcctaattgcagttgctacacggtgcctagcgctgattttagaacactgaccacacctttagcctcttccaagtcccagagcttgatggaaccatttgaagaaccagcaagcacaagcacctctgctgtatcaaactcaacagcctcaactgagccagtgtggcctgataagctctgcacaaacaataagccagaaacacggcatgagtcaaattcaacataaccaatagaagtgtccatcactgtgataggggcacaaaccagaagtggtgtctgtttgccaatggcccacaggttaaccttgcggtcgctgccgccagtgataaacacacggcttgacttcttgccgatagacaaggacctcacttcagcatcatgtgcgacaaattcctctaatttgggtttccatgttaaggagttataaacttgagcaatgcatgcttccaaaaagtagccagtaacagcttccacagctatgatttgtagtcaactaaaaaaggtgaataactgatcaaaccgtatcaatacatagctgtttttttcccggatgaacttcacaatttagttatagttgcttcggaagcaaattagacttggtgattcggaattggcgcattgctaacctaaactgggcactaaaggaaactatttgctgaacctgttgaaacatttagtggtagttcagttccttcttgaaatcagaaacgacttcaaccttggcgcagattgccaagaaagaaaaaggtggcgaaaattttctcgagaccaccactgtcgctccaagaaactacccacaacaacacaagactagaatttgagggaggggaaataa

SEQ ID NO: 41733 - DNA, 2088 bp, Oryza sativa
tctacattttgatactactagtagttcgtagtagaatggaatttttggtacacaggccattttgcaatatatataggttttgcaatgaatactcgctatggctttgagaagaaagttagcagcctcaccagcactccaacagttgtaaggtggtgtttgaatacagaaacttaactttagcctatgtatttagacactaatttaaagtattaaatataaactacttacaaaactaattatataaataaaagctaaattgcgagataaattttttaagcctaattaatccataattagaaaatatttactgtagcatcacataggataatcatggattaattaggttcaatagattcgtctcgcgaattagtccaagattatggatgggttttattaatagtctacacttaatatttataattagtatccaaacatctgatgtgatagggacttaaaagttttagtcccatctaaacagctataagatgattggcaagagtcaggaggtatgtggtagatgtaaaccattagtatcacattgagtatatgggatatgacaaatagagaatatgttgaaaagaagcttacccaatacccatctttacaagagatttagggcgtttttttttgggggggggaggggtggagagttgggagtacgattcactaccaaataaatatgcatggcacgaagtggtgaagataaaaccatacttcaatagttggaggacacaaccgttaacctagagagtcggctagcaatcatcaaagtagtccttcctacatcggtttcttcctctctttttctctcgggggaaattgatatgtgttaggctactttgaaaagaaaaacttctcatacatatcataatctcgcatataccctcgaacaaccttacgtatagtttatacaaaagcccaccatactattatagcaggatctaatggttgcttctcatatttatatttatagtcccaaaaaagacaaaaacatgttagaagagaaaagaaaaatatatctttcatgcatgagtaaatacaagatgatgtgttttgtaaacaatctagacatatgctcagaccatcttaaaatacttgcatgagtacactcaaagcatacacctagtagaaataaaaataatgatgagtagtaattttacagtagggtaacttggacttcattcgttcctgggagatccgggagattgagagagaaaaacatctcgttttccgcgcgcgcgcttccgttttttgcaaaaaaaatttctataggaaagttggtttaaaaaaaccatattaatctatttttgaaatttaaaatagttaatacgcaattaatcatgagctaatgactcacctcgttttgcgtatattcccaatctcctcaatcactttctcctcaaactcaccttggtataaggtgtgtttgcaagagcaagttcccaatactctcctctcgttttccgcgtgcatgcttttcaaactgctaaatggtgtgttttttgaaaaaagtttctatacaaaagttgttttaaaaaatcatattgatctatttttgaaaaaaaaagctagtacttaattaatcacgtgttaattgaccgcttttttcgtggataggagatgggttcccaaacacccacctccaaacacagccataagcacggaccaaaataagcgaaagcacatatatgatggtgtgaatgggcacttgcatccctccttgataacggaaacatcaaaacggttggtattcggtactcccaacccaccacccttaatctccataaatacggtgttactcgagagttggcatgagctggcccatagatgccaccgcaaccggtatgaacagtggcagtgtgcaaacaccataaaacctcagcttggcctaccggccgccgcccgccccatggacagggcctacgacaagcacaaattgattactctatccgacttgtttggtaggtcgaggagtcaatgtgccgtccggtgggaggtcgctcgcgttcgcgggcatcatcaggcagcgaaaaaaacgactttcccgatcccaaatcctcctttccccttccgtcttcaggcgagccc

SEQ ID NO: 41734 - DNA, 2122 bp, Oryza sativa
ctccaaggccgacagatggccgtggcgcacacgtggggaatcagcatagatgacagtgattgtgcttggggggacgttcttagttggagcttaatgacagctttcgtcttaaaaatctctctgggttgatgacttgatggctctgttttctgtcagatcaatggatcatcaactggatccaaatgccaaactccagtctcagaaagacaaggggaacatgtccaatctcgatttctcgaaagaacacgtgttcagatagttgaaacatatgctcgtgttccttcaatcccgcggtctagtacaattcatgggcctaattgggccttaaagttgatggaccggactttgtgttaaagtttgtggaccagcccgaagaacgccgagcaacacagaaaggaataagttcactttaactcccttaactagaggccgaatctaactcatattcctaaaccacaataccggatatctcgaccccaactattaaaactggtacaatttaactttctgattggttttgaagagcggtttcgctggcgtgacgcctacggtggcggtattgacccaatcttactttcacgtgaggttgacatggcgcttacgtggcattatagttttaaaaatatgtgtgcgacccaattgcattaacacaaaaaaaaaggtgggccccactaacatgtgggcccacatgttagcctctctctgttcccttcccttattcctcctcctccctctctctctctttctatcagcgcactcttccccctcggccattgaagggcggcgtcaggtgagaggacaggcgatggcgccctgtgtcaacaagcagtggcgcgtcgtcgtgcaggcggagccacgcccctaccacttggatgtcgctgccatcgctccggccgtcgcggagtttcggtgcaccagcttctaccgcctcagagcatgtggtagcaacttggcttcggcgttgatgatgcccacaccttcaccgccaattcgcccaaccccaccacccgcgccctcctccacctcactatgcctccccctctgactccacctcctccgccaccgctcatctcatccatcccccgccgctgatccccaccgttgtccccactaccagatgccaccgccgccgctcatctcatccgtcccccaccgctgatccccaccgttgtgcccaccgcccgatgctgctgccgccgctccgactgtcgtggagttccggcacaccggcttctcctgcctcggagcatgcggcagtggcttggcgtcgacgtcgacgacgcccgcacctccacggcccactcccatcttcccgtcgcccatccccaccacccgcgccctcctccacctcactctgcctccccttccgacttcgcctcctcttccgccactcatctcattcatcccccaccgctaccgtcaagtgcgacgacggcgtgtcactctctaccgagaaagagaaagagaggaaggaagaagaaatagatggaggctgacatgtggggcccacatgtcagcgggctccataattttttttgtgtgaatgacaaatgagtcctacatacatgtttttaactctaatgccgcctaagcgccacatcaacgttatagaccaggtcaacactgccatgtggacgccacgtcaacgaaaccaccatccaaaaccaccgagggagtcaaattacaccggttttatgggccgcgatatccggtattgcagttcaaggatacaaatcagattcggacgccagttaagggagtcaaagtgaacttattccacacaaaaaaaaatcagctcagactgctagaccttgggcgaatgggccaataaggcaataacacactttccaggcaacacagacatcgcaaagagtccccagttcccgcacaacacaggagctgcctgctaaatactacctctgtcatatccaacgttgaccatccgtcttatttgaaaaatttatgaaaaaattaaaaaaagttagtcacttataaaatattattcatgttttatcatctaataataataaatgtactaatcattaaaaaattttgcggaaaattggtagtgtcaggattagagccggactcccaatcttctggaaatccagggctgcaggaa

SEQ ID NO: 41735 - DNA, 30438 bp, Oryza sativa
acgaaaaaaaaacgcgtctttacccttaaaaagagcaagagacaataaacactcattttgcaaggattgatagatccgaactaatcaaacactcatttgcaaggatcggagtatctttctgtgatttgattgctgaggtagagtagacttagggggtatttgggagacaggggctaaactttagcccctctctcaaaaccataagtccctaggagcttagcccctctattctaaatacccccttacccaaggcacccaagacggaggaagaggagaaatcggtggagtagctcgggagggtggagagatggggagaggaagaggataaatcagtggagtaagctctttcagtctctcttgctcctgtaatcctgtccggagaggcggagaggcggacgacaatggaattttttttattttccattttttttattaaaagttttacaaaaataattttccatttttaaaaatcgccatcccagagggcggcgaaaatgacgtggcagacggccgttcgctctcgggcgacggccgtcaacgaaatttgcaggcggcccccttgccgccctccgctagggcgattatgtactgtgcggggggccgcctgcaaatgggcggcgagggggcatggaattttgcaggcggcccccttgccgccctgggggagggcgatttttgcctcccccctataaagcacagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagtatatctgtagcacacaacacatatgtgtagatccagagcatagaatataatagtatgaattgagacatagacagtagtgttaattgtaagatgtagtttagtttgatctggagaatataacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcaatcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgatataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcgaggcaggagattcttccaatgcgcgaactttgatcaggtatgcttcatctattcgaagttcaaatggataaaaaaaactaacttcttcgtacacaattgtaacatcttacgcagacatatcgtccaatgtgcaacttcatcgagtgggtagacatggagaacccacaaaacgatggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaagtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatgatccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtacagtgtatcgatggcacttcttatctatcttatcattacaatgtttaattatggtggtgatttttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattatattttaccagtcttggagattttaatcttgtatagttttcaatataaaaagatttgataactattgatatttatacaaaaatataaagcacaatataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggtcgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcgacgacaatgtgctctggttatgtgggcttgtttacaactgggccagcgtgggagaaacggaggcctttaacgtagcagcgcggatcttatggcatctgaaatttgccacattgctttctgttcaaagacagacagaactcagtacaagtgttgaggaagaaatggtcgccgcctgatacagatgttctgaaactcaacattgatggagctttccgtgcttcagagaagactgggggtttttggcttcttggttcgagatcatctgggatgtggagttcttgcggaagctgcacgtctgacttatgtacatgatgctatttcagttgaagcggaggcttgcctggcagcccttccagctgttgtagcgcatggtatcacatctatcctggtggaatctgatttatctgtgctaatttcggctcttcagactaatgagtatgcctctgctcctggtgggtccatcttcagggagatcaaagtccttgttcaggtagattttgccaatgttgagtctgtttttgctcctcgtgcttgtagtacggcggcccatgaactagcccaacgtggtgtgaattgacacccgggtcatgcaatggtgtggactgaccccctccctgattttgtacaaattctagtggattgtgataccactgatccagcttggtaataaaatgtcagtgttgaagatcaaaaaagatgatcgatcgacctttacccctcctcctgttccaacttccaacccatcctcgcatgagacagtgcaggccgacgcgaggagattcgccgggttcatccaaccagcacgtgagacgccggtgtttgctggaactttccgtcgccgtgaagcacacgcgtgtcgattcgcgtcgatccgcccgctgccgaagcgacgtccggtcgctgcggcgcgcgattcgctcggtagtcactcacaagatcagagctgttgcggtgcggagcttttgcttggaccaaagataaaaaggcaaaatcttctcttgctctaaacggtactccactcgggaaaacttaaatcatccctataagagatatccctttatttttcatgttacttaaaaagtcatcaaaaaaattataaaaaatagtagaatagatcaatatgtgatatgttactttacaaacatgcaaattcaaattcaacttatacaagtagaaacaaaaaataacaaatttgactatgaagtgaacgcgtaattcacggtcaaatttattatttttgttttgaattgtataactcgaattttgactcacatgtttgcgaaaagatatatcatatattgatctatcttgataaattttaaaaatatttgataattttataaatgacatgcacaaaatgaggggatgtctcctcgaggaaaaaaaatccgcttccactccactcaatcttgtagctaggagttgacgaaaagctcgtaactcgttaactcggctcataacaagctcggttcaactcagctcggcttgtttcattttcctaacgagtcgagctggtattttagctcgttagaaataacgagccaactcgagctggatcgcgagccgtcgagcctaaacgagctaggatgacatcaagtcggatggccaacatggacatcctttcggcccaactaggcccatctcggccatgatacaacggtgttatcatatgatgcgcgtggccagcctaactctcgttatctcatatacataaaccgatagatggataaaacaaaagacaacaacaagaaaaagagaaaaaaatggaaacgtagaggagatcgagacgactccggcgaggagctcgctacagctaatttcgctggcccggaagggtgggggcacctcgaaggggaggaggagcccgacctcacggaggcagaagtcggtagcgccgtgccgggtcgtggcggtaggggcggtcaggggcggagctagagcgaaacaacgggtggcactactaggaaaagcattatcgcaagcggccgaaaagggtcttcgcagcggggcgcccgtccgcctgtaagccaacgactgtgaatatcgccgatcttcgcaggcggggcgcccgtccgcctgcgaagataattttcacaggcgtacgttggctagtccggtccgcctgtgaaaataggaatcgtccgcttgcaaaaaaaaaaaaaaaacttccgcctgcaaagataggtagaaaatattgaaatttaattataatttggccgtaaattacttttaaattatttaatagaaattcttgcaggtagatttttatgtacatatattggaagattatcaagcatttggtactgagaaatctacatatattgcataaatcaaaagtgttgccaaaatatatatattacaatatttttttacattgtcacttcaaataacgtcatctagttacattatggcatagcagtgttccactcccgaagatccttgaattcgtcacttgccgctaggacaccctctgggtcgaagaaatctcttttgacatgacaacactcgtggtggatgaagtggcacagatcacgctgcacatttgtgatacctgtatcgtcaaaacttgttcgacattctaatcttggcaactgcatgcattaaaattaatcaatatattagtatcataaatatcaagagctgtctagtacatagcatagagacttacatcctccgcgttagtcctgtatcgtccattaaccctaaggaattagcacgcataatacccgcaaaggaccgttcatcgcggttgcttgtgacacttcaggacatatcatagaaaaaagtagttaaaatttgcaattagtgaaacaattggaatacataaagtgagtggagtattaccagccaataggtacgtactagcagcttctcccgtgtttgggtctgttctccacccttgaacttgtagtattggtatgcactgtatggatgtcgtaccgtttcagagtaaggaggatatttatttgtaatacattcatatacaaatgcaagagtcataataacttactactgtaagattgttagaaattctttgtattgcttgtgattgtaatcgagaggatccaagactaccacgattccgtctttagggtggatgagtaaacagatataatgatcgctacatattaacaacattatagttagttagtaacagctaaaataagacatatgtgtacaagataaatgtaccggacttacttaaaatgataagcggccatgacgactctcttattttgaaagtgcaagaaggctcgtccaatgtactgtgcgacagtaatcaatttctccttgtgcaagcccttcttgtattctgctatctcttttggattcttacccttcagctggtctgaccctggtgctagcgtcacggtatgctgtgtttggcagatccgagttggatccaagaagtcgatgggttcttttttcttcttagcatccatgtattgcatcctatagaagaagtttgttagtaacaatcacatggatttgtattgtacatatttttcatctaattaattaaaactcatactcacatgcaccaaacaccgacgtagttgacatccatcttatcccgacgatatatggcgtagagatatgagaaatctagccatacgtaaccttcttcgccgaaacaatctgccggtgatcgagctgttatattgcccaagcctttcttgctggcctccatgtagaagttatgtaaccttctcatctcccatggtgcttctttcagtgcccattccggcaagagtgctttcccatgttcgtacttttccgggcaatcatcggttgcgaagtatgttggcccggctagttcagaagccttctgggggtcgtcatctctgagcttggcacgttccttaccccctctgaagacggttagcatgaacttctccttgctcgcatctttggacttggagtcgtggctcctaagcactcgtggcacctcggggtctttcgcaggagaagggtcttcaaatatctctggctctgtaccgtcccattccaatcctggtacttcttctttgtctgacccgaccgatgccacaaattccacctctggttctgccactgtaatctccatgggcacatccggcactgaaatctccatggctgtctccggcggtgcaatctccatggctgcctccggcaatgcaatatccggtggcacttccagcactggattttccttttgcatctctagatcatccgccttatcagtcaccttcctcttaggaggcctcggaggttttcccaaccccggtttaggcaacacaggtttttccccagcgtcagtgcccaatccaaaggatatgtcattcttgtgccagagaattacaagatcgaccgcatccccaagtacggatacaccatctgcagtcgggtagtcaatgttgtccacattttaaatactcaaattagtacaaactaattagtacaaaaataaactgtgtattaacaatatatcgtatgaacaaatttaaattctctgagatttccaaatttaactagtacttactattatgctaaattaattagtacaaacaaatttaaatagcgaaactaatgactacttactattatgctaaattaattactaaaaaacaaatttgtacaaaatttgatatgttattatcaagtagtgcactaattgacttacttatttcatcgacatgttgactaaaaaaaatggaaaaggcaaacatatcctctacatttttttaaaaaaaattgttaacataccctccaacatgttatctaaaaaatttgacaaattcacatatcctgcaaaattgaacataccctcccaatttcattcacatatcacccacattcccaaattcacattcacaatcaacatataaccccttattcacatatcacccacccctcatgcccattcacacccacatgcacacacatatataccccctcacacccacatgcacacacatataaaaggaaacacccacatgcacgcacgtccgtgttggacgaacggccggtgacgagcttcggtcgtggacgacgaaggaagggctggcgacgaggttcggccgtggacgacgaccggcgtcggccgtggacgacgaacggccgacgacgaggttcggccgtggacgacgaccggccgaagacgtcgttcggccgaggaagtcttcgctcgtggacgacgatcggccgatgaagccgttcggccgcgagcggaggggtggccgacagcggtggaggggccgacggccggcgccggtggaggggtggccgacggcggtggaggggctggcggcggtggaggggccaccgacggccgcgctcgcggtggaggagccggtggcggtggcagagaccggtggcggtggaggagcctgtggcggtggatgagccggcggcggtggaggagccggcggcggtggagcgggcgcgcggtggaggggtcggcggcggcggtggcagagagctcgacgacggtcggcggcggccgaggacgtcggtctcggtggtggacgacgacggttggcggcggcggaggacgacgatcggagagcgaaggtcacaggcggggcggcggtggaggacggcggaggcgtgcggcggtgaaaaatttcggcagcctgacggcgccaaaatttctagggttcccgcctggacttagaaattttggcgctgcgggcttgcccttatatagggcaaagatcttcgtaggcgggcggtccgcctgcgaagatcatcttcgcacgcgggcggtccgcctgcgaagatcatctttgcaagcaggcgatccgcctgcgaagatctttttttactatcttcgcaagcgggcggtccgcctgcgaagctcttttttactatcttcgcaagcggatcgtccgcctgcgaagatctttttaacaaactggtaattgcacataaaaataattacacttttcaaatattactaattttaaattttttaactaaatttttacacttcaaatggtaattgcacataaaaattagtatgaactaattaatatgcaaaatgttgagtacaattgttcatcaatttgcgatatgatcacacatcaccttacatacgaccattacataactaattacttcttagatgcttacatgccactccacaatcattaccctttaacatttttgcccacactgtccgtgcgcatgtacggcttcacggtcttctgagtagatgtctcgacattcttaatcttctatacaaactgactataaagtggcatactatcgtattggttgtaatcttcgacatcttcaactccatccactcccaatatcttttgtttccctggtagcactatatctttcttcaaatttgaagggtctttcacataaaacacttgtgccacgcgattggcgagtacccaagggtcatccttgtgacccatactcgcaaggtcaacaaaagtaagaccgaacttatcaacattgaccccgttcgggtattttacccactggcacttaaatatggggaattgcattgtgtgcccatagtcgatttcccatatttcttcaataaacccgaagtatgattgtttttccccggcttcatcaattgtctccacacggacactgctgttttgcatacaggtcttattatctcgggctcttgtgctaaacgaatatccattaatgtcatatccctgccaagaatttactgtagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgagcttcttggaatgatttgtgatcatgggtgacgaatctcttctttcctatcgttcccctgccctcaatctgccctcgtgtcggggcacaggtactccaattgcatatccatctttgaggtaatcgataaaacactcgacaacctcttcagtactataaccctcaaccattgatccctctggatgtgcacgatttcggacgtaacccttcagaaccgccatgtaacgctcgtatgaccacatttgatggaggtacaatgggccaagcgcaaccatctacggcacaatgtgaacaatgaggtgctccatcatatcaaaaaatgacggagggaaacacatctcaagttggcactgggtctcatgtgcgaatgtacggagatttcctaactcttcgagactaatgaccttctatgacactgcgttgaaaaagtagcacaaccttgtgatagcaacctttaaatgctcgcccttcttcatgccagcgcattagttccgcatctcgcgggtttgagtatatttgtttaatgcggtctttgacaggaaggtaccacattacaagctgcgggatttttctctgtcgtccctcaattgcttcagagggttctaggccagtattgctatttgacttgtaccggcttgcaccgcatgttggacattcatccaaagaagcgtactctttcctgtacagtatgcagtgatttacgcacgcatgaatcttttccacaccaagtaaaagggggcatatgagtttctttgcttgatatgtgctggatggtagtgagttaggcctcggtagcattttctgcagaagttctaacagactgtcgaaactggtatcagaccatccatgtctcacctttaacttcataagttcaagaactgaccggagtgttgtgaactcactgtcacagcccttcgactcatcgtacaaaacttcctttgctgccttctgtaaagcttcaaagttatttagccctctagccaaccccatcagcacctcgagttctgcatgacgtaacatttcctctaggtcgattttgtcctcaacagaaccatcgttatgcaccatgtcttcaacttgtgtcggaactacattttcaggcccgtccacttgttcttcgccatgaagtgtccatatttcgtacttgtccataaatccacgagttactaagtgctcattcactttaaaagcatcgtcaaagtcccaggctatttcattcttacagtcagcacatggacaaattatcttcctcatattgttcttctcagcgtgaaccttggcaataccaataaatttagccacttcgtttctatatggagacaaaaacctcggccaatgatacatccattcccgactttccatatctctaaaagttacacgtaaaatatttgcacaattaataccaaatttgtagggttcattgaaaaacttatcgctattcaaaactaattaactaaaggttaagtgtaaagtaataaaaaatcatagtttatttcaattttttttacacagacatgccaaattagtacattaggaaaatctaacaaaatcaaatcatcggcatattacaaaatactataactattttttgattgcaccgaataaatagacatttaaaattttattctctctctatacatgacaagatctagatctagatctagaactaggtggtggatatgatagcaaaaataaaaaaaaaatgagaatttatgttaccatattaaaccactacaacaagaggcatcaagtattacacatacatctaacatcaacatatgaaaagaaataaaattaaaaaacatggagctcttccttcacaattttggatgcatcgagctattttgccgtaggacctcccctacagtatcgtcaccgcagtagagtttaaccaccaaattcgggatggattggtgaatagacaagtaggacagtgctaccagctagttaactcagttcattcttgactttcggcttgtagctttgctacgcaacctcgcattcgaaattagcactatgaccgtcggtgaaaaagaatcaaagagaatggtccatgaattggctgggtttatcaaaagcactgcaatggatggcagagggtccatagtacccgaagcactagagtgatccagtagctgggaagggcgattttctattcactcatgatcggccctgacctagtcgacgtttataaaaagaacatcacctccctttttggttagataccgctccgttaggtactaatgcttctacctatcacccatccatcacaaattaaggtctaaaagcttaaaaaaaatgcatacctagtgtgaaatgagtagatctaagtaccgtagaaaaattccccgaagatttgaagttcaaaacctccccctatatttaagtcactttaggagagagaaacgtcagggagaatgaacagggctcggggaggaagaagactatataggggcatttttgcaggcgggccatataagcgtcgcctgcgaagatctatcttcgcaggcgcacgacgtctgccgcttgcgaagatcaatcttcgcaggcgacgcttatatggaccgcctgcaaagatcaatcttcgcaggcggaccgccccctccaccccgggtactttttttgccggcggggttttggctctgaattacatgcccgcctgcgaaaatcgatcccctacgacgccgaaaatgagttttctagtagtgtggtgtcccttgcttaatttactctattttagatcgagtttaagctaatacgagtgtctaagtttgtattgagggggtgcatacatggtgaaaatagatgaggtatagctaaaaaaatttcttgactgggttcctgggcacccccctaatatatactagctccgcccctagtggcggtggtcaacgtcgggtgctttcaccggcggtgcatgctggcgagtgaaggtgcaactataaggggaatccagcggcaggcgacgatggagataaaggtgcggtgggagacgttcctcgagctttgtccagcctctcttcgctggacgtcgtctctcactctcgtcgccaccatctcccatcggcgccgccgtatggggtcgtgggctcactacgcgccgccactagagctcgccgtcatctagctggcaaccgtagaagcaccagcaccaggtcaaaacaagctcttcttgcccgtctccaagtcgaattgttcccaactccaacgccaagccgctaataccgtcgtgctagccatcttctctccatctactactttgatttgctagctgagccaaacaagttggctcgagctttcaaatgagacgagcctcatcagctcattatcctaacgatttagaccgaactgagccggggtgactcgctatccacccctacttgcagccacacgagaaaatattgttggccaaccggtcagccatgtggagatcaaaaccaagctaattactgctgctgctgcatgctgaatgcagtaagatgtactccgttgtctcctacgtaataatacatctacatactagagtatagtaatacgttgaaaaatataggaacatttatagtactaaactagtcttattaaatttagcattaaaatatattttaatagttgatttgttttatattgaaactatttttatatttttctataaacttaaacgaagccaaaataattaattttaaaataaaactatgaaacggaggtcgtattacacatgcggcacaggacaaattcaacagcgacaagagaacgaagcggacaggagggagctgcaagcctgcgtcgtgcggcaacagtggagaatccgggcgtgtcgtgccaatccggtttggcagcggctgcgctgcagggagatgtgcacactgtagcagcgtcgtgcagcggtggacggcgaaggaatcctgacaggtgccaaaaccctccttagatccgggggacccccacccaccatacacgcatgcgacccactggcacgcggacgggtaggaataggatgtggtagcatccgaggaacaggggcagtttcgtctcgccggcgttgtatttccacatcaacgtgatatgagtaggcttgctgctacggtacgaagcatgggtgatggcctgatggctacacgactgcgtcggtgactcggtgtggctctagatcgagtcggtacggtattggtttgttgactcgtactctcgtactggtcattgggcggtacacgtgtatctttatctgaaccgataatggtgctatccataacgatcaacggtgccttcacaaaatcacaagcgaatgattttactgccttgctagaacttccaaagatacccgcttcagaaaggctttcaccgtctccactccaccaaacagaaacacagaatgcataatgtgtgattacgatcaggcagagtggtacacaggtactgtagtctgtaccctgtacctattaccaccattttaagcgaacaccatcaaactcataaataacctgccactcactcgctgcacactagtccttcagtttcagtcccctcgcatcgccataaccacctcgcccaaatcgaagcacactagagagccacaagacccctcctcccgacacaaacaaccaaccacactacccttcgcgctggtctcgaccaccggagatggccgcctagctagtgtgccggtggcagctggaaggcatgggctgctgcttcagcaagaagcgcaggaagcagctggccagtgcagctgtgttctcccgccgctgcaagccgccggccgaggcccgcgacccgccgcccccgccgccgttgccggaggaggagaaggtcaaggaggtgctctccgagaccccgagcgctaaggtcagggccgaggcgaagcccgtcgccaatgtggctgtcttggaggagccggaggcggagaagcaggcgccgaagcctagcgccgatgcggatgtcacggtgagcgatcttggtagctgcatgtcgctcgccaccgacgataggtccgaggcggcgtccgagtcgtccgtcgcgaccagctcggtgaccgggccagagcggtcgccggggaagccggccaggaggaagcgcccggtgtccgtctccggcgagctggcccatgccatttcccggcgcgaccgcgccgccgccgccgcctacggcgtccgctcccgcagcgcccgggcctcggcgtcccctccgccgcggcgcgagcaacgggaccgctcagtgcggaggtcgccgtcgccggcagcgaagcgtacaccggagcagcgccgcgccgcgagcccagccccgtccctccagcggaagccgcccgtcccggtgaggccgtcgccgcggcgggtgcaggaagcgcctccttctccgctcgagcccccgcctccaccacctccgcagccagaagaggacgccatgaccgccgacggcgagcccagcattgcggacgccgccagcgccggcggcgacggcgaggggaaggagtcgctggacaacccgctggtgtccttggaatgcttcatcttcctctagtggcgctgcactaccgccgtcgtgtcctccttcgtcaggtggcatcgcgctattttcctttgaaaatgttgcgctaatcttgtttagtttagatgttctgtgttaagctggtgtggtaattagtgggtaaactacttgtggtggtgtaatgctactgtcatattccggttattaacctatgtcgggtggaatgacagcagctttgacttttggcgtaggatgggccctccgattggaattggacggcgcttgaacgttggatgtttctttttggcttttggactagccctcgctgtattttgtagagctctttttcactaatcgtcaattcgtcatgtctaacctctgttcccatgtggagtctaccaacaatgtgcacgccatcacatggcgacctcacattttctgacttgttcggtgcgtgagtcatcggatactttcactttcgccccctgcccatgctgcgccatcgaacaatgtttccgtcagggacatccatccatgcatgcagcttttctgatctcatccccagattcagcacaggatcagatctgccaaaggagcccgtcaacctaggcaaacagatctagcgcccgggatgtgtgcgctggtgttaaacaaaccgccaatgctccgcttaaaattctcatcaaggtgacatgcggcgcatcatggcgctgcacgaggccgcgcgggtcgacagttctcgggatcgcgccttggttttggttcgcccgtagcgcgcaccgtcctgtcgactcggagcagagctgcgctgcgggcctgcggctgcacccgcttgctctcgtccccgtcgtcgttatgctgatctgcgttgcgcgcttgtctcccgtgtaaagatttcgcgccgcatgcgagctcacgggagcaacgtctgtgttggactgatggttgttggttccggtatcaacatctgactgctgttcggatgttcggtggtacgagacctgaaggatggcacagcacatggatgcggttggttgaagccaaaccccattcatgctgtctgtaggcccacgggaattcatcgagcaagtcaagattatctgaatttcttcatggcaaacccgtggtttcctgtaggacagttagcagaatttggcactagtatttgctagtactgtcgcatgctggcagcgaccagaatgatgaacagtggtgctaacacagggtggatttctaatcatcggcgaggactgtcccagtgcgtgcgtgattgattggtctctacctagctgtagcccgtaagagccgagcagaaccggttcaatacatactggccatactgctacgtgggtctgtttgtcatgtgggccacactgtcccgtattagtgtctcacgtaatccaagcttacaaatcaggattccttgtattgcggccgggagaatggagatattattatctccatcctgcttggacctgcggattctagatgtagaacctttcgtcctgagttctgactttttcatcgaaaggggcggaacgttgtcctacttcgccgtctggtttgataaaatacggtgaaattcatgctcgcggcggctagtgccttcacttcagccgtttgtccacggcaagcgtccaacctgtagcctcgtacgatagaggccgtgaatccgttatataaagaggacgcttaattttggggcctcccttaaactgccctgggctgtaacgtcttcttaaatgggctgggttattaattcaagaaaaaagtttacttaaggtccctcaagttgtcgttgaattccaaaatgtccctgaatcagaataacagacataacacattcctaatcttgcaaaatcagatcatattgatcctaggatagtattgctcccagttttgactgacgtggcggctgagtcaacgtgggacccacatggcccccgattttccacctttctctcatctccccatctcgatccaggcctccaacctggaagggggggggggggggataatggggagaggtttgacagtgcgacttacgggagaagaggtgtggtcggcctcctggtctagggctacacccgtgctgtgtgtgccgcctcgcgcatcatgctccctgtggtctcagcgtccctactcgtccgcctcgactaccaacacgtctccacctggtgtgtgtgtcctcccagatttccattgctcttcaccaaagcctcgccatcatcctctctcccgcgacggcaaagcactgcatcgtcatcgggcacaactggtttgccttctacgacgacgaggttgcccgcctcgtgaatgccctcaccgtcgaggagattcccttccattcgttcctcggaaagaatgtggtagtgttgaaggtcgtgttcacgccaaacctgatgccgagcggcttcactgtggcggccatcaccaaccacggttgagtcacttacacgactagtgggaacatcggatgaacctatgtcgagtgttcgcatcttggggatctcagctacggacactactaactcatgggaggcggcaaattgcatgtccttcgcctcaccgtcggctatcgttcccagtgaaaactggcatccttcgaccactgtttgacaagcctagcaatgtgttctatccggtggaataagattgggttgctgacacatagggctagcgtgggttccacgctgaatcaacagtcacgtcagttaaaaccagaagcaatattgtcttgggacataatgtggcccggttttgtacgattagaaatgtgctatatttggtattccggttcaaggacgattttgaaactcaacaacgaggagggatgtgaagtaaactttttccttaattcacaaacccaaagagagggttgggctgtaactcataaaactgaagattgggttgggctgtaagcctgaaactcacaaactgaaatggagatgggccatggccatatgactttttttcggttttagattttttaaaaaaatatttacagaaataatctatcggccaaaaaaattataaaaatagaccctgccacccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggtcgggcggcaggcctcgctgcctataaaaggcctgctgcctagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagatgagtgtaccttctataaaatgatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaatgcgggtggcctctagctttggttccgtttgttcacgcgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtagatgaaatggagaaggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctagtgttcagaaataccacaggaatattacttgtgcatttgttgcatctgagatgtatgcgcatgtcatcgataatctcacatatgaaccaaggtcaataatccgacacatcgaagagacatataagtatactattagctatgccaaggcctggagggccaaacaaaaaataatagagatgagatttggaacttacgaagcctcgtatgacaatttgtcacgcctgcttggtgttatcgaggaaagaaaccctgggagctcttacgaagtgaagaaattccccttaattgaacatcctagcaagagtgtgctgtaaagggcgttcttagctctacatgcatgcaagatggcattcgtgaactctcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgatagttgttggtatgacttaatcgtcctctcgagctcctcggggaaccgttggagagtcccggctatctccgagaggcgctgggcgaggcccccttggttggcggcgtacttcgcagtccgcccgccccagaggcccacttgccggccggcgcggtctagacgggagacggcgtcccgaagcatgctgggccctacctcgcctgccaagcggagggcctcgacctccccggcggacgagtctagcgcgccctgcagatcggcgatggtgtgttcggcagctgcgaggcgagcggttaagtcgctttcgcccgcggccgccccgccaatctgtgccctcgcgtccagctccttctcccgcgcctcgagcacagcggcccgctggttcagcgcggccctctcggcgcgggcatcttccagattacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggttcccctccacggcgcaggcacgctcttccagcgccatggcacgggcctcaagggcttcgtcgcgtcgccgggatgccacctcggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcggcccacttccaccatggcctccaccgagcgtcgcccctcttcgacacgcactcatgcggcgtcgagctctgcccgctctgcttgcagggcctccacctgggcacttaacccgtccaacaccgtcgtgtttgcgacggccaaggcctgcagaaggggttctgcgctcagtggagcaacagaaggcgtggggaagagccgtctcggtgaggatgccgcgcggctcggcccgccgatggacgtgccggactctgggatatcccccggacctagcttgtcctgagcgtcgcccgagggattgggcccaagcgatgcgcccgcggcctcgtcgcaagctgcctcagaagttgtcgccgcctcggcctggcgaagtctggcctcttcccgagcggcttcttcagcttggcgagcttggacggccacctgaacagcttcctcggcttctcgaaggcgatccgcggcctcttgccggtcagtttcacgggtcgcctcggaggatgtcgtcgcttcggcctggcggagtccggcctcctcccgaacggcttcctcggtctggcgagccagggcggcctcccgagcggcctcctcggcttcccgaaggcggtctgcggcttctcgccggtcagattcccgccttcgggcctctgtggtcgccgggtcctcggcctcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagataggggaggggttccttcctgcttcctcttcccccgggcgtcggcagggtggccgctccccgggcccccgtcgcgaggcccagaagcacgaccccctcccggggtagatcgttcccccctgcggctcccacccgcgccatcgtggcctcgaggagcccgctcctccgacgccccgaccgcctgcatgatggtcaagatggaggcacggtctggatcactgcagagggggaggactccttgaggaatgagggatgcctccacggagctgagattcagcacccgttggaccactatcttgaagtcctcaggagcccagtcccatcggaccccctggtgggtcctcatacagtcctcggacccggtgtactcccaggcgtcccgggcgcgccgctggagtggcgcgatccggcgacgaagatagtcgccgaataccatggcccctgtgagcccctgagatcgcatgcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaccgaaacagccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccttcgcccagcgagactatctcctggccggtcgcagattccggcatgaagcggcgcagcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacatgaaacaaggagttagggcgcaagcggcgaagacaaggggaataatggcgagagaaaggaagcaaatctcttcctcggcgactttatacccttgccaacgctgtgcccggctcctcgtttctcgcgcccactatcttgccccctcgattctcgcgcccactcttccacttatcccattcgcccgtttacggtgcatgaggtggatatgcggctgtggcagtcgagatggaacatctcgtgcgcgcgttaattacgctcgccgaccgaagcgccatcaccatatctccaggcaaaacgaaccggcacgtcccgattcgcgcgtaatgtggcagtcttgaagagaccgttcattattgacagccgagtaaccattgccgatgtgcgtgatttgcgactgttgggtttctgcccaactgtggaaaccggtcccacctgtcaccaggccttaggaagtggcgtcacgcccgaccgcttccctcgaggagggtaatcgcctcggcataacgccgggggctactgtcgatgacatgggaccgggagtatcgtgactagaggcttgaggtagacacaatcgcccacgtggcctggcaccctcggggggggggggcgtcgggcccgagggtggtgtgttcgccctcctctttgtctccccgagggggtcggaccgctcccgccttggccccgagggctggggcgccccgaccccttgtggattttgcgccgcgtgtatgggtttggtgagcacagtggcgctcacctaactgcatttattgcggtttggacgaacgcgtcacgccgcgtgtaacgcagtgcagcgcgctcgtttatccggtctgtgaccagtcacagaccggtcagatcgtgggtcaggtggcgacaggcggtctgacgcacgcctcgccccgtccagtcaggacgagagtctccaagcactcgtccctagccggagccggcgtgttagctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggcggaagtggaggtaggtatgggctgtcccgtcagaaggtgattcggatggcagcgatgcaaatctccgtccattaatgaagagaagtcaagttgaaagaaagggagggagagatggtgcatgtgggatccccttgagatataaaaggaggaccttgcccacttagaaaagaggaggaggaaaaaacgatcccaggagaatcgggggctgacttgcactttgtagcttcttcatacgcgaatccgccaaaacacaggagtagggtattacgcttctcagcggcccgaacctgtatacatcgcccgtgtcttgtgtgtttccagtctggcgaaccttccacagattgggagcttagaacctcacccagggtccccggccgaactggcaaaggggggcctgcgcggtctcctggtgaggagcccctcgctccgtcagcgagcgatagaagagttgcagtttgggagtatgaaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttcgacctctcccaatggatagtccaacattggttagaagaactggattggagattcggaaattttctcagtggattctgcatgaaccaaaagagaaatgggccaaggcgtatgacacaggtggtgctagatatggaataatgacaacaaatttggcagaaatttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacgacacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagtttacagagactaacgatgaagtactcaatattcctgacccatcgaagctccgaggcaaggctggaaggaggaggactcgtcgcatccgcaacgatatggacgagtcggaggctggcatggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtactattagtaacgtttgctatatttaaatagcctgtactcttgttgtacataattaatctcatgattttattactattttataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttgggacgttccgagcacgaacgtgcggtgagctactcacggttcacgactcctttgtcgagaggtacgaacagtgttttactataagttagttgcactgtaatattttttataatgacatattaatttgttattgcaggctatgtgaggccggcctcctaccgatgtgtcggctggtggaggctgcggccggcgacgcggacccggccagacgatggactgtggacaggtccctcctagcagctttggtcgatcgatggaggccagagacgcacacttttcacttgccgtgcggtgaggtagcccctaccctacaggacgtatcgtacttgttggggctaccgcttgcaggagacgctgttgggccagtgaccacggctgtggactggcaggacgatctgacggcacgtttcgcactagtacagcgcacaccgcacctcccgctcaagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctatggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctaggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcaatcaggcgtacctaccataccccaccacgttcacatgtcaggggtatcactcgattttttgcgcctatataagtcgccttaacgagtgagacctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatactgatattcgaggaaggcgcttttttaggtgccctaactatgaccgtgaggtattttattatctgcatatgcttattcatttcgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttttactgtcatgcttccttgtcccattactacatcgtcgttgtgttcaactattgcactacctccctcctagttcgaatctaatatcatctatgtaaccgcaatgcaaatagttatatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgg

SEQ ID NO: 41736 - DNA, 15266 bp, Oryza sativa
cagatgaaaaagtacggccgcaagctctttatgggcggccaaaattgtaattagccccttgccgccctctgtatgggcggcaagggcctaatcgcaattttgaccgacggcggcagacgacgcggtcgacccaccgtctgccacgtcagcttgccgcccaccattagggcggcaggggctatttctgtaatttttttggtcgatagattatttctgtaaatattaaaaaaaaaatctaaaaacgaaaaaaattcgatattttcatggaattgtaaataaagatgtccaagtcaagtcctgcataacgaaagctcagattcgttggaaacttcaccgagttaacaaaaactctgttatgctcgcagaactgcacaaagtgaaacgggggacgataattccagcgaaaacctctctcggtctctccccttatcgaggagagtagaagattacatgcgtgtactgtacaccatacaagctagtggcggttaaaaaaatcgattcgttggtattataatatatctatcagtgttatagtatgctgacggagcgtgaggctcctcaccgggagaccgcgcaggcccccctttgccgattcggccgggggcgctaagtgagattcttcgccctcgatctgaggaacgtcagcgagagaggaaatgcgcaagacacgggcgacgtagacaggttcgggccgctgagaagcgtaacaccctactcctgtgttctggtggatctgtgtgtgaaggaatacagagaggccgagagcgaaagagagttcaggctctagaaaccctttgccagagtcccaactcccctcctttcttctctcctctttcttttttcctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgttgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccagtcgcggaccggataagcgtgcgctgcgccgcattaaatgcggcgtggcgcgctcgtccaatcccgctataaatgcggttaggtgagccccgctgtgctcacctaacccacacgcgtggcgccaaaaccacagggggtcggggcgccccagccctcggggccgaaacgggagcggttcgacccctcggggagacagagggaggggtggccacgtcatcctcgggtccgacccccccgagggggtcaggccacgtgggtgaccgcggctacccaagcctctagtcacgataccctcggccccatgttaccgacatatgctaattataattagatcatgatgttataatatatggataaacaattttgttataggttttgccgaaaattatcggtgtcgtgataccggtccttctactgtgatccgcccctgatacaagcatacataggtgaatcgaggattccacgcgcgtggctgtgggagatgctttgactatgctcaccatgtcttctctcgatacggagaaaccagcaattttcctgtgtcggtgcatctttggctgtgtttagatctaaagtttggatccaaacttcagtccttttccatcatatcaaactgtcatacacatacaacttttcagtcacatcatcttcaatttcaaccaaaatctaaactttgcgctgaactaaacacaacatttaacatttattgcggacacttaacatatcgaacttatcgggaaatttggtgagtggcgactgattcggcccgcatcaacttcgacggcgatgttcttttttctttttccttctttacaaggttggcagccctgaaaagtattcgtgtccttgtgctttcgtcattaacgtcttcttcccctaggggagatggtttgttctggtcaggtcaacttccaaacctaaagggaaggggcatagcatatcactagtgtactcgtataactgtagtattatccagcaatctgttggtttcaagcttctagtaagaaacagtaacagaaaggggttcaaataggatcatcgcccggaaaagtcgttggtaacaaaaatcgtcctaaagatcatcaccacacagccaaatgccaatacactacacactcataaaactcttttgagtttcatagcactgctgcatctgacgcaggaaatttcgctacatatgcttcactgcatcatgtaacatgctgtcatgttaccgggacaccggcgcacctaccctccatactccatgacccatgtttcctcgtctttgacagtgcgagcctgcgtgatgtgcgaagtgtaaacactagacttttgcctctgcacggggtgctcctagtaaattcccggtcgccgtggcgtgaaatccgtgaggattctgagacaccaagcaacgctgcaaacggcctccaccgaatccgaaactcccccaacaacctaggaatcagaaccggcaacgtcaggtcgcacttcctatgcgcacttgcagccggcgcccagcaaaggggacgatgagaagacgagattttctttcacggttcaagctttcacaattttacttgttcacttcttcgtgattttactttggtcgtatgggaagtgaggcaaccattggccggatacttgggtggaatttacgaaacattactgttttctcttttgttttctgacggaaggcagtagtagagagttggagaattattatagaacagtggtcgatactgcttaactatggagtttcatgatctcacaatctcaacttttcttgtaactactttgtttgagaggccggagtgccggacacatatcctctcaagtctcaactaggcttaagcaagctttcataaaaccgttcaggctaagctatcaaggtttgccatttgccaacttgctactatacaatgtaaaaaacgaaaaacaaaatctatttgatctctttaaaatattgggacgtctagtcaaccatctcagactttaagggtgggaaatattttcttgggccgtgtttagttcacaccaaaactcccccaaactctcaactttccatcaaaactttcctatttacataaactcctaactttttttttccaaactaccaactttccccaaacttctccttaatttcagaaactaaacacagccctgatgtcacgtataacaagttttgattcaaatgaaagttttctaattaaggccttgtttagttcgcggaaagaaaatttttaggtatcacatcggatgtttgaccggatgtcggaaggggttttcggatacgaatgaaaaaactaatttcataactcgcctggaaaccacaagacgaatcttttgagcctaattaatctatcattagcacatgtgggctactgtagcacttatggctaatcatggactaattaggctcaaaagattcgtctcgcaatttacatgcaaactgtgcaattagtttttcattttatctatatttaatgatctgtacatgtatccaaatattcgatgtgacgtttttgggaaaaaaattaggaactaaacaatgcctaaattcgcatgagtccgggatagtagattgtaaaaaaaaaacccaaggctcatgagttactcgagctcaatttaagctcgcctcgagttctagttgagtagagctcgagcctatgccaaagctcacgagctttgtcaagctgagctcgagctcatgtcgagttttaccgttcatttaataaagtagtacatcatgtatgccatatatctgtatccatgcggtgaagtatcttgcgttggcacaatatatttatcttattatttttcatcaatcattagcatgattaaatataaataaattatttatttcaagagattatccttgaaatatactatgttgcgctacttataagccgactttgtaggaaagctcaagcttgaaccgagcatgtctaaaaactcgaaggttactcgggctcggtttgagcttgagcctagataggtaagcttgctcgagctcgacccgttgtcagcccaagttacaagcatacccttacacccaaatccataacatgactttcactgaagcaatgatatgcgcgtatcaatccgacaaacaccaaagacaacacacaaagggcccgtttcgtagagcttttaacttctattaactctaggagttggggtttggagcggagttgtggagcagcctaaacttagttccacatctctaaatcattttgtgagagtgctccacccagctatattcccattttaggtggagttgaaattgttcggctaagctccagctccagaataggtgaagctggagctgaagccgtgccaaactagcccaaaaccacaacgtcgcacaccaactttcgtgagagttttgcaggaaaatagtactaccttcgtttttttaatatgcaacactattgattttgaacacgcatttaacaatttatcttattgatgaaatatgagaaaaatacgtaattatcatttgttttatcgctagaagtactttagacatgatttatatagcttttgcttaattttttgaataaaatgaatgatcaaacgtgtttaaaaattaacggtgtaatcaacgcttctcctttttaccctaaaaaagtatctctttttcacgatttcaaccgtcagaaatgcgaaacccacagatttgcgggtgccttcggcaagaaggcgtttctcctcccgcacgggcccgtgtgcagcccgcacccgagattgggcggcccgctcccacccccgtccgtccgtccgtcggaagcccaagccaaccgcctcgcgactccaccgcgtctctgcacatgcccagcccccaccacgaaattacccaccccccatcgcgagagaaaaaaactactaaaaaaatatcgcgcataatcccaattcgactccgactcggccattccgtccccaaacccacgccgactcgctccgcttttttaaatcccccaacccggaacgaatttttccccttcgtttccaccaccaccccccaccaccacgacgcggatggcatcttcgtcgtcttcgtcctagcgcgcggcggccgccacgcgaccctgtttgagagggggaaaggggggttccgctcggctaggcggaggaaggacgcagccgcccctgtcccgcggcgaatttggatgatcgaggcccgccgtcgagggtaaggagtgatggaggaagcggcggcggcggcggcggatttcgatggcggcttcggcggcgccggggaggacaacctgtccatgcccctcggcgacttcatggccttcctcgataacgaggactggaaggagcagcagcacgaggtgcgttactactcgccgccttgccctaattcgatttacgcccgggtgtatttttttttcttctgtgtgcgtcggatccgattcggtgcgcggggttgttggggggctgggcttgcgtctgttctagggtttttgattgcatcggggccggatgcgtggatttctcgagaagtttctgccttcaattaagcgatttaggatgtttggaggctaggcactgtgttttcccccacgagtgttgtgtcttgtttaggcgcgaatgatacaagcgtgatcaagcttacatgcggttttggtccggctactcagtttgaacaggtattttttttgttgttgtttcggataagtggagctctgggtgcctgaagaagagctaaaatcaagtccgttatgcagtttcattaaatgttggttggtcaatgacaataatctgacgacagatcttcaacaatcatcggtcgctgaaatgacgcttgatgtacagaggctcggttgctggtttattgggtctcatgtttgattcactgcccttgccgtggtttatactatgagaaagtgtgttgatgatggcggctggaagcgagtttactggcagtcgtggcgttgggggttgtgatgtggtacatgtatgctgttttcagtggcgatgggctataaatggccatcaggctgttgggattggagaaggtcaaacaggaagcagcttggtagtgagttggaagtgtgtttgctgccaaatggatacaatgatatgtgggcttttcgtgttgtcttttctgctctcactgaacttcaggcccctgtacacatgttctgtatgtttaccggtgggcatagatatacatcatgcagctatgaggtatccttatggcctgttaagaacacaggagttcagtatatttttcacttgaaacagttcgatttcctcatgaattggaaaaattctagtgttgcaaacggccaccttttcccctgaatcctaacacatgtattttagcagtagaaaatattgaatttgttgtgagcatgcagatagctaatagtctgacctcacaatatttattatgatggtcgatcctggtaaatgctttgtttttatgtgtgcttgaatgcttttagttttgcatttgctatgcctcattactaaagagatgaatcgtaaaactgaagtcatttcattaatgaaatgggagagtagatcctttctttctcaaacaaagaaaactaaagagatgaatcaaactgattttatttactgtgttgtgattgttgtgaccttgaatactttgggtgagtgctggggaaatataaaatttcttgccgcgttcagttctgtggcaaaataattggctgataccataccaagtgaaattgaatcttcattttttgtgctttgtttgaggaagtgtttttttgggaggttttgtcttttaattgtattttcaagttgttggttgctaggtcttgtatttaccaaccttgggtagtaatgtactccctccgttccaaattagatgtcgttttgactttttgcttgcaacttttgaccatttcgtcttatttaaaacattagtgcaaatataggaaaggataagtcatatatttaaagtacttttgataacaaagcaagtcacaaacaaaataaataataattccatattcttttgaatagatgaatggtcaagcattacaaacaaaaactcaaaacgacaagtattttgggacggaggtagtacttgttatgctcggaatttgtcatatggtttgtggtcagtaaccagtaaaactctacatttagttccagcatatgccatcataggctgttaactatgtgtggctaactggatatgttcatagatgtccaagtttccttgagtacaataactgggattgcattttttttcgtgtagctgatgctaattcttgtgtttattgtaagataagtcagttccttgccaggaatatctacctacttagctttgttgcatctatatatcatgccccttgtttagtctattatcttgtgttcccttgacaaatgtgcatatttgtaactaaagagctattatgttgtttaatacagggcaatcaaggtttagagatgccagtggacagcacaagttctgaaaatgcatttcaaaaccatgaaggtaccagaagatgctcgttttattttggtttctgctagatacacacttttcttttccgtgtccatttttttaatttttaaattttattaaaatgagcagaaatttttgagaataaagaaaattggtcaaactactcgcatacagatccttcacatagtcagatggatgtaatggtggaacttaacaatggtggagaatcttttgatcactcagaggatacctcttatagattgcttagcaatggtgagaaacacaagaaaggcttcaatctggaaaaaaaacatttttattttattatgtattatatgattttaattttggttttgctccacagattttttggaaaattcaaggaatggtaatcctgagatgcatttaccaatggatgcattaaaccatgctaaaactgttgatgaagaaattgtccctccatatgaagattatacaaatggtttatactatggtcagcattctatgcactccgacaatacacaagttagagtagataacaactttgagggcttggagccacacactaatacttgtatggcggttccctgctttgtaatatacacatacgtgtgtgctttcttagcgttgtaatataaagaaggcactaattatttgatatctcctgcagattcgggatgtgatatgttcgcagagcaatctggtttaagtgaagttaaatgtgagggcacaggtcccatgcttggtaattctgagcaggagggtaaccatttcacgtcagtgcctatgtttgaccatagtgctgttatacctgatattccttacaccgagttgaacatcggtgatgtgcctggaagcatgcagaatggaaatggcagttgcctaactgtacaaggagaatatctgcagggggagtatcaggagtatcctcagccagattatggatcgtttgatatggctaatgaaatagtgctgcatgatttgccacaaaacaatcagtcatatgagctggaacaattaccacagaatatatgtgaaagcagttcaatgcaagtgggctctccagatcaatattgtgatgatacatctctgtcggattattacatggatgatgtatcttcgatagagtcgatgtccagcgagcagaaccgatcagaagatatctgtttccggagtgagtctagcactgactcttctccggtgccctcaagcagaaactccaccactgaggatgctgataaatactttggagatgcaccaaaacatttgcagaattccatgtttcctgtcagtacccaacaccaacactcattcatgaactcaagtgatccaatgcatccaacttttcataaaaagtatgacattcctagaaatggcagctcttctattctgggtaactcatcaaggaattgcttcagtttagatagcaatcgtgattctgatttatgtattcttgagggtagtagaagtcttgctagtggacatgtgttgccaccccaaggattgcagcataactttcaacaatctgtgtgtgccaatcctaatcttcctcggtttggagggagatacaggccgcatgaggaaagaatgactttgcggcttgcattacaggtaatttaccctttttactcttggcggcacttgctcattgaagtaccataaacaaacaaggtggttttttttaaaccttttttagtccctttttttgcctaacccaaaggaacaggcaactaaactgcttgaggtttgatttgttatcatgtttctggtcactaaaacagaggagaatgtatgattttcttatgaagatatttgccttatatattttctgtagttgtcttgcaaacagaagaccattttgtgttaactagcaaaatgtccatgcttttctatgggtaaaattcccattctttgcttttccaatgcttattacaatatatgttattcacttaaatcaaacaaatattaaattattgcatatatcagaaaatatcagggaataatttgtaaaacatgcaaaattagtagtggtgggctgcggcagaaccacctccaccactagagtatagataactgctggtgcttatgttttcaaccttttctgcactgtgatgctgttaaacattgatttttgaccttttgtctgcattggatataactggtgactttgtgaatgttatttcatgtgatatatatgtggcatttagttccctttttttgttagccttgtgttatgctgtatgtgttgatacttttttagccattacttgatgcacctcttgcatccagtttgcttgtaagtttttcttcaatgtacttaaccaattggatgatgggcaggatatttctcagccaaagtctgaggctaatccacctgatggagttttagcagttcctttattgaggcaccaggtacactttgaaaccaaagctgttactccctaagaaatagtacttcagccaacttctgatttcgatatatctttttgtcagaaaattgccttgtcatggatggtacaaaaggagagaaatggttcgagttgctctggcggaattcttgcagatgatcaggtatgctagtttacctcactccacagtccacacccaagcccacatgcaggattgagccaaaagggcaactgtcctaatttatgatctgatatttttcagggcctgggtaaaacagtgtcgactatatcactgattttgacagaaaggtcaccagttccatcttcagctgttaagcaagaaccatgcgaagctgtaacccttgacgatgacgatgaggatgacgatgctgagcctcatttgaagaaaccggcactagcacatctagcagatacatgtaaacctgaagcgacaagtagtaccattaagacagaaaatcctattgcaaatgttaaggctagaccagctgctgggactttggttgtttgccccacgagtgttctacgtcagtgggcagatgaactgaggaataaagtcaccagtaaagctaacttgacctttttagtatatcatggtagcaaccgcacaaaggatcctaatgatcttactaaatacgatgtcgtgttaaccacatattctatagtaagcatggaagtaccaaaacaatcaagtcctgatagtgatgatgaagagaaagggaagcctgacaggtatggtgctcctgttggctcctcaggcagcaaaaaacggaagacttcctcttctaagaagaacaaaagtggaagcacaccagagagtaaattgcctgagaaacctctcgcaaaagttgcatggtttagagttatccttgatgaagcacaaagtattaaaaattatcgaacccaggttgctagggcatgctggggtctgcgagccaaaagaagatggtgcttgtcagggacacctatacagaatgctgttgaggatctctatagctatttcagatttctcagatatgatccatatgctgaatacaaaaaattttgcttcatgataaaaacaccaatcagcaggaacccaattactgggtacaagaagcttcaggttgttctgaagacagtaatgctgaggaggacaaaaggtcagtaattgattatattttcttgttgtccatctcctgcatgtacatatctatgaactcaagtaattgttgagttctgattgtgcttaaactacaagacctgatagattcttttttttttttgcttggctagaatttccagaaataatttttgtttcaccaatttggagttacttcgttcttttgttaagttaaatgtataaatgtatctatgcccaaatagcatgccagagagtttgctaatgtcttacgtagcctgttgaaaagtgccttcttatggctgtctttagatcaagttcagccaaaaaaagaagaaatttctagcttatccaagactaaggtatagaactttgagttgtatttgattattggtgtcctctaaactttcatatgttctagcggtctcagtgctaacttctggtagtcctattaatataaatttcacatacaatgcttaatatacataagcacagcttgatgttaatcaggactgaactggcaagtacagccactttaaaaatatctatctttgcttgctctaatgatagccttggttgataatatggaggtataattgtgattcaacagtttggcacccttcaactcccaacacaccgacgtgtacaggggtacttttaaatgatattcattgacggaacatagtttatttagtctccttccttttctccacctactgtgcttaactgcccctctgttaatacacaataattggtgccaaaatatttatctgcttgtcatgtagactgtagaggggtacttttaaatgatattcattgatggaacatagtttatttagtctccttccttttctccacctactgtgcttaactgcccctctgttaatacacaataattggtgccaaaatatttatctgctcatcgtattatgttgttattatctcttatgacctgttgtattgcagcaacgatgcttgatggaaaaccaataatctcattacccccaaagaccgtctctcttaagacagtggacttcactagtgaagagcgtgctttctataacactctcgaagcagaatcacgagagcagttcaaggtgtgtttagaatgttaattaatagtctcctttatgagaccttctatttcttttttaaatatgctgctgcctttttcatttgtcaatggtttattaaatatttttacttgacaactaccttagctaataattaggagcacattgtgtaagaagtagagtgtttactttcaccatattatgcaacctacggactacagatacagaaccctacataccttgtataagaagtagagtgttactttgaattaatgaatcatcctactaaaagaaagctcttctaagttctaacatacatggtatttagacattgaacttattccattcatgattaaaccaaacctaataatgctaatatttaaatcacttgatattaagtgcttgcttatgcttttcattaatgaacttttaggaggctaactatgcttccttgtgcaaataaacaatctaattgcaggagtatgcagctgctggtactgtcaagcaaaactacgtcaatatcctgctgatgcttttacggctcagacaggcatgtgatcaccctcacttagttcgaggtcatgagtctacttctagttggatgtcttcattggagatggcaaagaagctgcctgtagaaaggcagcaatcgttgctggtttgcttgcaatcgtgttctgcgatatgtgctctctgcaatgtaagtgataaaagtgaatgtgctgcctttttaaaccacacctaatatgatatcgtttctaccttcattctttgctctaacccatgttttgtgttattgttgcactgtactttgatattatctatccagctgtggtgtggattgtggattgattattttcaaagttggaatgcattttttgagttttctcagtagcacatagactgccttaggttactatcagaacatgagattcttataataggatttataagtgcattgctggggattgatcgtgagcttcctttcctggatgcttatacaatttctaaatccatagctaagtaccaaattatatcttgtggttagcatacaacatgatattatgtttgcatggctatcagcggcttgattttagtgaagaaataattctttgttgttcatgcataccattttcctagcatccacttctgattcattgatccgtacaccataaattgtgcaggatgcgccagaagatgccgttgttactatatgtggtcatgttttctgcaaccagtgcatactggagcaacttaccggtgatgacagtgtatgtccagtgtccaattgccgagtccgactaaattcaacttccttattctcccgaggcacccttgaatgtgctctgagtagatcaacctgtgagtttctgtctgatgattcctgtgaagacatggtgcaagggaagcaacctagatttgattcgtcttatgcatcttccaaagtgagagctgccctggatattcttctctcgttgcctaaactggatttaacccatatgagtgatgacaaaaataaaattgtgcatcctgacaaaattaacgggaatagtactccctctgaatatgctggcaccaaaataactgagaaggccatcgttttctctcaatggactagaatgctggatttggtagaggttcatttgaaatcttctcatctatcttatcggaggcttgatggaacaatgtccgtcgcagctcgggatagagctgtaaaagacttcaacacaaatccagaggtttgtattcaatgaaatattggcatatgtaactgttgaagggaagttctttattgacttgctctgttgacaggtttctgttatgattatgtctctcaaagctgcaagtcttggtctgaatatggtggcggcctgtcatgtacttttgcttgatctttggtggaatcctactacagaagaccaagctgttgacagagcgcatcgtattggccaaactcgacctgtcacagtgtcacggttaaccataaaagataccgttgaagatcgtattttggctctccaggtaaacctaaaactgtaagcttttcttttgattgcaaatcattcttgtagcctggaagataatatccatactgcggaaactgtcattaccatgttgatatcgaactagaggctggttttccttcgtcgaatgttgggaaaactatgtgaatgttgaagcaagtttgttttttttccttggccttcattagacagtaacattttcatcctgtctacctgttcttttttcttcaagtaatatcctatcgacaatggcttatggcatgtggaacagtatatatcccatctttgtattcaccttaatccacttggaccacccatgatacatctagaattgctacaaactctcatccagcactgcttgagttaactaacatgttattgttgacgtgagtcctgagatcgcacccttgtgtgaaatccaattttagagctaatcttagacccttccaactacacttttcttcagtatttactcttttctatcgtctcatgttgccctactaatctgttgtgtctgtctcaggagaaaaaacgggagatggtggcttctgcatttggggaagacaaatctggtgcccatcaaactagattgacggtggaagacttgaactatttgtttatggtttagcatttctcctgagattggacacaattttgctcgtgggatggtgtaacttgcatctataggtgaaatatctgtcaggagatagcatttctctaggcgtctagtgtttctagtttgtacaggtgctcagattttgtagttaaaggtggcattgtggtgcgattcattttttctccgtgcaagtggcaactcatcaggtaatttttcgatgagctgcagtggtgtcttttgatcatgaagatacaaaggagaacgtcattagctaacgccatatttgtacatagttttcaccagcaatcttaactcat

SEQ ID NO: 41737 - DNA, 1016 bp, Oryza sativa
  unsure (1)..(1016): unsure at all n locations
atatgtccgtatgatcaaattctttttaccaaaacaacttacggcctttgtaactgcagtccgatggaataagaaacaaccgctcgtttntgttgcgtgataaggttgtaacttgtaagggctgcagccgctgactattctcgcagcgcataattgcgtatcagagctccagatgacttagcacaagagcacaatgcatttctcgctatccccaactttgaatcaacgatttttttacttctcccatctcacaatatagcaacctaatatttaggataaaacatattgtactgtttaaatttatgtttaaatttatattattaggatacgtcccatcgctatatcgtgggatgggagtacattttgatcatgcacatgtcaaagtgtcaaaaactacaccatacaatctgccacttctgtatgccgtgaagctaagcctgaaaaatcagacacaaaaagggaaaaaaaaaagagaaaaccttttggcatagctacagttgatgaattgagccccaaaaaaatcttgctcatggatcgagaagcctatcattgatccccgatcctcctccggcattggacccagacgatccacactcactgacgcctgggccatcggtgctcgacgtgccttcgacggacaccggagcgaccaagtccggcggcgggaagtacgacggcaccggcatcttgggcggcagcgacggcagcggcgcctcgaacttgagcacgttcagcgcctgcctgatgctcggccggtgcgcgtggtcggggtgcgcgcaccacattcctaccaccatgagccgctccatctgctcgaggtcgaacttgccattgagcctctggtccgaggattcgaggatggctctcttgccgtagagctcccacacccacggtaccagcctcgccttggtagggacctcctcgtgaagctccgctggggcggtggccacacgcgatctccagcgccactacgccgaagctgtacacgtccgactcccagctggccctgcccgtga

SEQ ID NO: 41738 - DNA, 1629 bp, Oryza sativa
tgttgaagaaggcgtcgccctggaacgcgatgcccgacggcgccgtgtccgccgaggtgaagttgtaggtgaaggagaaggccgcggcgggggacggcagcagcagcagcagggcgacgaggagaaggaagggggcggcggcggcggcggcggagatccccatggcggagaagctcgggttctcctgccccaggccaggcgagccttggaaaagagatacaaaagcttactacatttgggttgaccaccaacgagaaggctcgagctggccagctggtatctgcttggttgtgtcgtactgtaccgttcttctatacgtgactacgtgctgtgcatactgcccgcatttgcagctgccaagttactgtcatgtatgtgtgcgtgccttgtgttggaatgttggatgagggcaggatgcgagcagagaatcgatttcgagagcgttgtctcccaactccgcagggatgggaacactggacgcgcggggcgccgcggtggcagtagcgagagagtgggagacggcgacatgaatcatgatgcatccagcgttcacaattccaacaaaaactggtcgaattctgtgaaatttcgacgttttggcatgactcaaaattaagttctgattagaatttcgaaggttaaacagtagatttggtcgaaatttatcgaaaaccgtgatacgatatagctcgaaatttagtggtcaaccggtaatgtaaaccctggatgcatctctacgaggcgacgagccgacgacggccaaacaactaccatttggagtcttccctgaggaatacaaagaagcctactccctctgtcctggaaagccagcctttttaagattggttggacaaattaacagaaagtaaaatttactatattggccatatttaatagttgcatttgtcacattagattgtaaaaaaaaaatacaacaagtaattaagtaatcactactagtagtattgaagatctatttaatactcccaccatcccaaaataagtacagttctacacatctcatatctaacgtttaccttccgaaccattgtcacctcccctcttttatcggatgggttgaggagattcacatcaaaacaaagcttcagccacgctaggtctggtggtggattctatctgcgctccatcttcccaactgcttcccggttgcggatgaccatttcccagcctggtggctccacactagaagcctaatccctgcagcaagaagatgcttcgacacaattgttatcctagtagcctaggtgatctagaaggaacaaaacaaccgggtcatcaacaatcaaccctttccttagttgatcgtcttcgataagattgcaaaagaagctgctcttcggtgcacggtcaggagagccaacgcctagaccaacgtatagcaatggtagtcttttttcatgagatttcccctagtatttttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaa

SEQ ID NO: 41739 - DNA, 9581 bp, Oryza sativa
tataaaaccaaatcaaaccccatccacccgtggtagcatgcgcgccaacgcactccccacgcgatcccccagccatccgcttcctttcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgccggagcatgtgccatcctgggctgccgcctctgccgccggggtgcgaggtcaagcggcggagggcgccgccggtggcgcgagtgggttccccgccgcccgtgccgcggcgggagcagcctcatcaggctcagccgcaccactactgcgtgtgctcgcccacggcgcaccgcgggtcgttccgctgtcgctggcaccgccgcggctactacgagtggggcgcctcccgccgcaggtagggcaaagcccgttcggtgggtgacgcgtgcgcgcatggtggaaactgctcgacgcatcgccggccagctgcgtacaactcatggcgtcttcttgcgcatcatgttcggttgctcatgtgtttgtacacagacacacagtgtacagttgttcgaactcggaaggaaacacaaaacaattaaataagcgtacattactctatagtttctttcatccggaagtgcgtcattagtggattataattcataccagaagaatagcaaatcgtgtataagactacaagagcgtctgagagtgtaacgaattctagctgactagctgtcagtccattgtgatccggcctggccctcccttcagtgagcggtacagaggcctggatcgcttgaagccgaatatgtcagtgattcggtaagttttgggtgcatcagcttcggcaatagcctcttgaattctgccaaatgtttgccgccgaagacttgtacgcttaatgtcttccgttgaggtgcaccaattcttatgtactgatcaaaaaattcgatgaattcttctttcttgagctctcttaggagagatacctgcaaaagaggtatatcgcacaactcttttcttttctttgagaagttatcctgtgcttaataacctgttttcattatattcgataccatcaaacaattaactatttgctgaaaacagagcacttacctcagaccttcctctatcaaactggagagttcctgcctcaatctctgcccaatagaagtcggattcctcccacaaatttttggacttctccagtttcgaatcaataagtgattttacatacctctgcaaaaagaatgtcatattaagtgattttacattgatgtgcaaagaacaaatttagataaattcaactataatgcatcatatatccctgttcttttatcgattacaacccctccaaattttgtatacaattatgcatgtggaagtttaccccaaaatgaagaagaattgaaagaacatgatgtgagcacttcaggaagagaaaagaaaggaagtgtcatgtaaatttgaaaacacgaaagcttgattcaatggaagctaagaaccttaaaatccttgtctgacaattcatggattttgttttcaaacatcttgaagaattcatcaactctagcatcaagatatgaaggatcctaggcgttcaacataagatcagttagagagaaataaacaactatcatgccaatcattctagccttgaacatgtacctttactgtggactgaataacaatctcgagtgccctgactcccctatcagatctggtaaacaaggatattcattgtaagctaggatttaaatggtcaatatctcctcaaaaggcaaagtaagaagcagcaagtctaagacaaaacatctgctacgtaccttacataaagatctgctatatagccaagctgctcaatagttcgtagctggttggcggcaggctgcctcgcaattaaagcgaacagttgaagtttgatatttgaaagagcatcatccagatgaacctgaatataaatatcaaactatgattggcatcctcacatgcttctttctacatatcatcatgttttctacttttcaaacttcaaattcgtgagacatcacactagtaaaataatagccctcatttcaagttaaaattttccgctcaaaaagatattgaaaattaggccccaaaaatgagctataaactttatacatcttaaacttgatcaaaattctcgcattgtcactcttttttcacgtcaaatgttgttgagtagctagaacatcagttggtggctcaagtatgtccccagttctccaaaaaagtcaatagaacataatcgaacatgtcactgaaggaaactatgcgttatgtcccttgtgctggttcagtcacaagcaaccatttcaataagctatagttactgacgaattccttttcattcttggctacattgttcaggaatttcacattaagaaactattttgatcatgtaattgtacttcaaattttgttgtggttgaatgagtatttcatattactttgcatgccagtacgatatgtaataataattttagcaaatagaagtaggtaaagcctcaagtccactgaattttaggaacaagatcaacaatttgtaatcagtttggtgaacattagttcagaagttagcgatcatggatcagtaatgtcttttgttaatagtagttgcatcccttgcacgaaagatgaggcctcagggacatttacctgaatatgttggactactgatgaattctcattcttctgatttaagccctcaatttggtggtagcactttaactcattttcaagggtgataacccttctaatcagatattgtgatggagacattgatttgaacacagacttaggggtattgaatatagtatcttcaatctcctggacaatagatgtagcatcatttggttcaatgttccctagaaggagaaaagttaatcgataagtacgactggaaattcatcctgttacagtccttagcaaatataaatacatgatgaatcgactaacaataacttccacctaaccttgaatatagcattccaaaaatgtcttcgatagcaaatgtggtatgaactttgcaagagaatctggttcaagcttagaaagagcttcaagtttctcaacccaaggccaattttgatcctccaatatcaaggagagatagtttgaagcttgatagtacggttggctgaacttgaaattttggtagtccttgacagcagtttcctgtgatggtaagatgaaataaatcaatgaaagaaaacgacattgtcaaaagatcctaattggtccgtggcagagcctgttatctacagaccgagaacaaagctcattacaaacaagttagaccaaacaagtacatgtgatctgactatttttgataattttctggcaggttcaaaataatacagcatgcggaactgaaaacagtaataagattactaaattaggagtatgaactgttatttgtgatatttgctttcacacgtttgaagcttacaggatatggcacaaaatccttcatgttgttgtaattaaaacattatttcccccaatcttaatgaaacaaagctttgatcgtctaacaattacaacttgatagataacaattgcctaataaaagtaaaatccagcggtcgaaaaaaaattgatgcacacaaagttcaaacaaagagaacaattaaatattgaaacctaaactccaaaataactgaatctacctaccttcaaggcacaaaatctgttcggtttaacttcaaagttagatatatgcttcataatggcatctagcagaatccgcattttgtcattgtaaccacctactgagaccttacatagaaagtaaaaaggttttagtttaattcaaactatcctaataaagcaacctaatgttgcatgaacaatgaatgtttttttttggctggaacactccttggaaactaaatgagaacaataaagtagttcactgactaaacctggaatccagcagaagtgcgatatattgaatagaataaaccagcaatttgagcatcatacgctgcaaaggcacaaacatttcgtaaatacccaaatgggttattaacatatggataaatatgctaatatttgtactatttgtgaagtggtgctaaccatatgcattcaagtaatctgccaacaaatcaacaaagagactcgtagaaatgactgcttcgggggaatggcttgttaacggacagtggaaatcaattacaatgtgaacctttggagtggagaacagcatgtcgggcatataccacaaccgtgaaagcggtgtctttctcaatattgctggaaatttaacctgcaaacatttattttgtaagagatatttactatatttaagattcagcaattcatttagaattgtgctaatgtggggaacaaacacagacgaggtgatttaaatccaaccttttcatgcgcttctttgagtgaaaaatcttttggaatgaaaatgttaggctttgggatacagagcttctcagtaggagctttttgaatccattgctgccaaagtagaacaatcactgacaatatgttctagcatattatctctatggattacaataagtagccacattctagcagtatgtaatgtggaataagataagaggaaaactctagttcaaaaaatcaagattattcaaaaaggacaaacctgtatcatggaaggagtgacattttcaacagaataagctgtacaataccatggctcaacagaatcagttgttccttcaaactttttagattcccagagtatcctgaagagggagagagagaaatattacataaaaggaaggggaaagtcacaatatttagcttcgtacggtattttaagtgctgaactggacatttgtcagcttgtcagaaaataagtgggcaagtaaatataattgactaattttgggcctaactttctaagatcgcatatctggaagaagttgaaaccagtaagaatgacaaatagtgatgcataactcttaaacctattaccactttttacttcagaaaagaatgaattcataaatgtttgtgtgttgagatacctaaatagtagatactgtaaatagataggaggcacaaacaatgctgccatgtgaactgcataaatgtaccttactctttcagctgacaactcatcaagtatcatatttattctatttggagcatacttggacggcaatgatgctccaaccagccattcttctggtgggaatgactgcaagcagttcaaaagatctttcatattgaagatagctaatggactacagatgaaaggtgcatttctccaacatttcagtacaacattgaaaatttagacaatagaatagttggtaatcggtgttatcacataatgctttgcgggaggtgtatcagcaatgaatagaattgatcatatggaattgcaaaccatacattatgtacttaatgaggtattgagaagtatacccgcatggttgttacaatatctgtcacatagctgattggatgaactttgtcctgataatggaattccgtttcatttatcgccacaagctaacacattcaaaaacatgttaccatcacattaagtttatctatttaaatcaatcccaatatgctcaagacatgtagaaaaagcttgatactataaataagtgatgtttgaatttgttgatgatgagatgataacttgaaacataatgagatcttgctaaaagaaagtacgactcatatgcaaatgtttctttttttttggaacgtgacttgtatgcaaatggttgtagtgtagttgatagagtctattgtccagaattagaagcacatctgtcctgaaccctcataagttctcaaaactaacaggtcctatactcctattcggtaaatatcccatttgttaaccaaaatttatattccttatagaattcactgaatgattaaaacctgtaaaatattcccaacaaaggtcaactgacgttcctaaagaaaacttttccaatcaagatatgaaaagatcagaaactcaattatgtggaataactcttgtttgggtagtttgggaactctagaggaaaagatcagaagtcgtagaagtatcagaacttctaaccataaaacatggatttacacactgcgtaagccatgttctttgcaattacctcatcatagatccactcatggatcccattttcttttagtagaagaatatatttgaagaccaagccaatgatgtcttccatgtgttctgaaatcattgcatgtgcacgcaagaggcttaaataataacaaaatgtgcttaaaacaaaatagccatgttagttataattaaagatagaagctgaccatgaccagcatcagtgagcctcatgctaattgaaaaaaaaggagtattgggcactgtcactgccctccccggccgacaaattcatagcccatcctaaagtagtcaaaattgagcatatttcacatgtagaaagaataaactagagtgactatgagtagataagggaggcaaaagagttgtacagcaatcaactggtgaatgtacttgcctagttcctttatgatatggaagatggatccctcgccttcatgctcaattaagtgactcaaataatgggaaggaccttctttgtaaaagtggatgttaggtgtaacaggccatgatatgtttaggtaatcgccttcagatatcgggatagctttgataacaagctgcacagcaaatttcatgtcatctaccatcacacacacacacacacagatatatatatatatatatatatatatttgaccgaaccatcacatatattttatttttagtgattgttgcaagtattccatcttctccattttccacaattggtgttgcttcaagtttctacctgcatatgctcttctgaaagaggttgacttgggcatttgaagcttctctgatcagtgtttttgatgtcactaaacatgtgctcaacaaagctttggatgcaatccaggctctctaccaaaataaataaataatctcagtaacagataagtttgtatgagaatggactaaccagtaatatttaccctttccataaacaacaaggtgcataaggtttgctgaataattctcatagaacttcaaagctcctgtctaatgtccaatcccctctcttttggttttgtttctagcgtttcacagctccctgatgcattaaatgacaaattagcataataataaaaatataaaacattttaacttgttttttttaaaaaaaattggaatagtatttcatgcaaacgggatatacaatcactgcagaaaagtagctaattacaaagcacaactgttgggagaactgaaccattgtatgatatgaatttagatttcagaattgacatgtcaattttcatgaaagtttgttcatatttcaatgtgacctgaagaaaattgtggtctgcaaaaccaatataacagctagattttagcctgtttggatcttcactttgttttctcacaagaaatgcaacccagtaatcttaacagctagcaagatgactggtaagatatccacaatttctgaacataactatttgcttaccaatattgaatttatgataagggtgatcctttgaagccagatgtttttggagctggatgggggaaaaagtggaaaattaggtaacagtgaagcatgtgctatgagattcatagcaaaggaatggaaagtactgtgcatgctattttttactttcttttttattggaggaccatttacgtgcctatagtctcaccaattgtttatagatatatttatataaggaaacacgccttgtaaataaagaataaacacatattgatctgtgagtgaaaaggatgcatgatcctatgctttaatgttgcagcttctaatacagtcatacatatttggcagcgcgcatggaagaatacataacatatcaactaccaaatttggaatgttgcagtacctgatacattctccagctatcagacaacaagtttttcttgtgttctaggacgaaaaaaaagcaaagttagccaaaatatgctttttactactctccaaatcaaactgtgagttttgaagtgtaatgtaatgttaaccacccacaccaaaaaagcataacacgatgttagatacaaatagcataaaaaatcaccatgtgtaaagtgaataatcagaacttaccagaatcaacagccttaatctctctaagaacagcatcttgcgacatcaatggcttaataaaaaactgtgcaaatctgcacaaccgaaaccaccaatgcaaattgttattttctaacaaaaagcatgaaaaatcttcagaacaaaaaccaccaccatattcaactcacacgataaatacacgtgtgcacacatacatacattaaatgaactaaaagtattaaaaaaaaggtcttacctgtctaatgcttcttcaaaattggccgcattgacataaaaaaagaaagttgttgtctctgaatatgtataggcatcgcaatagccaccgtgctgatattttttacatcaacccattgtcaaaaacatagcctaggtatttccaagcattataatatttttgttatgtgtgtagctctttaacaacttgtggcatatgataggatgaggattacaatgctattgctcatcaggacattgtccttccgcttaaacagcaccgcacataatgccatgctggcaagcatggacattagcttcaggggaacacaatgggatataacatgactttagggtcacgaccacggataaatagcatttggtctgcagtttgccagtgtgcacacatgcaaaccagtcatagcatagattactcacagtattccatattagaagtcgttttggatttgttctaggtcaaacttcttcaaacttgactaagttcatagaaaaataaatgtaccaatattttcaacacaaaacaaatatactataaaaatattcaatggtggattaaataaaacaagtacctctatcatatacttcgagtaatcattttccccagggtatttctcactggcataaaatagcatgtgttctgcaaacaagaccatgacaataaatcaagacaagagaacagataaaaaactatggtcaatgcaggatttttttcttaattcctgcaggaattaaacttaaattgtgtgaaatactatataatttctgtgaaatctatgtgttccaaaagaggcctaaacggttactgaattttgaacaagtcagcattttcttcacaaaaataagtggttttgctataattatggcgacatttttgctttgattacagtcaaatttgatttaatctctctttctatatatatgtattagctagtatagctttatgtatttaatctctctctctctatatacattatttagaaattatatttacaatttagaaagctaagtggatattctttgcctttttttaaaaaaaaaaagtagagtccaatccaaacagacttgaaaccagaaaaa

SEQ ID NO: 41740 - DNA, 7574 bp, Oryza sativa
tttttttctagcgtcattagacatagcctttttcatttagaaactaagaaaggacgacagcagtcggaactcggaacttttcccgagattttctcgctaagttcgcgaactagacttccccgcggagatgaaggggacgaggtcgggagagaggaagcgaacggtggactgaccgagaaagtgggcgaggccctcgagcccctccgggtcgctgaacgagcccacgccgacctccatacacgccgccgcctgcaacgccgaggaattaggggttagttaaacacacacgcacgcatacgcaccacaccaccaaatcacgcgagagtcgccgatgaaccgacgagcattctgcaggcgagagcgatcggggagggagatcgagaccttgtcggtgtcggagtcgctgatgaggaggcactcgagcgcattggggagcaccacccggcggtactcccgcttgtcgctgcgcgagcggatgaactccacattgctcgccgccgccgccgccgacatcgccgcttgttctccgcctccgctctcgcttctgctctcctcaccaccaccacgcggtcgtccaatctcagaggaatcgtggaggtttggtatcgtttggaaaattttcctatatatgacctcatttggatcaaaggaaagagcatctcaaattcctaattagggaaaggggagaaatcctatactttcaaaaggaaagcaaatgaaagaggtttcctcctaagggcgcaaatgatctccctccaaacggcagttatggccttcttgctgctaaaagaacacagggatacgaaaaaatgcaggaatatgatgaaaaatggaggattaggaaacagaggaattttataggattggatattcggaacacagaaatagaaagtggagaattcaaacaccctatagcagccaatgatgagacacaaacaaaaaggttggaggggatgtttggaatcctttgaaattcctgtgttcactggaatgctacagtattccttcaaaatcccttcggacttcggttaatcactgtgagtgagggattggaggggatttattccacacctattttggtatggattgattcctacgatgcaaacaagtgaacagtagcaaatccaaaaagaatcatcaatcctacaaaaaaaaatcctatgtaaaccctttcatccgaacaggccctaagaaagtcgtcgccggagctcgtgctgccaccgggatccgcagcgcacgcccgccgcaacttcagctctcgccggcagagctcgcgccacgtcgggaatcaacgcaggccaccacacgagctcctcgcaggctcacactacagccgccgccgccgccgccgccgaaggtcctgccgcttgagctcccgcacgagccatggtccgtggagttgtgtgcgagtcgagatcaccagtgactgagatgaaaggttacaggataatgctatgtaaatgaagatattagttgctagagtaaaggttaattaattagaattcctcctatccgtccaaacaccagggtcatgtatatatatcacatgttttttaatcatattctaacgttttgtattcatgtgttttattttaattagaattcctcctatccgtccaaacaccagggtcatgtatatatatcacatgttttttaatcatattctaacgttttgtattcatgtgttttattttctactccctccgtctcaaaatataagcatttttatacttcgacagtcttcgatatgctactttgaccaacgatataagtaagatgtttcaaataaaaagagttgcgctagtttgttcaatgataaacctagtaacattaattttaattttatatgattgatcttttttatttttgttctattaatagtcaaagttataaatatttgacttggcactataataaaaatgattatattttggaatggggggagtagcgttctgagctagaaaatagacaatatgttacttcatttgtatggtttcgataaaatatcactcaccgtaatacattggataaaatgagactaattgtctttagttaattagcatgtgacccatgcagatttgtgtggctagtatttttatattttctcacataatggcacatatattttcacattttattttaaaactagcaaaaatactcgtgtgttgcaatgcgatgtaaatgtttggagctgaaaaagaaaatattgtcgaaatggaaaaagtccaaatgccccccccccctaactttggatgaaatccatctagcaccctgaattctaaaaccggacatttaaccctctaaactttgtaaaatcagtcatattaccatctaagatggttttggatggtggttttgcatattttaaaagcttaaacgaacaactttaaataactaatataacgtatttacgtatcattagtggtaagtcatcaatttatacttatgcggtaatatcatactattattatgttggtacttgtttgtaagtgagagctaacaagtggtaaaaataaagatttaagtggagattttaatacatatattcagtgtgtatgtcatgtgatcaaactcatctaatttatatacaaattagataaaaaaaccattatacaaaaccaccttagggaataatatgatggttttgcaaagtttagggagggtggatgtccgattggtgctagacggatttctatgtaaagtgtatggggtatttggactttttccttttctaaataagccaattgatactcaaattggagcattatttaaattaaataagttatgggctattttttcaagaaaaacatttcaacttaaatatttaaggtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcaccatgacgttcgcctgttcttgcagcagtgcacgtacccctgctctgagcgcatcaggctcctctaccttcaaaggtgtgagcctttctcactaacatgtaggcccatatgggcccgatgaaccccaggtccacctgttagtgacaaaggtatggtgtctttgaaagcagatgatcttaatccgctctgaacacgcgctcggctggttggcctgcgaaagacatgcttctcttatctcccttttctctgatcgttgtcgctgactctcttaggtctcaacctaggtaggagtctagaagaggagacacggactcatattggaggccgggggctgctgttgtcgtgtggacagcgaatcgccaaattcaggtggcgaccgacgttcgagttgtgttgtcccagaggaatttagattgagtgatttgagtcgaacacgtcgtgcgtgagggactgtagtgttggaacaaaaattaggatgaagaacacaacgtgacacatacggatgaaggcgacggaggaaactcctggtagaaacaagtgggtccaaagatgcaggcgcagcggtaacgcggaaaaggacaacttaccagagccatggtaaaagatggctgctacagtacgagatataccgttagaatgatacactttaataaacctttatcttttctctatctacctgagtaaccacacataaaataaaacgaagcagcagcgctcccccttgctccctcgctcatccacatcaattgcaaggaagggtggaggcatcagaagaggaagggtgaagaagagccaatggcaggtccatcaccaggcgaccaaaaagcaatgacatgtgtcccctctctcctcgacttgataccaagtatctgggcaatgacatgtgtcccctctcttcttgacttgataccaagtacctggacgtactagaccttggtatcgagtgtctggtaccaccatggtacccaagtatcaagcatgatacttataggtatcacctatgatatcgctaggtatcatgatactactggagtatcactgggatattcaaaaggatatccatgtatcaagagaaaactcaagacaaatcaacataaagtaatttcaattctaaaaaatcatatgtttatcaagagagggctcaataaaaaccaataagggaaatcgattccagaaaaaagtcatcataactatagaaacacccataaaatatgtagaaaaccccacatcaaaccctaaaacaagccaatgcaggagcttgagggtcacgagcccagatcttggtctaaagatctgcaccacaaagaggccttgtccttgatgatggtgacctcgtcgacgatggcgacatcttggaacgtggtgagcaactccacctccgtcatgtgctcgggcacctaccccactaacagcttcgcgatctcctcctctaatccgttcacacctccaccagcagcaacaacggcgatggagacggtagcttcctcgacgcccgacgcgccaccccgcacggccagctgccatcgtggcctccgtgctcatgagggtgttagtcagagagagtggaggggaaggggaagagataaaggagaggataagattgaataggtggtgtgaggagtgagggcaagatatttactagtagtagttatcccatgtctatgggacttcgttccctagattttctgatggtaaaaacatcttcaatttttataatagcagaggatagagatatattaagggaaaaaaatatgaattatccccctgaactattacggtcgattgaattacccccccaaaaaaaactcaaataccatacgttttataccctcaattattcaaaccagataaataacccccctgagcactattttaggttgttttgacctaagcttgcacatgtgacgccaatgtggcaatccagtcagcaaagaaaatagaaaaaaagcatgggcccacatgtaatctcccccagtcaagccatccctcccttgctctatctctctctgcagtctacacctaaggcaggagaatacgagaaggcggctgaggaggggcttggagcgatggctccagatccacctccagctgtggacgcagtggcggcagaggaaaaatcgcgtggcgccgtcccagcggatttggcagtgagctcagggagccatagtgatgtcggcttcgtcatcgtcgtcgcccttggagacgtacctgcgtggcgccccaccgacgcatgtggggatgacgtcaaaggcgggaagcgaggtggtggcggcggcgcaggggcgtggggaggggggcgtggagacgccgttactgctggcgaacatcctcgattggtcgaagatccttggcatggagtatgacggcaggggagcacgggcgcggacgcggcgcggtgactgttggatgagcgcggcgacgaggagttccgctggggtaggggctaggtcccgcacacgagctcctcctttgccgggagcgcatcgacgcatccttctccgcccgcaagggcgccggccgcacgctcaagggccgtgacctctgccatatgcgcaacgccatctgggagaagaccggcttctaggactaatgcctctactccaccactgccgctgtcgtgatcctctccatcaaagaggacctagttgccgcagtcgccccagttgtgcccgccgctgcgcctggagctttggcccgcctccccagccactcgtgtgagcttcggcctctgccaccgctgccgcaaccttcgtgcgagcgcgagctccgactcagtcggctgcccccgctcgttgcaggctgcggcaaggggagggagtgcccggagcttcggcgcctaccgtcgggccagccaccctagccactcttgtgagtttcagctccgccaccgctgctgcaaccttcatgtgagcgcgagctccgactttgctggtcgccgccgctcgttgcagcaagggagggagaagagagagagagaggagggaggagagtcttaaaggtggggtccacaccattttttaaaaagaaattaactggactgtcacgtaggactaaaaccactctagattgagccgggggttatttgtccggtttgtatagttaaagggggtaattcaatgtaccatgatagttcatggggtaattcgtacttttttctatattaaaataacaacataattttaaattatgtacaaatgatcaaactaaccggtgtgtatctcctatgctcacgagatgaccaaaacacttctttgtttaaccaaaactgattgatcgatctcacctgcgcgttcgtgcaagtgcctcccaagagtttgttcgtcgccgccaaggagaaggcccgaaaggatgaccaaagtcctgctcggtcctccacgcgctcatcgagccattatcacctccgccaaggttcacaaaaccaatcggttttcgtgtaaaccggccggttttcgtgaaaccgctagttattggtttgtgggagttaatctgtagtagtctattttcgtatggcgttgacccaaagtcattggtctttactgatttttgctaaactagtgaggagcgtttttcacttcgaagacaaaaaggtaaaccctgacctccgctcttttatcggcaacaggcaaatcaacgaatgaggatatccagatagagcatgaaccatagtggcatagtgccaagatttgcactagcaagcctagaacagtaggtaccaggcaaacgaagcaatcggttagcgtccaggatcacctccagcctccaggtacggcgttctcctggagaccagaatggatgtgtacgaaagagatgataatattatagctgtttggttggaggtagtttttagaagggattggaagtttagaggaataaggttattaagtgttttgt

SEQ ID NO: 41741 - DNA, 1021 bp, Oryza sativa
tcccccacctccgccgccgcgagccagcatgccgtcgctgccgccgagatggttcttcgccgggaaagaaaggagcagcgcttgactccccctcttcctccgcaaccgcgagccggcgctccactaccgccgccgggaaagagaggagcacgccgacaagcagaccggagagagagaggaaggggagagttgtgcggttgataagtgggtcccacgtcgatttttacacggtgttggcattagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaacaccgttatatgatgattaataagttgacaataagattgataaataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccacagtctttcttttcctctctttcttttattttttctctctctctcttatccttcccttctctcggttccttttcctgctct

SEQ ID NO: 41742 - DNA, 2501 bp, Oryza sativa
aagaggaaaaacgacgaggcggggtggtgggagcaaaccctagcctttggggtggtgcgagcaaaccctatcctttgtggacccctgatgggctctactgaagacaaggcccaagcccaagtttctggtccaaacattgtttctattattctaggcagctccactcaaatttgatagtgaggctaggctcatttcaaagtagtcgacgatatctttacaatgagtactcatgaggtccaaacgaagctcgtatgtaaatttggtggccgttttaaaacacttaggacgatatatttttttcacacttaggagcacacaaaaaccaatcatagaaaaaataaactcaaatggacgaaatatgtgacatgtagaattttccaaagctctaccgagaagctttttgccttgaaaatacaatcttgcaagcagaatttagaggttctaatttcgctgaacccgacaagcgggggagaattggatgtaactttttctgtagatgtccgtggatatattatttgcttgattccaagtttgtatgaaaaaattacgcctgttttaagaaatgacacccaaatgtaaaaaaaaagaacacaaaccctaacttttttttttggtttataggatgtaaaaggtataaaaaaaaggctaaagagtgttcgaaacctgatctactttttttttttgggaggtgggggggggggagaggggactatataagggctcacacatgcttacccccgctcgaacataaaccaatgtgggtggtaggagcgaaacgtggctagccttgctgcgtatgtgtcgaaacatgatttcggcaataataaaagggggtggcgctcgagacctaaaagtggatggatgcggagacaaaggatttagacaggttcaggccctctcaatgagaggtaataccctactcctgtttggggatttgaatccgccgagtgtgtattgatctgacgatcaggttgtctcatatatatgccccctagagggcctcctgcccaccttatataggatggggggcaggattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgccgtgtgggtatggggtacccataatctccacagtatgcctactctttagtccatgggattttttgcctagcaagttagtgttggaaaaaaataagagtttacatatggaatttttatacacggcaattttatgtcatagaaatgaaactttcgatatataatctttgaacaaattaatttgtagcgaataaaaaaagaagaaaaaaaatctatagataagtttataaaaataaaacttgtatgtagaaacttttgatacatatgtaaaaatttgtactttgtgtaaaacttttggtatataaactctatgcaaaagcagattaaaaaaaacatttgtctacaaattttcacctaaaaatttgacagatgtaattatagtacaatcgtagtgtaattacactataacttgtatgtaaatacactgtaacatgtaactacagtgtaacttgtatgtaagtttcacgtaattttgaatcattagatctaatacaagatttgttctagtgaggaagaaaaaaatcacagcacacacatgtgtgaaaggatttgttcccacgacctccattttaccgaaatagcatgttatggagagatttttaaaagttatatacaagttactgtgtaagtataattgcatctgagaaaaaaaattatcgacaaatatatagcaaaattgaaaagagaaggagaaaagacaaacatgccaaatgtgtcatgaggcccgctacttatcggtccatcacttggtttcggcctttcatggcccactccaaaggaccaaaatcgaaaatatctcgaccatgcaaagagaagatggctgggcaacatgttcgtgcggctggcgctgggctcacgcacaaacgtttgcactcatgtgcaatcagctagtttgttgccataatttttgtgtatgtttgtttcgctatcaaaaccatgtcatgccacgtgtttttaagtacaactatatcatgtcacgtgtttttaagtcttaggatccagtgtcacaattttaaagctggccatgccacactttagataaggtaaaatctaattggagaaacctctccaattagtcttaaccagagacaccccacgtgctagtactttaagagttttggttgctattaatccattgagcaagtagggaaaatattcctatcatctatacttcaaataaaattttctcttaaattactcatccgatttacaatccgattacaccgttgtgttcgtaataattaaatctttacaacaagatctcacatgattatattttgatgaaaaatcacaaattacttttatgatatgtct

SEQ ID NO: 41743 - DNA, 10158 bp, Oryza sativa
tttcattgaaaaaattatcatgtatatctaaaagttacttttagatttgattgaaatacttcctatacattcataatgctctgaggtgattacttttttttattattattagttaattccataatttgtgctgattaatttaatttgtactgataatgtttttatctctacaacagatttatgacatgctaaagttaccttcattttgttctaagttacttctataatatatgtaaattactcttaggttttactgaatttacttttatatatataagaagtaacttagtgaaatctaaaagtaatttagacatatcataaaagtaatttgtaatttttcatcaaaatataatcatgtgagatcttgttgtaaagatttaattgttacgaacacaacggtgtaatcgaatcgtacatcggatgagtagtttaagagaattgtatttgaagtataggtggatggtgcctcttatagatggagtggtagctggtttagacaaaccagctaccactagccgtgtagttacgtcctttagataactactactattaaccacattgtttgggcaacatgtcacaacttggttaaggacaagtttaggcaacaactaaccaaagattccatagataacagactgcagccctccagccgactgccgaggcagtaaggcaaagggtgcccccggcccctggcatggaggtactcaggtacaagtacaattgttatgtgcaactggagtactggaccagaaaattcacatcaaaaacagagagcagaaagcacataaaagatcatacatagacgaactgaactgaactgtttaatccgagggctttttattcttcggagccatggttgccatggcaggcatccattatttccggtgtccaatagtttctcagggaacactcaggcaacaacaacaacacaaggtgttttggttcctatccgaatctctgtttcccttcactgcgggaaggtggccacaggatggacacccaacacacaaggaagggttattactggtactggctcgcgagctgaccttccttgacgatgtagttctgcaccgggaagtcttcccctttgaagtacctgtccagcatgtccttcactcctgctgcgtatctcagctgcagcaattgttcatttgccgtgaaatttcgttacagacacagtcagcaatacttataggaaacagattataagaccaatccaaatgcccacatataatctatgctagacataatacaagcaggacccgttgccaatgtagtgagaaattgaccgccgaatctcaaccctatggctgaataaagcagttgtgcatatttaatctagcttggagtaaaaacatcttatatgattttgatcttaagaaacaattattgatgaatcaataaagtggcccttggtttgtactatgtatcatgcaaaacatgcgctgccatctgggtaactaagttactcatctcactagctgacatattgctctacagttttgttaaagcattgtgggggtacccacagaatcagattctagaattttatgctccaatgccctaagttaaagtagaaaacatatataaaagctgacctgtgcatcaattgtagtcccagagatatgaggggtcatggcatgattaggcatgtatcgccatgggtgatcctttggtgctggttgggggaaccagacatcaccaccatatcctgagaaggaagaatgaggttttcatgctaaaggaaatattgatcaagatagaaatattaatacggcatcattcttataatttttttttcaataggacaccaatattagttctctggaaggaaaggacatttagtagtttgtcacagattaaagaatcatggtaagagagctaatttacataggtgcagagaagttcttttatttttttaaaaaaagattcttcaataattgtgaacaacaagttatcatatttgacatacatactgctttactgggttagttgtcctggttttaagttttttcatatcacccctcttaaatgtgaagcatgataggctccaggaaaatgatatacttcatggatcaaaaagaaagatttagaccaaatctgatggcatgctagtatgcagtgtaggctataagaaatgaaaggatgatggtacctgcaacttgaccactagagcaagcgtctgcaaccgcctgggtatccatgattgctcctcgagcattattcacaatgattacacctttcttcatctttgcaattctttctttattaaacatacctctgaagaaagaatcatacaaagttcagataagtagatgtactatgtatatgattttgcaacaaacaagaatacgatcatcaggaaccttgttttctctgtaagaggtgtattgatcacaatgacatcacactttggaagcatagcatcgagatcctcttcatatttggccccaatttctttctcaagttctgggtcaattttaagtctgtcatggtacagcaggttgcagttaaagggcttaagacgctgaagtaagagcctgccaatacgaccagccccaacagtccccacagtttttccttcaagatcataagccctataggcaatgccagcaacattccattcaccatgaacaacctgctgatacccgggcaagaagttcctgagcaaaatcaaaatgcgcatgagctcatcttctgccaccgacacagtgttacttccggtaacctctgccacagttaaacctgctgcagcagctgctggcagatcaatatgatctgacccaatcccagctgtgagaagcagctcgaggttctttgccttcttgatcctttctgcgctaacataggctgggtggaaaggggtggtgatcaagacatgcatatcctcaatgtgcttctccagctctgacaacaagaaaagcatcagttatgtgcacaagaggagttaaaaggataggttcagagctatgttgctatttaaatactgtagttgttatctgtcttagaactaaagcacaaaaatagttgctacatgtttttcgacaaatcgataagagatatgcaaaagaaaaaaaaagttcaaacttgaaacatgtatgcaacataggcacagacaagaatttgagttacagaagcagcatgccagcatgaatagagttaatttcagccgtgtgctagaggaaaccacttggctgccaaccactcaacacgtgaaagcatgactaccctagccacatacatcaagaacctcctttccaccttccatcaaccagatgaatacatccttaattctcctgatcaaaagataaaaataatcatcggcgaagttaagtaaacgctcatgtccacctatggcaactccatccacctctattcagcctgtacagggccacactacaagctgggagatgctagctactcaattcatcatgtgtaagcggctccatgcaaatcatacaccatgcacaactaaaaaatgttggtagaaacttgagagaaagctctgaaaatctgaacatctctcgcggatactaccacttaccgctgtttagcccctccttgtcgtcggtgacaatgtagtgatgccccttggactcaagccattcgcggatgccgagagcgccctccacgcagccgacgaagttgggattcttgtcggcgtactcgccgcccttgtagaacacacccacgatcttcttgctgcctgctgatgtctgcgattcagagagggaaaaccaaaaggtataccattcttcagagttgcagcaactgagatttgttcagacaccgaaattcacatcacagaagagatcaggaaaaccgattgcaattgttcatcacccattcccgtacaaaaggggagaaacatctttttgggaggagaaaaaaaaagaaattccgggaggggacaaagcatactgggaatcacgaaattagggaggaatccatgcttttgcaaaacccaatctacaatagaatgctcttgctctcgcaaaaagtaaaagctaaaacccaaaattcacctccgaactgcacccaaaaaaaaaaaaactcgcagcagaaacaaaaaagaaagagatactctagacaagaagaaccccggtcgatccagttggaagtacgtacgtgcgcggccctggagccgagcgcgcggccgagaagatgccccgccgccgccctccacatcgccatgatcccaggaggaggaggagaaatcgcgagacgaacgcacaggcaaccgcgagcaggcgagagagagagagtgatggaatcgatcagtgcagccgactcgatgggatagattgatatggatagataaaggcccgccacctcgcgccgccaggtgggccgcgtggacgcgggtaggtgggcgcggcgggctgacagctggggaccagaggctgtgtgggctccatttgtcagcgtctgcagctgctcacactattaggatatttattttcattttctggagtatatgtataagctacacatacgtggccccttggcgttgttaggataagacggagccttgctggtgatcatccaaaacaatgtaagcacttattagcaaataatctggttttaatttgtgacagggactgaacaagtgaggacactagggaagcacgcacgcttcgtgcagctttgcgccatggagccgtggcagaaacagaaaggctgcgtgagtcacccatgcacgtaggccctgtttatttccaaagttttttttccaaacttccaactttccatcgcatcaaacatttcatacacacacaacttttctatcacatcgtaccaatttcaaccaatcttttaaacttcagtgtgaattaaacacagccgtagaacctccgaatgctcaaaatcgggcgcctgatgcggcgaaaaaaatggggcgcccatatgcgcgggccgcccccactatgtatgtccatcattcgcgccccattacaatcagtggcggatataaatttaaaatacagatggggcggcagagctagccctaattaggtaatggcacaatgcacacaaatcatagtcgccggctcacggcactggtacagcaacgcacggcatgaacattgagaaagttaacaacgaaaattggtagtcgaacaaacgtatattaattatatgtagagagaaaaaaaaaggagaaacgttgttagacaataataaggggaaccactttcaatacattggaggtataaaacgaaatgaaaaattatttagaggtttaagtgttttgctaaaatagttcaagtgagtaaaatagtttcttttaccaatttaactttattgtagaccgtattatgtgctaaagaaatagaaaaaaagtcaaattttacatatggccaaaatcagaaacggtcgaaatggtactactcatacagaaataatactcattcagtcaagaattttcataaatgttgtttatgccatggagcagtgtattgttgcaatggcatggagcccgggcagctgcccgtgctggccgggccctgcctccgccattgtgtttcactatgtatggatgagttgcagtggattttgatattgtttcgtaatttcatcttagtggacacgtggtttattgatgtacacggggtttaagtgttgcaatgattttaaatcgtttgttgcatatgttgaaccaaattatttcatcaagtgatcttactgtgtttcactttttttaacaattgaaacattctttcgctatttgctgaaacattgtttttatatagggtgaaacaacgctcgatttttttggaaaccgttgttttatatattgtagcaaaatatttcatgaggtgatttggttgtgtttcagctttttacaagattgaaatattttcgatctacttggtgaaacagcgcccgatttatacagaaaaaattgggcgcccggtttgtaggcgcctccacagaacctgcacaagcctcaccaactcttagtctaaagccatgagtctctctagccgcctctaattattgttccatatgcatctatagtgattgttccaatatggtcccttttgtttcatagccaaaacagttctccttcatctttttttttctattttttaagtagtattattgaaataaaaaaacaccattttgttgatcataaataggcgaattttgaggtccatttaacaaggtggcattctccctcttgtttcaaagtaaagaccactgctacaaaaccctaaatgaaactagcatctatggatttttttttccacctctacgtgatgaaaaaatatagtatcgacaaatttgaccattgtaggtatcggttctagaggaaaacccgacatcaatactatagataccggtttttttataaaaaaagaagggtacccataaaatagattgagccaagccgtccatatacaccacaccacttgcattttatcctcttcccacccggctgtctctttcgcacatcgttcgatccccatcccactcacacaaccccgccaccgctccagcctcacttgcgcttggcctcctcctcattgtctgtcgctcctcctcctctccgtctgccgcccatcctcctcctccttcctctccatccgccaaccctcctcctcctcctttcccttgcagcgcccctcaccacttcctcgccgccttcgagctatgtctccccaaccacgtcggatctggtcacctaaaggtctgaggccaccggatccggcctccttgaggtcagggctcaccggatccgtcctccttgaggtcagggctcaccggatccggcctccttgaggttggggctcactggatcactaacgtggatcaccttgcatgtgcttggggctggtgcggtctggctagaaggagataatggcgacggtggcggtcagtcgaaggagagtagcaagggaacgaaggcgacagatccaatgggacagtgagcctgatatgttgaacatgtaatggtcagccatggcgaaacatgtaactgtgaattgttttgatctaatctgtgattagcttgttcttgtccttttggtttgtgatgtgcttctttgttttttgatgtatgcatatgctcttgtgttcttgttgatttgcaatgtggatgggggggattgcagatggggctaggtgtcggttctgtctcgagaactggcagctataatctctataggtaccggttctggaactagcacctatacatataggtaaaggtgcctccaaattggtaacagttgggaaacccacacctataaggggttcccaaccagcacctatggggtgctctgtagtactggactcaaaatgcacatcattcgatagagtttcagaggaggttttcgatgctagcatattataaccctttagtgaaaaagatattttaacacatgagcttgcacttgacaaatacagatccaatagtagatacatgcacactaaataggatcaaaattgataaattattattagaaaaatggcatctataccttctatatagttggtatccactagcaattattacaagctaaagcttaacatgcaagtacgtcacattaccacccactagtgattattactattctaaagcatgttaactctcatgcaagcatgatacgtcatatagaatataatattgtagagctcaacatataaatatgtcaaatgatcttccttacacctttttcacaatatttaacatttagcatttctataatattttatattcatccatatattccagaacgaagcgcgggtatactagcaattgtaaagaagaaaaagtttgagtcaccacatggcacacactaagattatttaaaatatactgaatcattttgtgatacattgtagacattgatataaactgatagcatccaaaaaattaaaagccttgaaggtgaactcaaattgggctagtggtattttcttaataattttcccatgcaccaaatattttttaaaaaaatatttcaaattttaaagcgcaagaaattttattgctttagttaaaaccccatatttcaattttattaattggtctattcatggaacctttcttttagttcaaatattaaaagccttgaagatgaacatgtcgatgggctatacatcactaaatacgtacctatatatatgccatatctttaaggacgtaaggaacagctaatttgaggatataaatgaaactgagaaagagccaaggagacatggatttttatccaacccccaagatgggtaatagccctagtcatgtttactggaggtcagtgttgccatcatatatcaatctcttacaagtacaaactatcgggaggaaaacataatctaatataccaatctattggcgcagagctcgggaatggtggtcagcggctagctattgttaattttctcgggtattgactcaacgagattggaggtggctctagatctctcttggcttactagtttctaacacattctcttctctcctcctaggggacttacatttatacccttgggtgctcctttatcgaagtaaaactacaagacaagtatgcatataatcagaatagtcctgaccatgcctacaaaagactcaacatttctttccttatctgggactccttccctatctactttagactttatctatgtgtatgaaggtttgttttcgtataaaatcacttgatctatggtggtcccaccgagttaaatgtgtgtgtgtgtgtaggatatctcaaacctaggacactgatagaacaattaaaacctttatcaaagttttttttacaacagaataactaaaagaaactcccttatgatctcaagtgggctgaatacgacccacccctcctttctctctcctgcgcccatgatctgtctccacttgttgatccaccttcctcacctttcttctaatagaatttcagtatccaaacttatcgcattttggagtgccttttattttataacctaccaatgttgttactgtcaaaacctagacaagttttcatgctaccaaatttagtagagatcactattgggtataactcaaaaatcgatagtattagcaacaattggtaccaaaccattcatctagatagtactattcagttaccaaagggcaaaaaaagtggcataagttagaatttatttggctccatactttcgtttcgctacaacttgcaacaaaaataactgcctccgcagcccattagttgggaagaaacatagcatgcctgatagaggctagctcatctgtctatggtgaatgtgttgtatagttcctagtgtagttttagcaagtcaaggaaatattaaggaagaggttaaagaactactagaccattttgtcgacggtggatacccgtagactggatatagagggtattggggtacgctggtacgaggatctacgtgatacgacatcaagcaaatagaagacaaggattatactggttcaggccccttgataggtaatagctctaatccagttggtatgggattatatggtggaaaccacatattacaaagataatagcagaactcggtgatatcgacaataccgtagtcgagttggtccgactagatcacccggcaacttggctcctataggctccgacttcctaggttgtggtcgttgtgttggcggtgagattcgatgccttaggtcctcccgggggtcccttttataccgtgggtcagttgatctctaattagaactcggagatatcggaccccacacgatatagtaacgacccagttctgtcagagtaggactccttccatccgtggactccatttctgttacgtgcgggatttccttaacgtgtacaggaaacatccatatacgcgcaggtataccgtatctagggatgccaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaataaaatcaataatttaccaaattatcgttaatcaacaataatttgaattacatcacaacttagtatcagttagcatcacaaatgaactgagagaaatggtataag

SEQ ID NO: 41744 - DNA, 3211 bp, Oryza sativa
ggtccttcccacttgggtgagagcttgttacgccctgcttggctttgaacccatcggaggacgtaatcgccgatcgaaagcgtgcgtgctctgatgcgcttctcgtggtatcggcgaagggcctgttggtagctggctgctctgacggtaactctttctcgatgctcctcgagtagattcacatcgtcgctttgctgctcctcttgatcctcgtcagagtacttctgtactcgtgtgctctgatgtcgtagctcagtggggagcatggcttctgagctatacatgaggaagaagggtgtgtccttgttggacgttgtcggtgtggtacgcacaacccatagtacagaggggagttcttcaacccacttcttgtcatgtgacatcaatctgtcgtagacatggtcttgattccttggagtactatgccgtttgccctctcgacctatccattgctctgagcgtgaggaaccgaggcaaagcagatcttgactcccaatctgatgcagtaatcctggaagtcagcaatgatgaactgggagccgttgtctgttatgatgcggtggggcaatctatatctgcagaatatccctttaataaacttaatggcgttgtcggccttgatttccccagtgggcgtcgcttcaatccacttggtgaaccgccacgaatagaaacatgtaggcgccctgtcctcgtgggaatggtccgagtatgtcgagcccccagcacgagaacgaccaagtaagggggatagtctggagcgcttgcgcttgtagccttgtgtgtttgctgtggaattgacaggcttcacaccggttaaccatgtcgcaaacgtctttgagcgcagttggccagaaaacctttgtcaaaaagcttttctgaccaaagtgcgaccggcggcgagtgacccacagatcccttcgtgtatgtcgaggagtagatgttagccgtcatcgagcgagatgcatttgagaagtaccccgtttggtgccttcttgtatagatcgttgccgatcatacagtaaatcttggcttgtcaggttattttctcggctgttgcatcatcttcgggcaactcgacactactcatgaaattgatgagtggggtctgccagtcatatgtggtctcgatgtccgcaactgcgcgttctgcctatgtaacccacgagccgatgtcggggacgactgtgctatcttcgccgattgtggttttgtcacgatgtccatgaaggtgccaggctccagcggctctatctggatgcacgccgcgctaggtcgtctggttcgatgttgtccttgcgatatacgtgtcggacttcgatcccgtcaaaccttttctcctgcttcctgacttctgtgaggtacttggatagctcggggctagagcacttgtagtctttgtgcacctggtttgcgactagttcggaatctcctttcacgattagtcacttgactcctagtgcggctgctgctcttatctccgcgagtagaccttcgtactcgactgtgttgttggttgccctgaagttgaggtgaattgcatgcttgaactggtctcccgaaggtgatgtcaagatgaaccttgcccctgctccttggctgttgagtgcgccgtcgaacgccattgtccatgtttcgctgtcggtttgactgtccggcctgttttcaggcataatccaatcagctatgaaatcggcgaggacctgggacttgatggctgttcgtggcacaaagtggacatcaaactggcttagctcgattacccatttcgcgatgcggccgacaacgtctttgtttctcacgacttcaccaagagggaaggaggaaacaactgtgaccctgtgggcttggaagtagtggcgtagctttcttgatttcatgattactgtgtaaagcagcttttggatctgtgggtatcttgtctttgcgtcatggagagcttcgctgacgtaataaactggtctttgcaccttctctctcgacaacaatgacggtactcacagaatatggtgtggcggcaatatagaggaataattcttcattaggttggggagcaacaagtacaggaggatttgacaggtagcgtttgagtgcgatgaacgcatcttcgacttcctgtgtccatacaaatttgtcttgtttcttcaacagagtgaagaagggttgtccttgttctcccatcctagcaatgaatctgctcagtgccgccatgcatccagttagcttctggatttccttgagtcttgtgggcgacttcatgttctcgattgccttgatcttctcgggatttgcctagatccctcttccagaaacgaggaacccgagcacttgcccgatggtactccgaacgtgcacttctctggattgagcatgaggcgatatcatcagaggttgtcgaacgtttctcggaaatcgtcaatcaatgagtcgcttgtcttggtcttgacaacaatgtcgtcgacataggcctcgacattgttcccaagttgatcgttaagtgccccttggaccgtgcgttggaaagtatttcctgcggttatgagtccaaatggcatcttgacatagcagaatacaccgaatggcatgatgaatgttgtcttctcctcgtcctctttcgccatgctaatttggtggtagctagagtaggcgtcaagaaagcttaacaactcacaaccagctgttgagtctaccaattggtctattcgaggaagagggaagtgatccttgggacacgccttgttgaggtcggtgaagtcgacacacatcctccacttcccgttggccttgcgcaccatgactggattggctagccactctggatggagaacctctctgatgaagccagctttgagaagcttgtcgagctcttctcgtatggcttgtttccgatctggtgcaaatctccgcagtttttgttttactggcttggcatcgggtcgcaccatgagtttgtgctcaatcacctccctgggtaccccgggcatgtcgcatggctgccaagcgaacacgtctgcattgtcgcagaggaaggtgatgagcgcgagttcctatttctcgttcggtgatgccctgatcttgacggtcttgtcggggtggcgctggagagtggaacgatcttgactgcgtcgtttggcttcggcgtcttgtttgttttgctcactttcttgggtggctcaactgtggcgggtgggttggacgtgtgctcaaccat

SEQ ID NO: 41745 - DNA, 922 bp, Oryza sativa
aatgaggatcgtcctcatcgcgctccacaaccaacgctgcactaactacttggggggtcgccgctaagtagagcagcaggggctcatttggctccggggcgactaaaaccggaggagaactgaggtatgccttcagctgagtgagggcacgttcagcttcctccgtccaggtaaacggcccagagcgcttgaggagcttaaataagggtagcgccttctctcccagcctcgatatgaaccgacttagggcggccatgcaaccggtgacacattgcacatccctaagtttactggggggcgcatccgctttatagctcgtatcttctcggggttggcctcgatacctcgggcagagatcaagaacccgagaagcttgcccacaggtacaccaaacacacacttatcggggttcagttttatgcgggcggagcggagattctcaaaagtttccgctagatctgagagtaaagtctcttgattgcgcgtttttacaaccaagtcatcgacataagcctcaacattacgtcctaattggctacccaaagaaattcgagtagcgcgttgaaaagtaggacctgcattctttaacccaaaaggcattgaagtataacaataggttcctacaggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtctcgccacctcctcgcggatg

SEQ ID NO: 41746 - DNA, 2653 bp, Oryza sativa
gtcttcctatttgccgtccaaaagaccaccgatccgtgtggtcttggacaggccgtcgcccagtgcaacctccttgaccgggacctcatcggacgtggctatccgctgcctcggggcggcgggggcggatgtgcccagcctctcgtcgccaccctcgggcttggacacgacggcgaggcggtccgcacgctgctccatacaagcgagcgcgactctgaggtcgccatggacagagatgggaccgtcggggcccggcatcttcatctggaggtaggcgtagtggaccgccgccatgaacttcaccaacacgggcctccccaggaccgcgttgtagggcagactgaggtccgccacatcgaagttcacccgctccgtgcggaaattggcgggtccaccgaaggtgaccgggaggtcgatatgacctagcggctaagtgtgccccggcgtcacgccgatgattggctgggacggccggagcatcatccccggggccttgatggcatcaaaggctgcgggggaaaggacgttgagggctgctcctccatcaatgaggacacgccccaacttcacgttgcaaacggtgggagaaaccaccatcgcaatctgccctccccgggcaacgcacggcgggtggtcggtctggtcaaaagtgagggcaacttccgaccaccgcgcccggcgcgtcgcctcatgagtaggggccgcggccagaagctctcgcttcatagccttgaggctccggcgagaaacgtgagcacacgctcctccatcgacagtggcaatggtggccccaggctcttggaaacctaagtcatcatcaccatcatcgatgtcctcggcgggggccttctgcttggcctcacttcgccgacggccggaaggaaccgccggggacttgccttcccggcgctcctgcctcctctcctcctcccacttccttgtccgctctgccaagcttttgactgcgcgacagtccgcaaggtcatggagggaggtgttgtggacggcgcaccacttgccggtagggcgctccctgctgggaacgctggcctccttctttttgtcgctcgcaggcctcccctttcgggtggcccgcgaagcgccctcgacggcgaggacatgaccctcgtcgtcggaacggactgacctcttcttcctcctcctgtcacgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcgtcgtcccttcgctgtacagcgtgcaagtccgcttcctcaccggtgcgcggatatgtgccctggaagttcatggtgaactgttggcacaaatcctcccaggagtggaccgacgcggggggcaggttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggcaacggacattccgaagactcgccacaaaggctctacagccgacaccaccaaccgggggcacggagggctgattcccacgtccatgtcgaggtgacactctggacaggaagcgccctccgtgcgtgggcagcacttcggtcattgcgccggcgcttgatgctggcgcgggcgtcctgctccccacgcagatcttgccgggtcgaaggactcgacgaaggagtggcagccgaacggcgaacagcggctgccgctcgtcgtgccctctgtcttgacgacgcggagccggtggtagcagcaccagaggccttggtggcggaggaccgcccaccagcatctaggcgctgccgcgccgtcatgaccaatttggccacatcgtccagccatcgttgggctggagactccgggtcagggacgacaggcggatggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcacctccccctgcttaggactttggcgtggagggggcggtggagtacgagctcgacggcgtgggttcggctccccgtcgtcgccactcacactgggagagaggtcgggcgcctttgcttgctcagccatgaggctgatcaagaaaaacttgacgcacacggaaaaatacgagagctcagaaaacacacgctgagccccctacctggcgcgccagatgacggagcgcggggctcctcaccgggagaccgcacgggcccccctttgccggttcggccgggggctcagggtgatgatcccaagctctctctgtatgtggaaagattgccagctatcgaaagagcacgaaacacga

SEQ ID NO: 41747 - DNA, 1686 bp, Oryza sativa
tccgtggaaaggttgatcagtaggtgtcaactcgattcgtgggattcccaccgcgtccaaggtgctggcgaaaagaaggttgatgcagctgccgccattgatgagaacccgtgcgaccttgatattttgaatagtgggctcgatcgcgattggatatcgtcctggaatgaccccagtcttggggtagtcttcctctgagaattcgatcttctgttcggaccacttcatcttgggcgcagccccctgccatgtcgaacaaacttcgcgctccactttcttgtactctcgcttcgaagagtacgccatagaacctccgaagatgtgcgagacatggagatcggaatctgggtatgctgagtccgagtcctgagtggctgcttccgtggccttctcgactacacgtacttgcttgcccttccccaatgcgagttgctttgtgagtgattttttgaaaacgaaacaagcttctaaggagtgcttgtccgatttgtgtatagggcatcatattttcttcatgtcgtcgccttatgggtctgggtgtttgggcaggtccacgtattctgctgcgaggacttccgtttgagctttctttttcccactcttgcgactcttcttcttgcttgattccgatgcgtctttggctggtttcttctcttcggcttgtcgttcttgcgtctcagtgtgtcgtccatgtgagcgcatcgatcgacaatctcgaatagttttcgagcagttgttatccgtcttgtcgccaactcctgggtggtgtagtgatctctgacaccagtcttgaaagcgcggatcacggaggcatcggtgatctcggggatcgtatttctgcactcattaaagcgccaaacgtagtccctcaatgattcgcccggattctgtgtcaacgcgtgtaggtcgtcttcgatcgcgtggcgtttgtatgttccttggaagttagcgacgaactgctgccacagatctgcccatgaagaaatccagtatggtgggaggtggactagccatgaatgtgcagatcctttcaacgtcgccggcaaataatttgccaatgcgttgtcgtctgctccggcagcgtagaatactgcggaatagacctgaaggaactccttagggtcggtgctcccatcgtacttctctattgctcccggtcgaaatctctcaggccatcggacatctcgtagagcacgactgaaagctctacacccgccaccgggggcggcaggttgtcggcgatcgtatgtcctccgtggatgcatgtctaatgacgaggatgatgacgatgatgatgagtcacttggttccggggtacgattacgaggatgacttccgggttctcgagaatcttgtcgtcgcccaccgttgttgtcccggcgccgatctttgtcgtcgtcatcgttatggcgacgtcctcgaccagtatcgcccggcatccgctgttcgcgatcatggcggttatggcggttatcatggtcttggttctcgctcgggtgtcctcctcactcttcgttctctcgacgtcgcgaagagacgcgatgccgggaacggtttttgttctcacgcgcgtcatgcttctcggcggacattcaaatggtcatggagatcactggtgccgcgaggtggaggagtggcttgacgaggtgatgcccgttgcccgggtagttttccattggcaccgcc

SEQ ID NO: 41748 - DNA, 29869 bp, Oryza sativa
gggccaaccccgcacccccccctcgggtgtgcagggttggccgggggctgccacacatgcacattctcattttctcttatttcagtatttcaataaaagcagtttcaaattcctaagggctgtatctgtgccgttttttcctttttgaagaattttgacttgaaatgaggtcacttgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcctttcgaggactgggacttgggcacgggcccttaaatcaagctaagacgcaaaaagaggaccacggcacagatcatcctcatctcatccgcatagcaaaataaaattaacacaaagaattttttcatcatttttgattgcagattataagttgatttatacaaaaaacaggcctgaaggccttagaagaaaggaaaagaaagaaattgaagattggcgggggcctgggggctcaatccgatgcgcctgggtcgccggcctcgtcttccacgtcgtctgcaccgctggcatcgccctcctcgtcggagttgggggcgaacgcaagccgaggggccgagccctcgaagctgtggacgatgtggtcggcggcatcccggacttgtgcgcgcgcgctgtcttcagtcccaggtgggaactcgtccagcgccatccacagagagaagttggggtccctggcctgatagctcgccaggacgagctccaccgctccttgggcgaggtccctcgaggatgacttgatggtcttctcgagttcctcggggagctgctggagagccccggccatcttcgagaggcgctgggcaaggcctcccaggttggcggcaggctttattgtctgccctttccagaggcccgcctgccgaccggcgcgatcaagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcggcccgctggtccagcgcggccctctcggtgcggacggattccaaattgcggcgcgcctgctccgtcagtgccgcctcacggagggacaggctgtccgccaaccgttgcgcctcggcctcggcctcttcgagagcccgctcccgctcggaaagagcgtcctcgcggaggcggagtgcggactcctcttcggcgcaggcagactcgtgcgccgccagcgttgtctcccgggaggcgacggcggcctcgtggtctgccaggtccttcttcgcgacgcaggcgcgctcttccagcgccatggcgcgcgcctcgagggcctcctcacgccgccggagcgccgcttcggcctccgttgctcgctgctctcgggcggcggcggcatcaaggaccccctgggcggcgtcgagctttttctttagctccgcctcccagttcccgtgttgaaggcggagggtgtcctgcgcctcgttcatcaccgtggtggcgatgagggcagccccccgctcctcctccacctctcgagcgatctccgccagcgccgtcttacgggcctcaagatcagagacgtgccggcggtgtgccttgcggcccgcttccaccatggcctccaccgagtgccgcccttcctcgacacgcgcccatgcggcgtcgagctccgcacgctccgcctgcagggcctccacctgggcatttaacccatccaacaccgcggtgtttgcggcggctaaggcctgcagaaggggctctgcgctcagcggggcgacggaaggcgtggggaagagctgccttgaagaagacgccgcgcggctcggcccgccaatggacgcgccggcctcatcgcgggccacccccggacctgtttggtcctgggcatcgcccgaaggagtgggcccaagcgacgcgcccgcggcatcgtcgcgagccacccccggacctgtttcgtcctgggcatcgcccgaaggggtgggcccaagcgaggcgcccgcggcctcgtcgcgaactgcctcggaagtcgccgtcgcctcagcctggcgaacccaggcggcctcctcccgagcggcttcttcggcttggcgagctcgggcggcctcctcccgagcggtatcctcggcttggcgagcccgggcggcctcctcccgagcggtatcctcagcctggcgagcccgagcggcctcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatctctgaagcagaaggaaaaaccagaagacaaacaagatgggtaagagaaaacttgcttttgggatagaagaaaagcggttgtaatgagcgtgggacgaacctgcgagggggtcggttaaatgaccactttggaggggaaatcaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagcttcctcttcccccgggcgtcggtagggcggttgctccccgagcccccgacgcggggcccagaagcacgaccccctccgggggtagattgatcccccttgcggctcccgcctgcgccgtcgtggcccttaggagcctgctcctctgaggccccgaccgccgccataatggtcaagatggaggcgcggtctggatcgctgcagagggggaggattccgtgggggatgagggacgcctccacggagttgagattcagcacccgttggaccaatatcttgaagtcctcaggagcccaatcccatctgactccctggtgggtccgaatgtagtcttcggacccggtgtactcccaggcgccccgagcgcgccgctggagcggcgcaatccgacgacggaggtagtcgccgtacaccatggcccctgtgagcccctgggatcgcaggcccgcgaggcggtcgaggacggcgtcatagccatcccccaaatctaccggcgcccgccagctggaggcttgcgccgggggctgactcggaagtcggaggcgcgcttcgtcggcgaggggggtgtagaaccagtcgctcttccagtcatcccacttcttgcggaggacgcagggaatgtagcggttcaacaccggcccccgcggcaggaagtagcagccgccaaccaccgacggcggcgacaccgactgcacggtgaagaaccaccggaacagccgaagagatgggcgcaccccaatgaacatctcgcacagatgtgcgaagatggccaatgtcatcactgcgttgggggtaaggtgcgccatctggagatcgtagaactccaggacatccatgaagaaagaagaaaatggcggaaccagcccagccattgcaaaggggagaaagaagacggaccgccccgggtagtctggcgccgggcgtccctcgcccagcatgactatctcacggccggtggcagactccggcatgaagcggcgcggcaacccagcctgcttctcgctcgtgatgcgggaaggcggcagcacgctaccatcaagcagtgcggagccccgtgccatggcgccggacgaagaggagatggagagcgagcgcgtgtggcgaaagaagggtgcagggaagaaggagttagggcgcaagcggcgaaggcaagggaaatgatggcgaaaggaaggaagcaaatcccatcctcagtgcctttatacccttgccaacgctgtgcccggctcctcgtttctcgcgcccattatttcgccccctcgcttctcgcacccacgcttccactaaccccattcgcccgcttgcggcgcgtgaagtggatatgcggttgcggcagtcgagatagatcgtatcgtgcgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgagttaggtgagcacagcggggctcacctaaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaacctcgatcgatatatgccaggcttcatcccaaccattacaagcaagatgttgtttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatctccgtccatttatggagagaagaaaagtccagtttggaaagggaggggtgcatgtggtatccccttaaaatataaaaggaggaccttgcccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggactcccggtgaggagccccgctctccgtcagggtcccttttataccgcgggtcagttgatctccaagtagaactcggagatatcgaaccccacacaatatagtaacgacccaatactgtccgagtaggactccttccatccgtggactccgtttctgttacgtgacggattacaggaaacatctgtatacgcgcaggtataccgtatcggtatacaacatacatccaagggtaaagggtatatcttatccgtaactctgacacatttattactaatatgaagagaaaatgaggaggggaagaaaacaaggaggatgaaggaacactattggtttagttaatgactacaaataaaaagaaaatgatgtaaagtggtctactacaccactctaaagctaaattcttttagggataaatttttgactaaattaacacttatttagggacaaagtgagtactcgataattccttaattatatgccacttgttacctcacttgacttatacatacggatctatgagagggatacaactaaattttttacattttaaatttatccgaatgtaaaacttcaatgaagaaggaaagatcagtaatttaaaaatgcataaaacattgaaaatacataaatacagtaactttaagcctatttctattagaaaatatgttttctctatcattggggaaatagtaaaaacattatatcgattctgttcatccctggaacatggcatataatatctcattatttttagaattattttgaatatttctacaattaatactccctccgtccctaaatatttgatgcctataacttttttaaaaatgtttgaccgttcatcttattaaaaaaatttaagtaattattaatttttttcctatcatttgattcattgttaaatatactactactactcaagtttttttaataatattcacaaaagtttttaaataagacgaacggtcaaacatgtttaaaaaagtcaacggcgtcaaatatttagggacagagggagtattactcaagcataacattacttgaaatgggaaatctatattgaattacaaaccaaacttccttttattactccagttatctatttatatttggtcggacacctcaactttgttgacactgtttctttggcaattatttggttcattatcatagttattatggctagccacaagttttactcatagctaggaccctatatatcaaaggtttgttgtagtgttggctgagttgcggctagcaaaatgcatttttgaaaaatgacagggtagcaaaatgcatttttgaatactagctgcggcaaaacgtaaccttgcccaaggtgtggtttgacaaagtaaccaaacaatatatatgccacggtttgtgatgggtccatgttgtaagattttgctcatttaattaccctttgttcctcgcgtagaaccactagtaacaatccaaatgttgtcatctgaatacgtgataccttccgcatagtaccagctagtatggctttacctccaagaatggaaagttcatttttcgaaaagaagagcgaatggatgtattgtgcacattgtattttattagtgttttaaaatagctgtataaaaatcaaatggaagggttataaaccaaggtaatatgactatgtgttcgcataaaactctctcgtttctaaacttggaaactaaagtggctcaatggagaaactaaaattgaaatactccccctttcagatttaagtcgttttgattcgatcaaagtcaaactatttcaagtttgattaagtttatggaaaaagtggtaatatttttaattcaagataaatatattataaaaatatttcaattgtgttgtaaatattaccatatttatctacaaatttagttaattttgaagtaatttgacattgatcaaagtcaaaacgacttatattctgaaacagagggaatagaaaactatcgtgtcaacaaaattggtttaagcatggtagcttgtaggttgtgctaacaaaattgcaacacgatgtggtgcctacctgcatttatctataagcttgtaagcaaaaagatacaccttttaagatgaaggagattgggcaacaaccattccattacataataatttgtttagatctccaactttgatctcatgatgaatgatatatagtaatataatcatgtagtccgtgaaatctatatactcctataaaaatgtctccggcatgagatggaaggaacaacaaacaatgaaacccacaacacatatgatttatgctactcattaactaaattacttgtagcgtgccattcatggaactaggtaaaataaaacaaaatgttggattgaaccaacaaatcatcatctgcgattatgtagctgttggtttgatttcacattgcacctagggcagtcgaagattgtcttagatactcaaacctttaatctcacaataaataatatatggtaatataatcatatcatctgaaaagtctatacaagaatatctctaacatgggatggaaagaacaactaaacaatgcaacccacgcacatgattttaccccacccatattaatggaactaggtaaaagtggacaaaatccttgttcagatcaacaaatcatcaccctctgttcagttacgtagcggttggttcgatttcacattgcatctagcctaaggtaacgtttggaacagagtactcaccatattattcatacgaattatctactttaaatataggaaggaataaattaaatattttgagacataaacctaataaagaggttaaaacaattgatctaaacaatatagtagaagaaattgtttttcttgagaaatactacctccgtcctattttaagtgcagtggtgagttttcatgtccaatgtttgaccgcctatcttatctaaaatatttatatttttttttaaaaaataatcacacctaaagtactattcatattttattatctaataacaataaaaatactaatcatattttttttcaaataagacggacagttaaattaaacatgaactgtgtaaaatgcagtctttttaggacgaaggtagcacttacttctaaaaacgtggagcaaatggttgtcataatatgatgaataaagtggaaagcttttacaagtacggctagtgcaataattcctttgagaaaaatataattgtagggtcaccaagaacaacaggagctagcacaacacatcgcttggtttagctcagtggcagtgtaggccgccccgccggcgaccatgacgcgagaatcaatcgagatcctggtcgacaccacatgccacatgcagcataagcgaatccatcaccaagaaatattccccaaccaaacccaggggaagaaaaaaataaaataaaaaaacgaagtgagattaacttaactagtcaagttttttaatgacagaatcagcccatccaagtttacattctagttttaacacggatgctttcatgtatgattaattatttttttactgataggatgctttcatttatgattaattattcttttactgatagatgagttttactgatagatgaggcagccatacacctgttgctcataggtgcagagagtgcatgtactgtgtttgtttaaaataaaataaaataaaataaaaagcctctttcctgaaaatgtccggtccagatgccactcggccacagggcagccacagaaaatctcgcggggaagacccccactccaccttctcttcctccctcgacacctctccccacgttacgctgcctcctcctcctcctcgcctccctctcgtgggcgtcgtccccctccgccaccgccgccgcccgccgcagcagccgcagaaggggactccacctcctcccggatctgctcgatcgcccccgattctgtagcttctcctctgctcagatccgcccccttgcttttcatccagctcgtggcacccgagatccgctgccgccgccgccgtctctgcggtcctcctcccccctcgccggtggggaaccccgccgccccgaagcgcgttgcaggtaacgatgctgacgtggcatcggctcgcttggtgctctgcttgctcgctcgcggcgcttcgattccggggtagctcgactttttacggcctgatgccggaaagggcgtggcccttgtagctcaatcgtgatttccagattagagcttagtggctatggcttgcttgcttgctgctaggggacgacgagtgtataaccctgagctttgtgctagctcagcttagtagtattggcagagtgaactaaaggcgttagcgattcttgtcatggatggggcgattagcttgatcggagtgctgagtttagaaagaggagtttggagtatagcccgtcgtctaagtaaatgcctcatgtttccttgagcttgggtttgctgaactgaactgaactgaacggaagatccatttaagctaggacggtgtgatcgatcgttgagttgatgaacttggtctatggctagctggcttaagcgtggccttccaatcagtttgtattctcgtgattttctttttatgttctctatcagggcaagtaggttctgtagtttctctagtgttacagctgttggtttctctttcttaggtgtatacatgatgctgaatatgactaccttttatttgcagcgtgtactactgccggactgccaaagtacgcttgctgctagccatttcggtagcttttgtggtttctacttaactatcgtgtttggcaatacaacaccttggaccaaaggatgcttgaaagatagactggataattaagactggatgccaaagtacgcttgctgctagccatttcggtagcttttgtggtttctacttaactatcgtgtttggcaatacaacaccttggaccaaaggatgcttgaaagatagactggataattaagaactatattggactgtacattcgcctatagacttagtcatgctgctggttgttctctgtcgctgctacaaggtgttcgtgctattgccttctgcttctgtgtgctatggtaattgtaactctgtggttattgcgcatgatgctctttgaatttgagccatggagcatgcaaggagatttccaacagatcccaaagaatataaattatgtgaggaagttggagatggtgttagtgctacggtgtacaaagctctttgtatcccacttaatattgaagttgccattaaagttcttgaccttgagaagtgcagtaatgacctggtgagtgttttgtcctttgttcattttttgtgccaaatttcattttgtatagcattgccttgttgatctatttcccccaacaaaataatttctttttttacaaaagcaattttttacttgtattatatactttcctaattttaagcaatacaaatttcgaatatttatttgttttgtcgattctcagatgctctttgtgaacatgggttcacttttttcttgctaatcgctttctactgtactgtcctattactgctttatattcttgacatgcatgacattctattatgcatgaaacaagaagagaaacattgatgccaacaaaaataaatagatgtagctcatttccaaggatgtctatctcaacagaaggctcagtttgttcttgcagaatatttatgacatattgacatgattcgatcatttgagcagaacataccttgtatttgttaggggccattgtagtactattctaagttgtcactgtaacactttactacatgagagttaaacctttttaattgtaagttagttggatcagtgtttgtttagattctttctttttttaggttgcattattatggactcccctctttataagaagaggttgtgtgtcatttggattaagtaatggaaatgcgttagtttagtcttttcaacctgcacctgacattgcctggtgaaggttgtctgtcattcattaagtaatgaaaatgaattagtttagtcttttcaacctgcacccggcattgcctggttaccctctgtgtggtatttaccctgatgaaccaatattcaacacattttattttaaacatcaaatttttgagtgagtttctactgtcccaagtagaatggaagcacacatatgatacaaatttgtcaaaatatttacaagttaagcataacataatatccatgttttactttattggtgaaatgtggtagtgatttttatcagagcttgcgcatgctttctcattgtacgcaccttatgctgaaagtagattaataataaatccttgaagagtattcatgaagagtcctgttgaaaccaacaagtgttatagagtatggattatggaatacagttattagacagacatggtactgccaaatgaatagaatacgaacaaataattcgaattatactaattttgtgtttatcccaatatatgtttatatttgataattgatgcggttagagtattaaagatatcagatatctgcacacgttgtattgtcatattatgagacttacttgtaatactctcccgttatgatgtagaatccaatgaatgggatgggatagaaattcttatctgttctagagatgcaaggtagacaaagtagctggttttgccatctaattgggccgctagttatcgggctgattcaggatcgctcagtgggtttctgggcttagttggggattaccagtttaatcaagcaattgcatggaattggtcggttaatcaggtgaggtggctgttttggcattcacacaagctaattcctttccaattcgctggtttgtgatgttctcctctgcgactctgcgtacttataagcgtcaaagtaagcagccattctggccgatttttacgacattggttgagactaggcttcctacaatttggtcattctttccagaacaactatttttctaccttcagtgatatggtttgagtgctggatatcaggatatgttattcctgcaaatggcatcgttcaaataacttatcttaaaaaagtttgacttgtgatctttaagtgaactaacttttgtaacaatctaaacttccttacttgggacatggcttttcgtgttaagataaaaaaaattgtcctttgaaatatagatggaaatgttataagctactgagaaagtaacatttctttttgtgccacaagtgcatagtatcacctccttcagttcattgcttttcctgtcactaaacatactaacttcaaatcagctgcttacattttggtgagcttgtgtttctatccttacggaattgccattctttaggatgggataagacgagaagtacaaaccatgagcttgattgatcatccaaatcttcttcgagcatattgctcgtttacaaatggtcatcagctttgggttattatgccttacatggccgctggatctgctctgcacattatgaaaacttcttttccagatgggtttgaggagccagtcattgcaactcttttgcgggaggttcttaaagctcttgtctacctacactcccaagggcatattcacagagatgtaaaggtaatattgaatctccaccattctattagagtggaagcataatatgtagcagcacagaatttgcataatgcgttgcactggactcaatatgaaattcaatcacatttcacctgtccatgttttagacttagagacattgggatgacacatgattaatggagagacatgaggcatcacatttttgttgctcctgtgttatattgagggtacagctaattgacagccagtgtgatttaaggcttgggaacaatcactgactcgcatatgcctcaccttgggatggttatgcacccagaagtttagtgccacatctgaatcttagatgggctttattctcaaaaaagaatgaaaatacctataatggtccaatattatagtaattattctaaacaaagtcccccacagagtactgttcatcttaatattatgtcttaacaatttgtactaggctactagcagaagattgggcatggattctatgtgaactaaaagccattagtggatatttagatgtcactagtttattataacctagatgtttaaacttgtttaattacttttatcatatgcatgcataccttctgattgtttcacatgactaatcatttcaggctggaaatatcctaatagatacaaatggagctgtcaagctaggagactttggagtgtcagcctgcatgtttgatactgggaataggcaaagagcacgaaacacttttgtagggaccccttgctggtgaatattctgctgatactccctccattcacttttacaaaatatgaattaactttgtgtggtccttttaattgaactttgaccatgattgttccagtatgtagttattgatacaaagtcatgaccatttgagatcacattgaaatacaaatctagtggaacaacttttatttcactaccctacaggctacatatgttagccaaattgttgaccaaaaacttaagaagtttgaagtttgaatgccagtcgttgcattattatattttatgtaaacatatttatgttaagattgtgtaaccccatactttttgcaggatggctccagaagttatgcaacaactgcatggttatgattacaagtaagttcataactggcaatctaaatctgatttgttaagctaccacaactgattaagttttccttttgtcatcatgttcaaaacatagagctgacatttggtcctttggtataacggcattggaactagcacatggtcatgctccattttcaaagtaccctccaatgaaggttagcactgaagtatagtttgttttcttattcttaataaatttccatgaggttagataacgatagcggtacatttatcacattgtaggtattgcttatgaccttgcaaaatgcaccaccaggtctagactatgagagggacaagcgattttcaaaggtttgttgtattcaccatgttccttttgtcgacgacttagactgtatattaatcataactgttcttttttgtagtctttcaaggatttggttgcaacttgcttagtcaaggatccacgcaagcgtccatcttcagaaaagctcttgaagcattctttttttaagcatgcacgtacagctgaatttcttgcacgaagtattcttgacggcctccccccgctgggtgaacgctttaggacattgaaggtgcaaatcactatttatgagatggcattcaatttgatttgacttgtctaatctttattatactcaattgcagggaaaagaggctgacttgcttcttagtaataagcttggttcagagagcaaggagcaactatcacaggttagatgctgctcttttgttctaagaaataatattgtcagaatactactctctctgtgactctgtcctaaaatgacttgatttctagccattccatggagtagtcagtgaaattttctagagatctcatgtcattggagttaacatgtgatgagagatctaggttttgcctatgttgaagcaaagactagagatagatatatatgttaaagttgttgatctgttcatccacatttcttgatttaatgatatcattaaacaaatagttttgctagcttgtttttcatcatttcctttctacatgtgctagattgagttgagttttattggatttattaactaaatggtgactgcatttctacaactgtggcaaatatatatatttttaaataataataagaactatagttagctaatagcaagctcatattttgaccataagtaagctcatatctcacatttatatattttactgtgtatttatatattttactgtgttgtatagaaatgacttattgtagtcatgaattgcacggtgcatatagattcaagtattattgaccaataggctattactgacttttgcttttcagaaagagtacatacgaggaatcagtggttggaacttcaatctggaggacttgaaaaatgcagccgcccttgtaagaattcgattcgaagtgctaaatctttactactgaaattttgaagtcatgagctataattaagccgtaacttttgtttgcagtgaaccttttctaatcttgaaattttgttcttccgcagatagacaatacaaacggaacgtgccatttagatggtgttaacagcaaattcaaggatggtttacaagaagctaatgaaccagaaaatatttaccagggacgggctaaccttgttgcttctgcaaggcctgaggtaccgaggtcccatcgtcttatttatgcaactaagaccccatgaactagctggaaacaacaaatctattgcattatagctttactctaaattttacaggatgagatacaagaggtcgaagatctggatggtgctctcgcctcttctttccccagccgcccccttgaggcactaaagttagtagtaaatccatgtcttttgcaacattttccaatcatgtttgaagaacctttgatattgtggaatgatgtggtttatagcttattgtttaaataatctacttgtcatgtttgaattgtcagaaccctgaacaataatttccttgctttttgaaccttcatttacattagatttatcaatatttcgcagtcaatctgagagtttggtaacttaaccccaatcaggtgatatggtaacaatggagccatgtttcaataggaaaaagaaaatcttaattgctaaatatattggtgtgaagtatcttaattgcaccacatttgtaataatgaatttgttgtgtactccttccgtcccataaaaaaccaacctagtaccggatgtgatacatcctattactatgaatctggacatacatctgtccatattcgtagaaatagaatgtgtcacatctgctcctagatttgttttttatgggacggagggagtagcttgcaaataaattagtacttgtagtgtgtgaatcctactgctccattctgaagtagtataattttgaactggagtggccaccttaaattgttttggttcgctgtattgatgtgctgtcaattttgcattttttgttctcttcgatataaaaaaattgtgagctgtgaagaatctttactgactacagtgacacagatcttgctttgatgtttgtggggatgatgatccccctactgctactgatttgagggagcaaccaaatatggaatctacatcacctatgcagcagttccaacaaattgagaatcataaaagtgccaactgtaatggtgaaagtttggaaagaagtgcctctgtaccatcaaatttggtcaatagtgggtcccacaagttcttaagtggttccctgatacctgaacatgttctttctccttacaggaatgttggcaatgacccagcaaggtgaattaatttcctttgttttctttatttattgttgaacagataacttatgattgtgttttcatctcaagtctgaagtatgtgcttaacttagtttaagttcgataatccccccaccccactcctacaaagagaacatataaacatgccttaaagtgaacagatttttttttgaatcaagtcattgctagttaccaaccaagcacaatgaccactctatttcgttgatgcaaactcttagatgatgcaaccatttgcagtggcatacagcaggctctgctgcagcacctagctgagcgctgagcttgcctagctcatgagtcatctcattcctctgtcaatgtgctcacttgatccgctgccacaggaggacaagttccactgcatcacatgctttcttttttccaaatcaggtcatcacgtgaactagtcagctgaccagcttacagttttgttggtggttagcaaacttgattatccaagtgattatttgcattaagctttgttcagttcaaaaatatattttaaaatgatttgatagattatttagcgcctagaactgaaacagtgttaaactagctcagtttgtgtggaccagctctctctgtgtgtgtatcaagtgtgtgggtggttgcatgaattcaagggttaattctctgtgttctgcagttgacagtctagtatttttttctttgattccttgataaatcaatgtttatagaaaacaagatggaccaagctgtggttctttttatttaagattaaacgagttgtcaggtacagtttcaaaagcttgtgcctagtgcctatgatactgtgctcaccttgtgccacaactttgtccctgtcattctgcctggtttgcattgcgatccttcatcatgctacacatggccaaactaggtcttgtcgagattggggatggtaatcctgctaggcggaaacgaaaaggatcagttctatacacatggattttacttcgcccatatgagaactgtagtgttcacttcaaattttgaaatacctgcatgaaaaatgtgggatcttagcatgcatttttttttatgctagtgaagtcaaactattgaaattggtcattattgtgagaagatttatattgtattgtgcattttagatagctatgcgacaatctcaattcaatttgtataggcaaagtactctttgccctgtaaaatcatgtttatgatatgctgaataggctaaaaaaactactatgggaatttagattggacctagaaaacatgatagaaccaaaaaaaaaaaagaaagaatgaagcatggatttacatgtacatatttgacaaaagtaacacttgtaaaaaaaacctttggttctttttcgtggcctcctactgtagtcttaatatttcactctcattttgcttcttatcatatcgtactaacatatcccatattgtctaatattctagtcggtgtaacacatgctattttttttttgcttcttttctgatttaggaatgagtgtcatcagaaaaatacatgcaacaggaaccgcagtgggcctttattccgccaaatgaaagatccacgcgcacatctgcctggtaagataatcatgaactctatcaactaacacgttacagtttttctttttttagaatagcaagaaaaagctttaaacctgtctcttttatttgtcattgatgtaatttggcttgttatgactgtttttgagagcagttgaacctgaggagcaatccgaaggaaaagttatccagcgaagggggcgttttcaggttacatcagatagtattgctcaaaaggtactggtttgttaattgagcagtcacatgaaactaacatggagggacgtcatatgcattgactattttgatcaatactccctccgtcccataaaaaacctagtaccaaatgtgacatcctagtactacgaatctgacacatcctagtactatgaatatggacatacgtgtcacattcggtactaggttcgttttttataggacggagggagtattaattaagcacagtatgttgcagttcaggactttgatttttaattatttatatttatgctaagcatgcctttaactgctacaatttatattatgtcaaaacatattcgaatatcatttaattgatacctgtagtgattggcaatgtttaagacttttgaagtggagggcaagaggacacaaatattttcttgaaacttttgtttgtttcatgattttcagctgctatatagcaatggctgctgaaatattatttgatcagtttgctagttgacttgcaaagagacaagcatgttttgcctgctctctgactgcaaaagaaaagatgcagaaatgggattctgttttctgattcatgttatttattgctgttccttcaaatttatttctcacagtccctgcatggtaatcctcaaaaggatttatcaccaatgctattctgatatcaatatttttgtcaggcttaattagtaaagtgcaaatatttttttcacattagtttgacaattacaaatgtcttaggtagcttcatccgcaagcagcagtaggtgctcaaatttaccaatcggagtaacacgatcaactgtccatccatcgacaattcttccaacactacaattcatgatacagcaaaatactatgcaaaaggtattcacacacttgttatttcacttggcaagaattgttcagaattttcacaattcttcgttttgacaggaagtgataagtagactgatttcttcaattgaggaaatatctggtatgtatgataaaattacttttgttagactttaaagagataatttcattagtatactgatgttatggttttaatggggcatgtttctgacagatgctgctgatgcaagtacaactggttcatctcaggtgtgtatcacgaactgtgggttatactgtcatttggtcttcaggtgtaaactttagatagttaagcagctcagagataaccatgccgtgtggtagtaatttcaattttaggttcattttaatgttgcacaaacatgaggtttcctcctatgtgtttattcagagttagtataataagtgcggatatatgtgcagccatctggagtgcatttcagagagaaggaactgcagtcgtacatcgccaacttgcagcaaaggtataaaatatttcttgtaggagtaactttttgcatatttatgaatacttgactgaagtttatgaaatatttccagtgtcaccgaacttgctgaggaagttcagagattaaagctcaaaaacactcaggtaaatctatttttaaacttcaatttagatttggaatcatgaacaccgtgttattttgtctaaatattggatgtattctctacattacagctcgaggagcagatcaatgcattgcccaaaaaagatgaaaggttacgaagagaggatacccgacaacaatgatatgcacaatgcacttgtaacccccgctgtaaaatcagttccccaattttgaatttggttagcaaaattatttgtattttgttcgaagtcaggcctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggagtcgtataagaaatcatttttaaaaaactagcaagcaaactcctaattaccgctcatgattttttagaataatatatatccaagcgaattcctacagtgaatttcaacttaactaaactgtgtaacaataacaagattaaaatattaaaataactttcacccgttgcaacgcacgagtattttcctagttatatcaatatgcgtctgatccattacaatgtgcgggcatataactagcaaaagtaaaaaaaaaaaaggattgtttgcaattgtggaggtagaactagttcagtaattcaatacgcttgctagcaaagcttgctttgtttttgatagttgcggcatgtcatgtcctgtcgtgattttttttacagggagtaactatatttacggcgtcatattttttataaaaaaaatagtcgacatgtatttacattataagtccataaattacatatgtgattttagtgcatctacaatgcaagtcctaaaattacatatgcaagtcctaaaattacatactaattatataactaagtgggggtgtaactatggtgtaaatttatataaatatataatggcttgtagttgttgcgcaacagtacgtgcgaaagctactcacacgaagcagcactaatcttggaaaaaatctgaccgaacaagaactgactgtaatgaggcagaaaaagtggcgagacaattctagcaaagccgttttgttatacaacatttactggtcgagtactacctttactcttttagcattaatatttaatatattcttaagtattgcaaaagaaaagtattgaacttgtataattaagtgaaagtatgcttcggttacatgagtataattaagtgaaagtatgtgaaatgtataatatgtggccttaaatttgaaaattcatagagacaactggtgtattttaccatgaatagtacttctctcttttttttttcggggatatgaatcgtacttgtcaaagagaaaattcaagccacagtactattaatgagattgaagaacactattaataggaaacccattagaaagctagcataatatatcctgatagtaccggacaataccttgtgctaactcgtgatgcttcactgagaagtttggtactggtcgagtactacctttactcttttagcattaatatttaatatattcttaagtattgcaaaagaaaagtattgaacttgtataattaagtgaaagtatgcttcggttacatgagtataattaagtaaaagtatgtgaaatatacaatatatgaccttaaatttggaaattcatagagacaactggtgtattttaccatgaatggtacttctctttttttttcggggacatgaatcgtacttatcaaagagaaaattcaagccatagtattattaatgagattgaagaacactattaatagggaacccattagaaagctagcataatatatcctgatagtaccgaacaataccttgtgctaactagtgatgcttcactgagaagtttggtagattcagaatttctatttcgtgaaattaatatattggttagcatggaggaaatcgttaatgatgccattgtggcctttcaaggtgagctagctaagagcgctgatgaaaatggcaatgatgctgacggaaagggcagctggcgtgtggccaaaatgaaacatgtagcttgctgctacattgatggggcaatatggattttttcctatgtatgtatctctatgatggtgtttgaatctcccgaagatgaagatgaagattaagtgtttcacgtaaaatgaggtggtaataacatgtgattaattaagttttaattattacaaacttgaaaaatggattaatctgatattttagaacaactttcatataaaaagttttcacacgaaacacaccgtttagcagtttgaaaagcgtgacactttaatccagaattttagcagtttgaaagattcgaacggggccatgtatgcaactatcatctgtaggactatggacctgttggctgtgtgctaaaccatatgtggacacgttgatccatggtatgaccttgtcatttgtgtgcgctaaatatattataggtgaactttatgtatgtatgcacctgttaatctattatatgtgcaccttcatgatatatgaaccataaatgttatgttttgtattttgtcggtgtgtcatatttgtcttgttttttttgtcagtttttgaaattttgctacctattaatcaagctaatgtggtatgtacatgagagcaattatgaaatcatattacttaggtcataattatcgaatcatattacttaggtcataattatgaaatcatattatttaggtcatagcaagttttgatgcactatctaccagttttactttggaaaaagctactagacagtttattacgctcatgttgttcatgttgagacgcccaactagacagtttattatgctaggttgagtgagcttctcatatgggtaagtttaactagcatctccgtgcaaactgcgcatagctgatcatctaagtgccttatggccctattgcaggtatgcatcagtaattgagctctctcatttttttcattcataatgatcgatggttaagatgatactatctatgcagagtctgatgatacaactgaaccttagtagtattttcttagcattcagttcttttttaacctagtagtgtttttctcctcatatatgtatgcaatcatatctccatgcacaggatgtttttcaaacatggttcatatgcagcaggacaaactgaagcacaaattaatttaggtgcaattgtaaatttaccactgctttcaatcgttattgcaagactgccactagaaaattgcaaaaataccactagaactgttattcgagtggcatctttgcaaaattgaaaaaaacggtggcaaatttacaaatgccccattaatttagaggcttgctaacccacggtataccgttagaacgatataatcattagtcggacacctcaaccctaatgcacatggcgggcacgcaccagcttgcgtgcatgtgctagtgctggtcgtggatactgtatattttttttggaagcaattcacatacacaaatacactagctaattactactctgcgcatctgccatgcatgacatgacaagtgctcctcactcatgcacccatagattatatgaatgcctatccttttggtcacacataactacaaactcctctataattgcgtgcttagctatatgacatgttattgttattatagctatactcagtggttgggctggtacctcagtatcttatattatgatactattttttacatgtcaaaatatgattatctataatagtacctcgaaagtatcgtaaagtatctatcatgatacatgtgggtagcaaaccaagcacatatcagctggtatatgtgggtctcagttttaacatatacccagtctgataccaaggtatcacgtatgatacctattatctctggtatttgtggtactaagcatgatacatatatgtattatgttgatacctgtaggtaccgggtctgatacttatatgtactagacataatacctaggtatcggtcgtgatacatgtagttaccaagtctgatacttataagtatcgtatattatacccaggtatcagtcgtgatacatgtaagtaccagacatgatagatgtagataccagatctgatacttatatgtactagacatgatacctaggtaccgatcatgatacatgtagttacgaagtctgatacttataagtatcatacatgatatctaggtatcagtcgtgatacatgtagataccagacatgatacttataagtatcatacatgaaacctgggtatcatgtctggtacctcgggatacatgtaggtaccagacatgatacctagatacgactcatatactcacgtgtgggaccttgaaacaagaccgtttatcatcaggtcacataggatcacatatagcaatagagaatcaagtcattttctcttgctcatggtcattggcaactttaacttcgatttgatgcaaatagcatcatcaaggcaggagtagtcattttttgatcgtgacaatagtagactagtagtgcatgtactcctcctatactactagtgcatgcaatagtatatggcaggcagtagtatagtacggagtactactagtactgtactagtagtgcatgcgcaaagagttaatccgtggggctcgtgggacccatgcgggaggagagatgggtggttcatttgcgacgctgggttggacggtttgatgccgtgcataatttgtactgtcctaacggtataccgttttatagcttttctcttaatttatatccccacacctcagaatcaggaggtaagtctttcattttcatctatttctgtacatacggtttccctaattaatctgcatcattgaatcacccttctttggcttcatcttcaattacttttagactttattggtttactttcataaattgataaatatctttggagtaatttaatttaatctaaaattaatttacatatatgataaaagtaatatttacaacatacatttttcatcgaaatataatcgtgtaaaatcttgttttaaaaatttaattgtaataaatataacggtgtaattggattaaaaaataatacctagtttaaaagatatactacctcctttttaatatatgacatatttgactttttgtgtccattcgatttattaaaaaaaattaggtaactataatttattttgttgtaagttgttttatcactaaaagtattttaagcatgatttatgttttatacatttgcataaatttttttaaataagacgaatgatgttaaaaatcaacgacgtcatctattaaaaacgtagggagtaagttttttttagctgcgctgatatcctttataactaaacagcatgcatcaccttgtctaatcacgaaccagtcgcgctataagactaatataagtgcgcgcacaataattagattttaccgtaacaattatatatatattaaactcctatgtttggtacagcatcaatacagaaaccgatcgcccccgtcaccgttgtgcgctgaaggaaaaatcagaatcggcgatgtcggccgacgaggatgccatccacctcctgtccggcgggtcgtctagcagctggcgagacgcagccgccgccggcaccgggtatatgtcctcctccggtgccggtggtgaggccaccgtgattgggctcggcgggtcgtccgacctcgccctgtgatcctgcagcaggtgcaccggcgacgcggaccggctcgacgccggcgtcgcgaagtcgacgctcatctgcgccaggaacgcgtccgcgtcccggaccttcttcttctccatcgccttcttcctccagttcatcagcgccttcatcgtttgctcctcgaagattgtcttcttcatgttcgatcccatctgcaagtgatggccaaaacacataccaacacaaagggcatctcatgggttcaatattgtggaaataaagaaaagacattttatggggactggtagtgaaactgaaatttcgaaacaaaaaaaaggttttggactgattttgaacaaattttgcaaaattccaaaaaaaaaccccctccttttcttaatagatgatgctgttaacttttggacacttgtttgaccattatcttattaaaagaattgtacaaatgcaaaatataaattatttaaaaagtacttttagtgataaaacaactcaaatgataattacataaatatttttaataagacaaatggtcaaaacgtgtgtctaaaaattaacagcgtcgtcaattaagaaactgctaatagaatttgtgaatggcttgttcacctgtgtgacgagcgcgtagagcgggaaggtgatgtagctgcatagcacctgaagagagatccccacaatgacttccacgatgctcagccaaatattttcatggaagcatttcttcagaccaggtgttgcctgtcacacacaaaacaaccagatcgatgaacaagctgtgtcattttttgtctcattagtcagtgcatgcatcacacttaatttgcttaagaactgataatggcaacaactaagcaagtagcatacacaccatagtccatacgaaatgcgccatctgaaatgcgttctggtgatcatcgatccgtcgtcccatcgatcagtagccacaaatggatggatgctatgttagttaattaggtgttaattgtgaaagataaagtactatttgtagttgagcagcaaggtttaggttttaaacatgtacatggaagagtgtcaggtgtatgaagaacaagacccagtcagggcggttgaaccagaagtacttgttgcttggttcaaccacaggtgctccctggatcacagtggccctgtcctgtatctcttgggccatctgcatgatcaccatctctagcttggtcccaactaacaagacgatctgagacaacggtggcattcacatgaatgtttgttcattagttatatgatcatattaattttcatgataaattaaagcataattaattatgttaactgtttctttggacagggaaatttcgctcttacgatgagaggaacaaaagagatccaaataagtgtgccaagacctacacgcggggaaaaagttgaaaaaaaatcgatggtgattataagaccaattcagaacaaggttttgagagtaaaaaacagaatgaaataggacaaggattaccgtggatatcgaggaagagtacaaggattccgacgaaccacagagggaggctgcaaaaccagccaaatgtgtcaagatccacatacacatacacaactggagactaaatatgtttctttataaaaaaaatgttgaatataagagtcctataattaataaagcgaggacggacctgatgccaacgacaactttgaagtcgtcctccaaagacctcttgatgtatttgtggaagtcgaacttgctattctgcgacaaatgcgcctgcaaaagagaagaagctaaaaccattactcaatgcacactcgaaaaaaaaacctggtctctgtttgcatcatcaatgttgaattggtcaggtttgattagtatatacattgatgaagccttgccgcatggtcaggtagtccaccttggtgacggacccaaagaactgcctgaagaatgctacctaacaacaaacacggcatgaatattttttttttcaaaaaatatggattgaattggaacagctaggccagttgcaagaataaaaaacaagcatgtattcggagattgataactcacgatccatctgagcccaggggtgcttgagaatgatcccagatgccgcttcacgaacgacgtctgatgcgtgaacctgaatcgtgaaggatctgcatggatcgatcatatttttcagctgatttgctcctcctctttcaagacattatcataaaggttctgaaatgaaatagttagggagattcttaattcactaccgattgcgaactgatactccaatgagttggtctgtgactcccacttctccatttcttcatctaaaaccaagaaagaccaattattatatatttactggcaaattaataaattgggtttcttgtcgaaacaatccatttgaaggactgacaatcttgctagaactagagaaaacatgtgcatgagggacagaacgacaaactcactttgaggcgccctaaacccatggtgatgacgcagtaggtaacatggaacacggcgagcacgaagatgaaaatgtgcagctggtgcatgctctttgccgacatcagcgccaccttgccctgcagaaaacccaagaaaaatcaattatagttaaattagttattgcatcgaggttgtgcttgccggcagctggtgttattctcacatcgaatttcgagcagtagtccccgccgccggcgccggccaaggaccggcgatcacttgctgcttcttcttcgatggcatcttggcctgccttgcacggcaacaagatgttggcagccgacttggggatgcagatcttggagatgggcgcctgtgccacggtgagaagcagggatatgaagcccagcagcatcagctctgcaagtgcagataggacaagaaatatgagaactgcggtggttttctagtttgtgtgccatctaaataattatttttttaaaaaaataaattaatatatcattttacaaatatatacataaaattcaattcctaagttgaaaaaaaacaaatttaatgtatattaacagttaaacttgtttgttttgtaatttacagaagttaaatttaatcctacatgctcgtgaaatgatctatcacatactaatttgtattgttgttattttttaaaaaaatcataaccatttgaacagcatataatcaacgagggaatataaaaaaaaatcatgtaatgactcctccaccctaccttaaaaaaacgaattaacaaaataattttt

SEQ ID NO: 41749 - DNA, 12653 bp, Oryza sativa
  unsure (1)..(12653): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatatgcaagatagttaaaaaataaatgaaaatatggtgatacctgcaacgtgaccactggcgcaagcgtcagcaaccgcctgggtatccatgattgctccacgagcattgttcacaatggtcacacctttcttcatctttgcaatcctctctttgttaaacatacctctgaacaaaaaagcatacaaattcagataagacaatgtgctagcacagaaattttggaacaataaacaagaacgcaatgaaggacgataaaccttgttttctccgtaagaggcatgttgatcacaacgacatcacactttggaagcatggcatcgagatcctcctcatacttggccccaatctccttctcaagctccgggtcaatcttcaccctgtcatggtacatcaggttgcagttgaagggcttgagacgctgaagcaggagcctgccgatgcgaccagcaccaacagtgcccacagttttgccctcaagatcataggttctgtgggcaatgcccgcgacattccattcgccattaacgatctgatgggtgataataaaaaacctaacattttagtctgcgaaattcaaggactgagtttaaaataggataaactgaatttctatttctatttaaactaaaaatatacgagggctagatagggttgtaaaaggactagtgaagcttaacacattacctgatggtgaccaggcaagaagttcctgagaagaagcaggatgcgcatgagctggtcttcagccacggagacggtgttgctgccggtgatctccgccacggttagacctgctgccgcggctgctgggagatcgatgtggtctgacccgaccccggccgtgagaagaagctccaggttcttggccttcttgatcctctctgcggtgatgtaggctgggtggaatggggtggtgatcaggacgtgggcatcctcgatgtgcttctccagctctgggaattgatgtacaacagaagcgtcagttgtgtgcgcaattcagacttaagacctatatatttagtcagagaaattttatgatccttcagatacctcaaggtatttagtatctggagatgtactcagacgtactaaattttactgtaaaaaatgtgatgcctattgatatgttgttaaggatagaaaaattacccattatgttgttatagggtttattttttcaacgaacagataagacatcagacaaaaaaggaaaaaaatataatgcatgtttgaaacatttgcgcaaaaaactggtcatacaggaatttgaattaactgaacatcaggccagcatgaaaaacataagataaaattaattccagccggctgccaaccaaaatacacgtctacatgctgatagatgctacggaatgctcaaaaaaagtttatcgaaattgttcgtagaaactacctcttgatcacagctaatactccttcagttcaacaacataagctttgactaagaattactcttaatttcatgacataaatttgatcttatttgatttgtattcaaaagtagtctttaagtattatgtgaaggctttattgtactgaaacaaaatacatacttcttaatttttagacggagggagagtactactaaccgcagtttatcccctccttgtcatcggtgacaatgtagcgatgccccttagattcaagccagccgcgaatgccgagagcggagtcgacgcagccgacgaagttgggattcttgtcggcatactcgccacccttgtagaacacacccacgaccttcttgctgcctgctgatgtctgcggtacaaagagggaaaccaaaaggtgtcattcgtcatatcgagctgcatagaacaaatttgttgatcaagtggatttgttatatttaggggtgtaagtgggtcagttgtgaacaacttataggttaaaataagcgggttgatggcttgttttagcctataagtggatttcgcgggttagccacttacactcctagttatattggttatgattatttgtccatcaccattcctgagaaaaaaaaaggaaacatttctcgggaaataaagaaaacccgacaggcaggggtataaacgtgacaggtattttcagcccgtctgctgaccagatgtttatggcaaggatacggtaaagaaaaatgattacctggtatgatccgtgtccaaatccaaattcgaaatatatgaaataggatatgggaaaatttgtattagccgaaatgttttgtattatcaaacatacaacaaaaattatgagtttatgatttcacttgtgaacatggataaaagatttgttaatcaccatttgatgagcttacaaattaacaatattgtgtattttttctgatatgtcattaaatagtttttaacactctacttgcattgtttggtcatatatgttatatgtagtgcagatacaaatgtgactgtctgggcctacccaaaaatatggaatgaaatagtgtgttcccatcgtgtgcaaggtaattactattttataaggttggtgctgtgtgacgaattaaatgtgtctaccaaagaggagcaatagttaaaagccgattacattgggatgaaaacggtcagaaacaatattatttatacagaaccgattctcgatcggtcaaaaattctcatatttatcaatttatcaatttagtggcgattgcaatatgaagtgaaaagaaattaaaaatatatataaatgttatatatagctaaaaacagaaacaatcaaaaagtgtaccagaaacagattttcgttgccattttctttttgattacagaacatttggctatgttcgattgtatatttttcaacttctatatatactttccctttttcacgcgcatccttcctgaatagtgagaaacgagaggactggagcatagactggtcattgaatttttaggtgattccccgtgcgttgctacggaaatttctggataatggctttttgatttttttggtggggctctaaatgtgaagtttgttagtataaatcatgttgtacagttgtttatgtggagtagaatattaattacttctattggaatatgacaacacgtgaaaggttactgcttatttctcaacgcgcttagtacatgtgaatagcaaagtaaatgagtaatcaaacatgaaatgaacttctaaacatccaaatgaaattcaacggatgataaattgacaatgacaagagtcaatgtggtggcttctttaccagagtaactaggtgaaacccccgcgcattgctgcgggaatttagtatgataacaataaaaaaataacgtgtaagatagctagataatatcagattaagtaaattaatgtagtttatgataatataaatttaaatagtatgtagaatgatgattcaaacgtaaaaagtaaggtggtacgactttatgaaagaagaaaagtagggatatagtttagaccgtagattaatcatctaaaagctaaaaacaattgatgtgatatgacttaattagaggaaagaaggagaaagataatttggaccatagaatattataaaacataataaagatatgtattgaaacattatatgaattatgttggatgataatttaacatgtttgtatttgaaaagctcctaaattataaaaactataaagatatagcatgtttgcatgatgtttaaatgtgatgattgttagtggataatgatgtggcattttgttaattagtggatgatgatgtggcatctttgcatgttaagcttaaggagttagtgggggataactttatagtaagataggattatattaagtgggttgcaactatatatatatatatatatatatatatatatatatatatatatatatatatatatatatatatatatatagaggtttgaacctagaggttcggatctcatctcatccgttatggaaaacgagatagttcattagtacataattattaacttattagtacatgattaattaagtattagtaaaaaacataaaagttaatataacttttttatagaaaatatttttaaaaacatattgttcaaccgtttagaaagcccgcgcttgagaaacgatgggccagggtttacgattccgacaggcccttccgtttcgggcactggcggaattcggaatttcgcgaaatccggtggaaaactagtaaatttcgaacaaatttcataaaccaaaatttgaataaaaattccctaagtttgccgacaagttcttgaaaaccggtcggttttggcgaaatttcgatcactaatccggtccatctaagtgttttcctttttttaattctttattcttttctttcctgatgtaagtttcagtaaatacacacaatacatcatttttttggaaaaattatatcccaataggttctatgaatatcatagtatttataagattttatttgattttttttctttttttatcaattcaaatttaaatttggatgaaacttctcgaaatctcatacggtttctactttcgagcctcgtcgaaatatcgaattttcgcgaaatccgaccaaatgtcgtcggaatcgtaaaccctgcaatggctataagctgagataggaagcgcggaacatagctaggaaagagaaggatacgtacctgcgcagccgtagatgcaagcgcgcggccgagcagctgccccgccgccgacggtgccctccacatcgccatggaggaaaggatatgaaattgagctcagcaacggcgagcaagcgagagagtggcacaagaggcagtgagtgtgatggaatatcgatcagtattcagtgcaggcaagcagccgactcgatcgatgcgatggaagtggaagcctggattggaagggatggatatttgtagctccgcctccgccacctcgcgccgcccgcgtggtggcccctcggctgctgcgaccgtgcagtcagcgtagtgcatacccccagggccttgcctttgtcaggtaaaacctgagcataggtggattcatggaaaggcaaatactcgcgtgaaaggtgcgttctaatctatattttctcaacttctttctcgttgtctacatacacgttttttccaaattattaaacacgttttttccaaattattaaacagtataattcctctattccaaattagacgtcgttttgactttttttaacgcttaatcattcgttttatttaaaatatttgtgcaaatataaaaagagacaagttatacttaaaatacttttaataataaaataagtcacaaacaaaataaataataattccttaatattttgaataagataaatagtcaaatattaaataaaacttaaaacgacaagtattttgggatagagttaattttttaaaaaaaactattaaaaggtatctttgaaattttatattaatctatttttctaaagctttttaagctaatgattaataataagccactctattttacttgcttctttagagaaaaggttcataacacctactgccacagaccgacatccgtgacatgtactcaacaggccagggcccagggccagtgaaccaccgagtccaaggtaaaagccatgaggcgctggccgcctgtaataattgttctgttccatacgtctctcgcggtcgttccaatcgaatggctcttgtttcacaggaggaaagctaagaattgatttttgattcctagctaggaggaaagctacgagacacatgcaggcaaaacctaaaaacgcagatgccacgaggtgttagccgccctctagctagtatggttgtttcaatctgtttgctgtaactaagggcagggcccgtttagttcccaaaaattttttctaaaaacatcatgtcggtgacatggggccgggggtatcgtgactagaggcttggatagccgcggtcacccacgtggcctgaccccctcggggggggggggggggtcgggcccgagggtgacacggccacccctccctccgtctccccgaggggtcgggccgcccctgtttcggccccgagggctggggcgccccgaccccctgtggttttggcgccacttgtgtgggttaggtgagcacagcggggctcacctaaccgcatttatagcaggttggacgagcgcgccacgccgcatttaatgcggcgcagcgcacgcttatccggtccgtgaccagtcgcggtgtgtgagaccagtcagatcgcgggttaggtggcaacaggcggcctgtcacacgcctcgccccgtcccgtcggaatgatgagagcttcctggctctcgtccctagccggagccggcgtggtaactcctggagttggcatgtcagtcccggtcagatccattccaggcttcatcgcaaccatggcaaggaagtcattgtatgaagaagggcagacgtgtggcatgctaaactgacgcgtggtggacaagaatgaccggtttgtgactggtctaacaccggtcacgtcatcggcagacaaccgtgctcccacgttgcatctgcttccggcggagtggaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgtccccctctcgccgaagtcttgggcgggaggaggcgctcgagagggtcgaaagatccgcgacttcgccgcctgcgggcgatggagaaggacggcgagacggggagcgtcgcctcctcgtctacggcgatggcagcacgccccagagcgcgctccaggctgcgggcgcactcctgcgtcacccgcccgtcgtccccgatccagagactccagcccgacgttggctggatgacatggccgacttggtcatgacggcgccgcagcgcctaggcgccggcgggcggtcctccgccaccaaggcctctggcgctgctaccgtcggctccgtgtcgtcgaggcggagggcgcggcgagcggcggccgttacccgccgttcgtccgccattccctcgtcaacgcctccgacccaagaagatgtgcgtggggggccagatgcccgcctcaatatcgagcgccggcgcaatggtcgtcatgctgcccacgcaacggagggcgcttcctcgtccggagcgccacttcggtccgggcacgggggccagccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccctatggccctgaaaggtcaggcgcggggttggctaatgaacttgccacccgcgtcggttcactcttgggaggatttgtgccagcagttcaccatgaacttccagggcacatatccgcgcccaggtgaagaagcggacttgcatgcggtacagcgaagggacgatgagtctcttcgctcgtacattcagcggttttgtcaagtccgcaacaccataccatgcatccccgcacacgcggtgatctacgcattcagggggggcgtgcggcacaaccgcatgctcgagaagatcgcctccaaggagccccagaccaccgcggagcttttccagctcgcggactgtgtggctcgcaaggaggaggcctggacctggaactcctccggttccgatgtggcagctccggccgcccccgggtccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggtcggcgctcccagcagtgagcgcccgaccggcaagtggtgttccgtgcacaacacctccctccacgacctcgcggactgccgcgcggtcaaaagtttggctgagcggacgaggaagtgggaggaggagaggaggcaggagcgctgtgagggcaaggccccggcggctcccacaggcaaccgtcgaggtgaggccaagcagaaggccaccgccgaggacgtcgacgatggcgacgatgacctggggttccaggagcctgaggccaccgtcgccaccgtcgatgggggagcgtgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtccttatagacgggggtgcagccctcaacatcctttcccccgcagcctttgacgctatcaaggccccggggatggtgctccggccgtcccagccgatcatcggtgtgacgccggggcacacttggccgctaggtcatatcgaccttccggtcaccttcggtggttctgccaacttccgcatggagcgggtgaactttgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcacgcttgcttgtatggagcagcgcgcggaccacctcgccgcggcgtccaagcccgcgggtggcgacgagaggctcagcacctccgtcccagccgccccgaagcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgactggagaccggcggacatgcccggggtcctcagggaggtgattgagcaccgtctcgccgtgcggccgggcgcaaggccggtccggcagaaagtgcggcggcaggccccgaaacgtcaagccttcatctgcgaggaggtggcgcgacttctggaggccggattcattcgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcagggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccaacaagcttagggatgtgcaatgcgtcaccggctgcatggccgccctaagtcggttcatatcgaggctgggagagaaggcgctacccctatttaagctcctcaaacgctccgggccgtttacctggacggaggaggctgagcgggtcctcactcagttgaaggcgtacctcagttctccccctgtcctggtcgccccggagccagatgagccgttgctactctacctggcggcaaccccgcaggtggtcagcgcggcgttggtcgtggagcgcgacgaggacaaccctcactccacgcatccccaccctgtgtcgactcgacccgagaaagagcagggaggagaggcccccgagccgaacggtggcctaaggcccctgacgaccagagttggccctttgcccgcttgtccgacgacgccaggagcccccgacccccaggacggccccgaggccactgtgggaaggccgcccctgtcatcctccgaccccgaggtcatcggcacagaagacgagtgcgccccgaggggccacttggacgaggagcgccccggggatatggcccttagcgaaggggatcggccccaccgaagggtgcagcggcctgtttactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtaaaatgggcaatcgagctttctgagttcgatttgcgctttgaaccacgccacgctatcaagagccaggccctcgccgatttcgtggcagagtggaccccagctccagagaccgtttcagtctctgaagccagctcggaccccttgcagctgcctcacgccgtccactgggtgatgcagttcgacggctccctgtctcttcagggcgccggcgcgggggtcacgttgacctctccgaatggtgacgtcctcaaatacttggtccgcctcgactttcgagcgaccaataatatggcagagtacgagggactccttgccggactcagagtggcagctggactggggatccaccgtctcttggtgttaggcgactcccagctagtcgttaaccaagtctgtaaggagtaccggtgctctgacccgcagatggacgcttacgtacgccaagtgcggcgtatggaacgccattttgacgggatagagcttcggcatgtgcccagacgggataacatgattgccgacgaactctcacggctcgcgtcttcgcgagcccagaccccaccgggcgcctttgaagaaaggcttacccagccgtcggcgcgacctgaccccttaggggagacgggtgtgcctgaccggcccccgaggcccgtcggagtccaggcctcgggacccgaagggagcgctccaagctcccttagattgattgcttgcatctccgagatccaagcatacctcacagataagactctacctgaggaccgcgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcttttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacagcccggtttggagtgcctaaccgtatcattacggataacggcacacaattcactagtgaactcttcggcgactactgcgaagacatgggcatcaagctctgcttcgcctcacctgcccaccccagaagcaatggtcaagtggagcgcgccatgcagaaatcctcaaaggcct

SEQ ID NO: 41750 - DNA, 4700 bp, Oryza sativa
tcggcacagaatccgagtgctacccgcgtgccctctcggacgaagagcgccctggagatacggcccctagcgaagaggatcggccccgccgaaaggtgcagcggctcgtctacttcgttagcgaggccctccgggacgccaagacccgatacccttaggcccaaaagatgctttacgctattctgatggcttcgaggaagttgcgccactatttccaggcgcatcgggtcacggtggttacgtcttaccccctcggccaaatcttgcataaccgagagggtactggacgggtggtgaaatgggcaatcgaactctctgaattcgatctgcgctttgaaccacgccacgcgatcaagagccaggccctcgccgactttgtggcggagtggaccccagctcccgagcccgtctccgcccccgaggccacctcgggcccctcgcagctgcctcacaccgcctactgggtgatgcagttcgacggctccttgtctcttcagggcgccggtgcgggggtcacgttgacctcaccgagcggagacgtcctcagatacctggtccgcctcgactttcgggcgaccaacaatatggcggagtacgagggactccttgcgggactcagggtggcagctggactggggatccgccgcctcctggtgttaggcgactcccagctggtcgttaaccagatctgtaaggagtaccggtgctctgacccgcagatggacgcttacgtgcgccaggtgcggcgtatggagcgccatttcgatgggatagagcttcggcacgtgcccagacgggataacgcggtcaccgacgaactctcaaggctcgcttcctcgcgagcccagaccccaccgggcgcctttgaagaaaggcttgcccagccgtcggcgtgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaagagagtgaacgcgtccagcgcatctccaagcgctacgtgctagtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggtggtgcagggcgtgccagttccacgccaggcaaacccatcagccggcccaggccctgcagaccatacctctttcgtggccatttgctgtctgggggctcgatatcctgggtccgtttaggcgggccccgggcgggttcgagtatctgtatgtcgctgtcgacaagttcactaagtggcccgaggcttatccggtcatcaagatcgataagcactccgcgcttaaattcatcaggggcatcactgcccggtttggagtgcctaaccgtatcattacggataacggcacacagttcactagtgaactcttcggcgactactgcgaagacatgggcatcaagctctgcttcgcctcacctgcccaccccagaagcaatggtcaagtggagcgcgccaatgcagaaatcctcaaaggcctcaaaaccaagaccttcaatattctcaagaagcacggcgattcatggatcgaggagttgccagcggtgctctgggcgaaccgaaccacaccaagccgagcaactggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcggccctccgagccgcacgctaccagcagagcctgcggcgctaccatcagcgccacgtccgggcccaatcactctgcgtcgacgacctcgtcttacgccgcgttcaaacgcgtgctgaattgagcaagctctcaccaatgtgggagggtccgtatcgagtgatcggcgtcccccggccgggctccatacggctggccacgggcgacggcacagagctgcctaacccgtggaacatcgaacaccttcgtcgcttctacccctagtaggggtcgggtgtcaggtctcgggctcgggccaaccccgcacccccccgggcatgcagggttggccgggggctaccacatgcatatacttatcttttttctcttccgtatttcaataaaagcattttcgatttcctaaggactgtgtctgtgccattgtttccttttaaagaatcttggcttgaattagcacgctcgtgctcgatcctgccctcggtggcccaggccggctaaaatcgccaaaaggggcccagaaccgagccatgccccggggcgtggtgaactccgggggggaatcggcaaaggcccacaatcgggtcatccataaccctcggtcaccacgctcccggcctggccagtctcgacacgtggatctccccaggcactagccccgacccgcgccgtttgaggctgggacctgggcacgagcccttgttcaagccaagacacagaaggaccgcggcacagaccatcctcgtctcatacacacaacaaatagaattgacacagaaatttcctctttatttgattgcagattaaattagtctatacaagaagggggcccgaaggcctcggaagaagaaagaaaaagctatttaagattggcgggggcctgggggctcactccgacgcgcccgggtcaccagcctcgtcgtcgctgtcgtccgcaccaccgtcaccgccctcctcgtcggagtcgagggcgaacgcgagccgaggggccgtaccttcgaagctgtggacgatgtggtcggcggcgtcccggacctgcgcgcgtgcgccatcctcggttccgggagggaactcttccagcgctgcccacggggagaagtcagggtccctggcctggtagcttgccagtacgagctccaccgccccccgggcgaggtccctcgaggatgacttgatcgtctcctcgagctcctcggggagccgccggagggccccggccatctctgagaggcgctgggcgagacccccctggttggcggcgtacttcgcgcaccgcccgccctagaggcccgcctgccgcccgacgcggtctagatgggagacggcgtcccgaagcatgccgggccctacctcgctcgccaagcggagggcctcgacctccccggcggacgagtccagcgcgccctgcagcttggcgatggtgtgttcggcagctgcgaggcgggcggctgggtcgccatggcccgcggccgccccgccgctgtgcgctctcgcatccagctccttcgcccgcgcctcgagctcagcggcccgctgatccagtacggccccctcggcgcgggcgccttccagatcgcggcgcgcttgctcctcccgcgctgcctcgcggagggacaggctatccgccagccgctgcgccgcggcctcggcctccttgagagctcgccaccgctcggtgagcacgtcctcgcggaagcggagtgcggactccttttcggcgcaggcgacctcgtgcgacgccagtgttgcctcccgggtggcgacgacggcctcgcggtccgctagccctctctccctcgcgtccagggcgcgggcgctctcctccagcgccgtggcgcgagcctcaagggcctctttgcgctgcctggacgccgccttgttctccgccgcccgctgttcccgggcagcggcggcgtcaagtactccccgggcggcgtcgagcttcttctctagctccaccgcccggctcccgtattggaggcggaggtcgtcccgcgcctcgttgagcacggcggtggcgatgaggacagtctcccgctcctcctccacctccctggcgatctccgccaggtccctacgacgggcctcgagctctgaggcgtgccggcggtgtgccttgcggcccgcctccaccatggcctccaccgagcgccgcccctcttcgacgcgcgcccacgccgcgtcgagttccgcccgctctgcctgtaggacctccatctgggcacttaacccgtccaacaccgtggtgttcgtggcggccaaggcctgcaggaggggctccgcgctcggtggggcagcggaaggcagaggggagagccgcctcggtgtgggtgccgcgcggctcggcccgctgatcgacgtgccggactcgggggcgtcccccggagctggctcgtcccaagcgtcgcccgaggggtcgggcccgagcggcgcgcccgcggcctcgtcgtgggtggcctcggaagtcgtcgtcacctcgggcggagtcgggtcgggggcttgacaggccgcctggcgtgcgcgccgcctctgcctcccggacggactccccggcccggcggagtctggcctcctcccgagcggcctcctcagcctggcaaacccggacggcctcctgggcagcctcctcggcttcccggaggcggtccgtggcttctcgccggtcagcttcccgcctccgggcctccgcggtcaccgtctcctcggcctcagaccggccggacttgg

SEQ ID NO: 41751 - DNA, 6648 bp, Oryza sativa
  unsure (1)..(6648): unsure at all n locations
tcaaggacaagctgtgatttagcttccaggcgaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaacttcttcacacacagatccaccagaacacaggagtagggtattacgcttctcagcggcccgaacctgtctacatcgcccgtgtcttgagcatttgctctctcgcgaacattccacagatcgagggtgaagaacctcacttagcgcccccggctgaaccggcaaaggggggcctgcgcggtctcccggtgaggagccccacgctccatcacatcacatcgaatctttggacacatacatgaagcattagatgtagataaatgaaaaaactaattacatagttagggaggaaatcgcgagacgaatcttttgagtctaattagtccatgattagctataagtgctacagtaacccacatgtgctaatgacgggttaattaggctcaaaagattcgtctcgcggtttcaaggcgagttatgaaattagttttttcattcgtgtccgaaaaccctttccgacatccgatcaaacgtccgatgtgacacccaaaaatgttcatttcctcaactaaacacaccctgactaaaaagacgggggctattatcgataaatctctgcccttattaaattaacataatatttataagcatcaatatttaacctggtggatagagtatatactcacaacttcggtaccacaccattaatgtaattttcagtaatacagtattagccaagtattgaatgtgggaattttgagctttataggtcaggtggtggcatccagtctggatttttcacaatttaattcttttaaaaaacttatttcgcaaatagatctatgaaaaaatttatcccaaaaatatagtcctttttgggcgctagagaagctggcgccgtcctcctaccaccgtggcggggcgacgctaaggtggcagggggagcgcaccagtgtggccgacgccccccccccccccccacctcccccaagtgtagagagatgtgcaactttatatatatatatatatatatatatatatatataagaaccaaccgtagaaaaattaaactcaaatggacaaaatatgtgacttgtagaattttccaaagctataccgaaaagcccccctgttggtatttcttaacgatattactagaaatataattcccagcaatggcgcagaaatactcctggtatattatggttacggagtttatccacaagtacacggatataccattgtagcatttaacccgagagtattccaagagtatcatatttgtttaatcccgtgggaagattataatagagagaaccgtactaataatttatatattacttgtaataaccatagtctaagtaggggttagtataatccaaagggtagggtgacacgcaagcatagaactactcattctcatattaaattatctaagctaagtggaaagaaaatagaaaagaatctatttctatacttctagtatacatactgtacatacattctagtcatatgattaacaaactaataccctctatccgatgccctcctgatacttcaagaagccacccctagctgccgagttccttacgacagctcgtcatgaccatacaaccggggctaaatacggaggagtaccctccccaggaaattaacttaggactatatacacgcgcagaggaatagacgtactgagctgtcaccatcagcggcctacctctcatccacagcacgcctaaactaccagatactactttaataacatcgtcatgacatagagtaattgcataagcaaatattatacctgtacctatgcatatcctagataagttagcagtataatcagtataacatgaacataaaataaagttggcattcatatactcaatatactcagaaagtatttcaataccagaattgtataaagaaaaatattctaaataaagtacaaatcttacaaaagagaaaaggagagctactagagccatacccgaactcttccgaagacttccggactccgatttctattctattcctactccactagcttgagactactaaactaaacttgagagaatatgagatagctgttgcttgaagtgtgtgaagaaatgaagagagtgagctccttaaataggcaggtaatgatggttatggcggttagaaaggtcggtaataccttccaaccgcctgtcacgcccagaaatttaggccaaatttccagactatttttgtgtataaaatccctatccaggactagctaaggtacacaaaatgacaagtaataaacagttccaaacgtaaataaagcgtaaaaatacttacagaagaggcacttagtcctcacaccgaaagagaacgacagcagcagaaaaaggcgatcctagcggggcttcagctccactccacaggcaaaactcaactggggtctgagccttggtcttctaacttcgtcttcagctcagaagcactacacttctaaaaagggggaaataatagcaaggctgagtacaaccaccgtactcagcaagccacaccaacgatgcaggcgtgcaaggggatataaggatggcttgtggctatttgcataaaggcgattgtaaaacattttattgagcaaaacggtaaaactgttgagtaattaaagtaatattaaatctccactgatcaacgctacaccacgttgaacaggcccaaccaacccacctgaactacagtgcattgggtcgatttattaagtatgagactaatcacggtgattctggtcgatcgcccataaccgcgggcacggctattcgaatagttttactctggccagaggtgcacaactatacccacaagacacaatccaccagcatgtcaccgtgcccggccagacacgtcaccatgtcgagtgattgtgacaagacccttcatataacccgctctgaccaagcacaccacaccttaagtttcatccccgcccctagcaggcagcgggcagtcccctctcgtgcctaggtgaatccggaagcaacagaggtcgtcgcagggaccgccccgctccatcacgcccacccttgcctggatgcgtcagccagagaaaagctatacttcaagtcaggcagttacctattcccgcttgtggcaagcgctgtatgtcttccagtgcatcccgcgaactggtccttaattgccatgggtgcgaccagcaaaaccatgcacccacagcccaccattcagtcacgttttagttggatacttacgaccaatgaaacatggtcgggtgtctcgagcacgcagctcgtcatgatactaacaggtctaatactgcaattatcccatcaactgagctagtggtaattaagcatggctaagcatatggttctagctgtgtcacataagtaacatgagctagtcgatttatcacccaaggttgacaaagagcagatatcagtaaacatggcgcaagcaagcagataggtaaactctgatcccatgtaattagcaaaacatgcatatttatttgcaaatggtaaaatatttgcaaattggaatcaacatgctcaaggggaatgtgtgacttgccttgcttcttcacttggatcttctgaactcttttcctcgcgactgcgaacttccgaaacgacgtattctacacgctggcacgcaaaacgagaaaaaactcaaataaaaaccaaggaaacaatacataaaaagtaaacaaacatgtagagctcaattttagatgaattttgcaagttgaacggctcaatttggagttcgaatgaattagatatgaattttagcagttttgagccatttaaatgaatttctagaattaaatacgatttatgacgcaattattaattatttttccaaaggaaaaagggttgctgacgtcatcaagggggaagggcggtgccggcaagcgggccccaccggtcagcggcacaagggcgtcggtccatcgtggaccgggaccaccgaggcggtccaccgccggtccacgggaaccgacggcccagattggcccgagccgatcggatggccacgggcggtgctgctggggcatggcatggctcaaagccggccgatcgagtgatggcgatgggtggcgcgcggtggagcagccagcggcggcgcacggcacgggggaggccagcgaagggggaaggaggaaaaagggagggggagtgctcaccgagcgacacggcggaagcatgcggccggcggcgaggaacggcgacggcggggctccccgggaggacagcgtgatggagctctggcgacgggtgtcgcttgggaaaggggtggacaggcttggcctcgatttgaggaagatgaaggaggggttaggaaagtgaggatggttgcgaggtgaccggaaacgacggccgaccgtgacaatatgaggaagacctcaccggcgaccgagggaggtggagctccggcggatttccggcgaagagaagcagcggccgaggacctcctcgtccttgcggagccgagggagacgacgacgtagcgcgggacggacgagagcggcggcgattggcggccgaaggcggcaatggcgacggtggctcgggttcaccgtggagagggcagctcgggggtggaatgggggagcggcgtggtggccaggcttgctcgcggggcggcgaagccgactgtggtggtggcagggcgcgggagcggctcaggcggcgacagcgtgcggctggaggtggtgaaagaggcggcggcctcgggtgtgcggtgggagttgtgctccggtgatgaaatggggaaacggagcgggggctgaggtgcggcaccgtgcggcggagcctacggcggtggctacgcggcgcagcgaccactagggcggcagtggcgggcggccgaaggttgccggcgagcggcggcgatggggtgcggcggtgtcgcggtggtttccgggcacgggagggctcgggagagaggggaaaagagagaaggaggtgcggggatcgttttatagagctcgggaggggaagatcgtggccgtggtgggcggtagaggccggcgacgtggagcggcatcatggcgggtgtggcggctcggcgtggcgccggttcccgcagggagagaggggagtggggcgggatgtgggcgcgaggtggacgggactcgagtccacgccggttaggacgaggggaggcgcgggatcggcggagggagtgggcagtatggtcggcggttggagccggcctgaggttggggatgacaggtgggcccatgggtcccacctgtcggggagagagggagggggaaacgggctagggaggtaatgttgacttgagggagagagagagagagagccgagcggggccgagcggcccaagaggagaggggaggagggcggccaggcccgagcggaagggaggaaggagagggttgggccgaaagcggcccaaagaggaaggggagattttattttgcttttctttttattttaattggttaaatgatctctgtgactttcaaattatttcttgagctccgaaaattcacggaaaaatccggagagtatttgaaggcacaaagaatattaaaaattattcccggccaatgatatttaaaaggaaatttttaattccctcaataattcacttgatgaaattgatttaacttttattaaatttctagaaaatacattatttaatgatttttaatcccgaccgaaaatcggggcgttacaatagggaggcaatgcacaccgtccagaagaagtccggcatccaacggcaccgaagaggattcggccgaaccatgggctgggcctccctggcccattttcggcaggtggcctcctcttttgctctactctgcagacttgtgaattttggcccaattcgacgtgtcatttctaagttcttggcccattcatacataagtctgattctcgatatcgtccgattgattgatcatttggttagatgtagattctcatccactttatggttattctctgaaaaaggttagtaatcctaatacaagtggaatattattattctaacttaaatatgcattgcaagaataactagttctcctctattttggaaataaaggcggtagaaacttgatcgctaagacagtnaaaaccccccctccccccccccccccggcacgcgctctctccctgctctttgttgttttggtttttatttgacctccccgactgcagctccatcttgtctggtagcatcaaattcaaaagtatggggaaaacgcacgatgatcgcagcgaaggaaacatatgcgcccgtgagcactaatcctccatgattctctctcctcctttccgtcgttgggcggggcaactttatttctgcatcctctactctcgatggtatcactacaagcagcttcagccatagctggatgactttctaggttttgtacccatgccttctgggcaggtaaaaagcaccagatagcttg

SEQ ID NO: 41752 - DNA, 4091 bp, Oryza sativa
tgcacccaaggcatccattaataaacaatgagacaatctagcatatagaaaaataatagtaggtgtatcccaacaaaggacagtaagttataaaatatgtagccaatttactacatacctaaaggaacacaaaaataactgtcaagttctattgattgctgaaaaacaatgatatgggtacaaatatcattattttcataatcaatcaatgtaaaatgacaattttaagtcacttatcccacgttttaattgaatgaacaattatgctcatcacactcctacacaaataattttcgcaagcattctttccacatgttcctcaaatgtgcagcctcatagttagtaagtcttttgcctaagacacatgcgccacctttagaaataacttttgtaatgtttttagacataggagtacttaacccttaacccacaaggtagcgttgaaggttttacatatagaagtattttatcggagtacttaacccgtaaaggtagtattgaatcgatctactctcttggctatagaaaaaaaaagggctcattttacatcctaacaacattttattcttttaaatttatgcttctctacaagtcatatttcactttgacacatcaagagacgaaggtaaatgataattaaacgaattcacttagttccacgctttgcacgtagaagcctataaggtgtcaatacaaaatcaatagcatatcttataacaatatgattagaagtttcctactaaattacgttgtaagactaatattgactaggtagttttcttaaaaatattgtagggtcctacgtataagaagcgctatctaatatatgtatatttagggaaaaaaatacatttatgagcaatacgagtttctcaagattttttttttaaaaaaacaatgaacaatcaattaaaaagggaaatacctaacattaatttaaacttattttggtagacctgtttttaaacaaaataacaagcatgcccgcgcattcacgcgggctacctttccagtttgctttctagtttgtagtaagtacttcttcccttgatgaaatttggtctgctttcttaaccggctggcgaaaaaaataatctatcaccataggccaagcaagtattgccatccagcctgccaaccgtattgagcaccctgtccacacatcatccgctgtcaccaaaacgcccctgctgaattgaattgctgatgatatcatcgggtgtgtccaacggctccagcacatgaactgcaccatcgctcatgccgactgcaaactggttaggcttccagggatgcgcagcgacaaccatgggatacacaatttcaccaccgctggagttgataagatgaaacaagagggcagcattaacaggtcaccagcattaaaattaccagactcgaaacaaaaacagaattaaactgttggagttggacactgcatatacctagaaactgaagatggtatataggcagaaggtgcaatcctgcactgtaacatgagagattccacttgaaatattccaattgcaccatcacagaatccagcgtagatcaataagccatccgatgagtatactgcactcgaaactggagcagagagtggatcacttgggaaccactgcacattgtcaatcaatgaaaggttaaatatcagtgatgattacaatatattgtgaaggttaggagcatcataaatatttatctcactgctagcatgatgtaacatgtttactcaagaccgaatcaagactgcatatagcaagtgatagatgcaaatacattgatatataaattttgtgaacaacttactgagcacaagcattctagctcctcatcgtagatcgccaattggctctcatgaactactaaaaggcgcttttggtcatagtgaaactgcaccattatatcaccaactaaagctccagaatgattagatggaggttggatatatctggatttcttcttcgcccaatcttccatactccaaacacatagctgcaaattccatttcattgcacacacaaaaaaaaatgattcagaaaaaaacaagtataatatacgtagttttccatgcaatcaagcatgtaattttttttaatttcttatcttttggaaaatggactaaagaatggcctgaaatgggactcatataaatatggattttgaagctatgcttatatgcaccgagcttacatttaactcagcatccattcaataaacaacaaaattgccagtccaaaaatctttgatatatattagaatttacacctgagaatcagcacctgaagatacaagcacattcattgatagcgagaataccagtccagttatctttttctgatggcccttgagcacccatttaacctgtgcaattcgattaagataagtcaatattttgtcatgttgctgccaaatataaacaaacggtaattagtatattaagtataggactccacataggaagaaccgaacaatcaattaccattgttgggaaaattgactctcggcatgaaaactttgaggcaattgcgcactgccgttttccacccattgccgcgtgattaacatgttttaactcatgattattaccataattatgcaatcacgtgcattgattggtagcgcccaaaaccttatgtttttggaaagcccccgattcccctcagtgcaaaataaaatgggaggccgaccctagaggaaggtgacaactttttctctcggtctcaaatctcaccaacacaaaaataacgtaatcccgatcaagctaaaccgctggaggggaaacatggtacagtccaggccgatgcaggtggaggccggaggacgctgccagcctgccacatcatctctgcttaaactactacgccgccaacgaacaccagagcagttcaagagactccatcctcttctttcactccggttccaagagaggaaatcgcaacaagtgcaatggcttcaaacaatggttagcgcccctaatattccgcattaggtgatcttttaggcttagcatattatgaatcttaagtagattatgaaatctacaatcattatgacttcccatatcttcaaatgtcgagctgacaatatatgaggtttttgggtcatactgggtaccactttcttcatactgttgccaagagataccacaaaatagctatagaatgcgtgtaccttgtggtatctcctcaaagaccataaaaggctcacaatttattatgtaaaaaagaacatatgtaaaacaacatttagaatctcaccagatcctgatacataagtaaaagatgaggagatatatagtctgaaacgagaacatattatttcacaatgggtactgcacttccagtgggaatcatagatagtgagttttgccaatacttttgagatttatgcaaacaggggacaagagatgcacggctaacactcacctcgtcaacacggatattgtagagtagaatcgaagagtcatccgttccaatagctatgatgttattgtcatgcgggtggaatgcgaggaaagttgcagagggtggaggtgctatgaaagtagtcatggtctgtgagtgattccacaaaatcagttaagtaaaagaaaggccatgatcgatgcaactatgaaataaaaaatattttccggaagtagtcatgacctgtgagagatcaatcatgaaattaccagattattgtgttacatgactgaagaagacataccttgaaatttaacatgttgaacaacgaaactttgccaccagatgcagaaattagatagcagtcatttttggatagtagactgcaggcagctgcttcttcagggttgccattagcagtgtcattcattagaatgtcactttccggttgccacacttgaggtgggacagatgtggtggactaacaaaaagtagtgatggttttaagaaaacaaccaaacagaactgcgctgttgaaatcaaaataatttagttctcctgtctaaccatgccagcaggattcttgtcattgctctcccatttccacagcttatgaacagcatttgagctgagagctaaaagtcccttcccactttttctataaagcagacagataacctataa

SEQ ID NO: 41753 - DNA, 10158 bp, Oryza sativa
tgctcgaatacggccagagctaacaatgttcgccttccaggcctcatttaccaacctccggggttctggtcacatgcttatatgcctgcattttcaatacaattagcaaataatattgatcagcaaacgaacaagaaagtgcagcaaactcagctggccactcatgagttcctggctataactacagtacacacattccaaatggaaccaagggcattcacaatcaggggctgcatggtaaaaaaaacagtggttatttttcctctttctcccagtttcttcatccaacggccaaccaagctcaacagcagcaacggtcttcctgtggcaggacacggcagtagatgggtgtcgaagcatctccacgtcatgaagaaatctgcagtgaaatgaattggcacagaggacagtgatggtggggagacgtcaaccagtactagagaacacagtcaagccagagatactcagagttttcaatttcggaaattgttattctgtgggagagaacaataactgaggcatcagccaagttagaaacatttgcatggtggtgtatctctgaggaatcggcccggcacccactgacagtttaaaccgatggagtcactaccaggtcaccagtgcacacttgctactgcaggctaaagtagcatacctccggtttgctcgctcatgtgtatattgattcacgagaacgtgaactcaaatcaagaaggaataagtttaaggaccattggtaacttaactcgaatataaacatggtgcaactagtagcataggccctcaagaggcctgtacctcataaagatattgtaatcaaattgaaggccaaacatgcatctaggtacgttttttgcaatatcaaatgatagacaggacatgaatttttctactcgtataaaagaagggaaaggaatggatataggactaattaaaagaagagaaactagaagtggctagattcgactcctagtttgtgaggcataatataggggaagtaattacctttactacaaaaagcaacatgggaatgaattaataagatgaaccaacgttggtctatcaatgtgcatgcatgatcagttcctacctcttggtagggtgagagcacagcttgttcgtcttgccatttggtttgaacagttgggtgtttgggatggaccgcagctgagttcatcaatgcagcagccacttcctccacctctgacagacgggcatctccacatttcagtactatggtgactttttggagcgaacttcttccaagcttctcgaagctaagcagcttgtcaaaaccaagctgggttgcatctttcaggaaccgcatatggacagcaaactcgaggaattcaagacttggcatgataatagatgctaagcttctattgtctgtgatgttgcacttgctgccgtgcagatcaaaccagatagatgtaccaagtatccttaagattctcaacttccgaaagtagccaacatcttcagtatgaatctttatgctaaccaattcggtctcatgcaaacgcagcacaaggcagcggagctctggcaacctcgcaagggtttccatgtcctgctctttcacaattagcacaaccacatccagacaggagaggttcggagcaagcgatgatttaatccatgctggcagtccagagaacacaaagcaattcagacacaggtatcggagatgcaggcaggagacagatcttgcactgcttgtcactctccttgtcactaggggtgggccctcaatgtgcaggtcccggatattgtgcagcttgcttagggattccaacaaagctctctccatgctctcattcaaatcctcaaaataagtccggagcacccttagttccctcagtaggcccagctcattcacaaacttcatcgtagacttcgtagtatcatcaacagcagcagcatcatcatcatcatcaacagaagcagcatcgtcatcataaacagcagcagcaggctctatccaaagctcttgcaatgaggtcaacttaccgatcaaaccaatcttcaccattatttcccaatcagctcgtaggcaaacaagttgtgtcagcagtcccacctcctctggcagctcctttatgcgacttccccttaaatccagtgtctgcagaaacttgagataccttacttccctgggcagcttagtgatatatgtatctactaacccgaggtacctcaggtgaagtaaactcccaagatggcttggcatagttttgtccctatcttccaaaacattaggcgtctcactttctgcacagtttatcacatctaatacacgtaaaaccggagtgtgtaggcataatgaaccgaagcactgactggcaataagggatctcacattcttcagagtgatattagctagctgaccatccttgtgcactagaacacgctgcagggctaacctgcgagcaatgctccccggaagtttctgtcgctcatcaccattcaatacagtgacaaaattttcttcactcgataatgagtggatcatatcaagaaccatatcatgaacgcagcaaccatctacatacccttcatgttttgtctccactggctggatcatgcttctatttatcaactcattgaagcacctctccccgagctcaaataatcctaaccctgctgctagttcctcatggatgaaaccttcagctatccacttccatatcaaactatttttctctatcacatgatcttcgggaaatacacatagatacaataagcaatcttttaaatgtgaagacagatcatagtagctaaaagacaatatccttctagtattacctacatcatcattgtcttcatgcccaaaaccgacagagttgtagacctcagaccagtcctcccctggtttactggccaacaaactagctattgtaatgatagctaatggtacaccaccacatttcttcaaaattttttcacatgccttagctgatggattatcgaaatacttccattcaccatcaactattcttgcatacaataatttttcagagttatcacgagaaagtggctgaattttgtaagcttcaccagcatgtgtggcaacttcagaaatacgagtagttatgacaagtctacttccacaatcactttcttgcagagcacatctgattaatttccatgactccttgtcccatatatcatcaataacaatgaaacacctatgtcatgattggatagaagtatcagagcaggaggaaaaccagtgcagttcaaagttaatcttggttcagtcagagttaggggtcagaatcaaattcagttaaaattgagtttagagtttgaatctgatttggctaagttctttgaagtttgttcagactacaattcagttagtattggagtcggtttgaattgggcttggctatattagctggttgtacatcatgaattgaatcatgcacttatatttttgcaggataactgacatgtacttacatctccaatgtttgtatgtgatgtatgtcttgtgcttagtgctaaaatacaactgcatgttgttatataaatataatttgcagtagctctaacaaataaccagttaacctacatcattaatttattatatagcttgggcctaccaaaatcgacatgatgaatgtctctcttttctcattaatgtggttgttttttgcaactcttgggagcaaatgagcttgatatgtttaaatttgtttgaataatatgactagcatgattttcttgcgattgcgtggctagataataaattaataatactcatttgtatgagaaaatatatctgaatattatacaactgtttttgcttgctgaaaacacatttacatttttatgcatgactgtattaaatcaatctgcatcgattagcgttgtactattttctagacttgagatgtaaaatgtgctcctttcatcctttatttaataaagtaaatagatataaggaaggaattgtacagatactggaattcaaagtcacaacgtaagcagtgagtcattggattggtgattacactcatacctcttctccttgacgaattccttgagttcgtccatgagctgcttttcatccaacaccatcatattcggattcgtgtacttttccttgtcaagatcaatgagaatgtctctaaagactttcttcatgtcaggattccgacccactggaacaaaagctccgcattcgaaatgcggttcaacctggtcatcgaatgctttattcatgtcaggattctggtcgactggaacagaagccctgcacttgaaatgcggtttgaagtggtcatagacagctttggcaagagtggtcttgccgagtcctccaaatccaacgacagagatgactttcatcttcttgtcggacacatcaacatcaccccccagggatagcttgtttatgagatcgtcccttggcccgtcaatgccaacaagctctgttgcccttttgtacagattctggagacgaggatcgatggtcgttgccgctagagacttgaggacaacgctgtcgactgtgtacttgacatgccttgctttcacctgctcgaacttcttgttaatgtcttggatcaggttagagatcttacggcgagccttgctcttcttgaacagcttgcctaacttcttccggaggcgcaggagcatgtgtggatcggtggggtcagggccatcgtcgtgcaccaagaatgtgtcgacgatgtcctccatttcgtaggatgcctccctgacatcgcgcgcccaaagcttgaccagctcatcgacctgctccgatggcacatcgccgatcttgcggaggacggcgtgcacgacatcgagctcccgtgagagacttgatcttctccctcacgcccgtttgcaggccgtactctttctcgagcagctgaagcagcttgggcagcaggctcctcatcgcccccgtcgccagctccatgcttgcaaactgggggtcgggaacaagcctgtcgtagacagcaaggaaggcccgcccgccccagatccgccgcctcctcttggcctgaagcaggagggacgcgcagctctgctgtccctgccgctcgccggccagatccagcccctggaaggggttggttgacttctgtgagaccggaatggaagtcactccggatggctaacgcaaagcagcaggggagtgagtgagtagtgactagtgactactgactactgagtactagtctgtcccaaaaaaagccaaactctggctatgaacctggacacatgtgtgtccaggttcgtagctaggattggactttttttgggacggagggggtactgactagtgaggacgacagcatctgcaagggtggaccacctcacttgactggctgactctgtgatgtttgtgactggagtctacttccttcgtcctagattataaatatttttaattctaacatgatttttgagatactattttaagtaacaatatatataaaagtaagattttttaaataaaaagtatagcatattttaataatttatttaatgataaatctattaacatcaattttatatgattatcttttttatttttttagtaatggtcaaagctaaaaatatttgacttattactgtattgaaaatgcttatattttaggacgaagggagtacttttgtttaaacaatccgcacatgacaatgcgatgtttcgtattgatagagcaggaaaataaattacaagtctgcaaccctagaaggcgatatagtaggaaaaagaaaaaataacaaccacaccgtgtgtctataaccagatcccgctacatccctaaggaaaaaagaagcaggaacacaacatccctaaggaaatgaatattctaaacgacacctttaggaaggatacgacactaaaagtgtcatcgtcgccgaccttgaaccctcaacgtggttttcacttgaagaaatccatcagggtgagcagagaagatcactcaacaatgccccaagggaaaacggcgctctcaagcatcaccattgctgccctggaggggctgggcttcgcctgtaatctctttgttcgcccgtgttgttgcctgctggaaacataaccactatcaactgtgcaccttcaacacgtagccaccgcgctagcgccttgccgctggctagccatcaagtaggacctcaacctttggcgcactccaaacccatccacgcggatgggttagaaagggagagggtgagagagaataatggaccaaatgtggccaccttgtggcggcaaggtgccaccacaggaggactagcgtctggatagaagcccatcgcaggcctactcacccacctcacggcacgaccgtcatcgctgcctcagtcaaactactcgcatgccttaggccgcttgcccgcatcaccgtcgcctcgtcctaatgcccatgcctccaccgagactccaaccggagcgccgaccgcagcagaccccgcttgtgccacaccagccagccacggctcctcttactcgcaccacgccgctcccaccgccatcatcatgcctacttcctaccgctcctaccatgccaacccgcgctaggtcagcctcccgccaacctccttccgtgcgcgacctaccaccgatgccgaccgcgccacattggccactatgcccttgccccaccatgttagatgctcggtgccagccagagccaaccacggagttgccaggcgccaaatctaaccatcgtctcggccctcgctccacaccgttgtctccttgcgcccgacgccgctgtctccctgcacccggcgctgcctttcccgcacttcgccgcctctcacaggaccaccccgccaccatgcccgatctggctgctcagctgctagatctgcttggtcgacgtctcagctcagccgcgctggccggatccgcgctaccgcggcctcccatgatgcgcaaccgtcattgccactcctccatggccagctcgtcgcgtcggcattgtccgctgccctggcaactcgccgctatatgcccgcaccgtcgagagcgctgccggagtgttcttcccgccgcctgagtcgggggtgagcggcggctaggtttttcgccacctggttgcccatgcggggagcgacacttgagtccaaagtggtctcgttaaaccagccatgatattactttggaaactcaacacagaataacatcgcgaaaagatctaaactggtgacgatatcggggctcgatattttttaaagagacatgattacatccacttctctttaatctagcatattacagtgtatctaggcattcataaccctcgatcgactaggccactaactagtcaaacccacacctatattactatcgtcttgtagttatataactagtatgtctctctatgtacatagagagaacttaggctgcgttcggcagctgtggttgggaacaaatcccctcctgcatgcaaaacggggcggttcaccattaacacatgattaattaagtattagctaatttttttttaaaaaaaatggatcaatatgatttttaaagtaactttcgtatagaaaaattttaaaatacggaccgtttagtaatttgaaaagcgtgcgcgtgaaaaagaaagagagtgagttgggaaactaaagtgccaaactcagccttaggatagtttgactctaactttatactacactgttacaatttcaaaccgtcaaactaactttatacccatattcgacgatagtttttctcttatgttacagtactctgttgtacaatttcggttttgcgcgttaacggtggagtgagatttgtacatggccgttaggcagctaatatgtagtggctgccatgtaggcagctaatatgtagtggcaaccagacaaccagtcgatggactactaatctattttgcactgaagttaattacaaggccactagcctgaattttaaacgagctatgtaccgggtacaatcacatattgttacccacacgatcgctttatccgactggtgggccaggttcacatattatgtaatagattaggacttagaaattatattgtcttgttacctaaggcatagctaatagtcctaattggatacgattatgtaaatagaaaaggaaactcgtgccgtgtccagcagggtttttctccttttaaccttgtctttgaacctgtataagaatggtaggaagccccaagaacataaccacaactcgatcatcagatcaataaacacttgacggatccaatcctgaaaacaggaatataatatttcttctcacctttgctcatccactttatctcgtgtgctacgccttttctcattgctaatttctagaatcggcacatatgcacgtaaacacaagtttgaagctataatattcggtctggacacatacttggttatcttaatttcactagacttgaacaaacgaactacagtcttttctcttagggcaaattttatagtaggggtaattgtcacgtctaattttattcatataagataagaggtgatatatacaatacaccacatctacaccacctctatcattgtaacctaaataattttattttatttgtttgtccaatcccctatttctttcatctcattttccttggggtttgtgtggaggttgctccttgcatgaggggtggctcaccttctctttcctcaattattactcccacctcatcatctaatcgtatatggtatttttagagagaacacatcaagcatcatagtacttgcccttaggctgtgttcgggagccccacttccttgcacggaaaacgaaccagtccactagcatgtgattaataaagtattagtttttttttaaaatgaatcaatattattttttaaagcaactttcatataaaagttttgtttgaaaaaaaacacgcaccgtttagtcgttttaaaaacgtgcgggcggaaaatgagatgagtgagttgggaacttaaagaaacgaaatcagccttaggtagtcttcttttaggcggtgattttcccccacgtttccaacttcaactatcttgtttttcacgcacatgcttcctaaactgctaaacgtgtattttttgaaaaaaatagtttttcacataaaagttgcttaaaaatcatattaatccatttttcaagcttttttttttgctaatacttaattcatcacacgctaataggtaacatcgatttccatgcccagccttaagccattgcaaatttgtcatattagaaaaatgccactactgtttacaatatcggctagatgccattagaattttgtcaaattggatctataccatagccatcacgtttttagttcgggatgaaaacggagtggacacggatagataacgctcgtaccatattcgtttttttttttttgccgaatatggattatctcgaatatgatcggacacgatcacacgaatacggaaacattttttcctcagaacacaaaaaccaattcaacttctaatataaacaaatatcaacatatataattagctcattttatataaaatataggataatttataaatagttttaaataattaaataatattaatagtgtggactagtgtcaagacataactactattaaaatctaaaaaggtatattgaaggtcatcggacatccgaattattatctgtatccgacggaaaccccgataccatattcgtattcatatctgggagaaaatatccatagctgtatctatattcgaaaggtatccatattcgtttttatctggagcggacggaaacaactatccgcttcattttcatccctattttcattcttcatatggaccaaatacccttgaacttgggacccatctgtcagtttcatctccttcctccatccctcctccagcctcccagcgcctctcttatgttcgtctgcaacctccgcgcccgtgacaaccgcttcaggacagcttcaagtggtccaccatgtcggcgaggtgggccaggtacaccaggagcactgccgcagcgtaccataaaattcgattcgaagttctcatattttaaaattaatttttaatgactattttcgcatgcggtcctattaatgaggcgcatgcaaaaatctattttcgcatgcaaactcttaagtggttgcagcgacggcgacggcatcggtgggcggcagcggcaggcggcgagggcg

SEQ ID NO: 41754 - DNA, 10359 bp, Oryza sativa
gccatagggatgggctcggcgctctgcgatgggcggtgggcacggcgccgcagaggcgtgtatctggcaccggccccacgacggccggcggcatcgggcggcgagcatgggcctgtcgggcaccagccacgcgacggccagcggtgggcggcgtgaagctagaactgcaggcggcgggcgggaggctagcgtttcgggattatttttatttttatttttttcactgaaaaatatcttcgcatgtggttggctatataaaccgtatggaaaaattccttttttgcatacggttgcgttgcccgcatggagaaatagcgatttttgcagacctttccgtgcatgtgggccggctaaccgcatgcaaagatcgattttgcctgcacgcaaagatttctttagtagtagtgtgcttgggtagccgcagcgagaacgacctccgctcctcgagcgagtcctggagcgtgtcggcgtggtgcgcggcgcggtgaccgttgaaggggtcggccaccgagtggtttggggagagcgacacggacggcgtcgccgcgggcgctcctgcgtcatgcccgccaccgccggagtcagcaatggagcgcggtggcgacagtgtgaggcagagaggcaacggcgaggagaggaggaggatcgaagcggtggagagagagagagagcagctgcgtcgggagcatgttctgcaggatggtgaggaaggcccagcagcgaccatatctacgatccattgccgtgaattggagctctaagctctgagctgtgaactcagctagcttcttgctgatctactgcctgagctgctaagctggacagcagcgggactgatgccatcgccatcgccccgatgccgagctgcttgctgctgctttggctggccatcgggagaggaagggagggagaggagaagaagaagaaaatatatacgggagtggaaagggatagaaaacgtgatggcgatggtattgtttaaatttgataaaatactaatggtatcaaactaatatcatgaatagtacctagtaaaaaacggatcggaccggcgattcaaccgaatagtcaatagtagtggtattatttcaatgttttttttatattttagacatttttaataaataattttaataaaaaaagcttgcagtaacttattaacttatttccaaaaatgaaccagccacaccattgtaatcggtgtggccaatctgaacagccatgccattggtcacgcgtggcatgtcaaagggtgcctcatggcagacgttgtcgttgacaagatcaatctggcgctgacgtggcacttctgccacgcctagctccttggcgtggcaggtgtagtctgccacgcccgacttgttggcgttgcagtgcatctagcccaattattttatatttttgaagaaaataattatgataagaaatttcatgtgttaggaatatttttattaatttcatgaccattgtggtttatgatgaacatgctaggtttgtatttagaaaattgatactaaacgggtaaagatcggataaagtttttccggtatttgtgaggtattactagaaaacttcttggggttttgattaagcaagagatttgatctacctagcattcgccaaattaacttcaagacgataatcatcatggcaacaagtttagaactaggcaacacttcaatatattttgtgaacaaaatattcatgaaatattggttgccacacttgatgaagatattctccccaaattcaaaggtatttatattagcaagcatacgacaactgcatacgtcgaaggacgtggttactcaacagttgttgggaacaataaagtgtattaattcaaggatttttcttaggatcctccctttacatggccctaggggtctagttatagtcctattacagatccccctattagggtttagattttacaggggaatttacatggttgcccttatgaaagggacacttgtatgggtatacagtgtaattgagatacatgggcctctaacgggccaattagcgaacgctggcccactggccaatgggctagagcggctgggatggccccttgggcctccttggagctggggttgaaacggcgaagtcatcctccttcggcatgcacccttcgccatttagtcttcgcccaggacgcatttggacttgcggggtcccaacgcgactcttcacccttcgccgcctttgccccatagtcttcgccacgaggcttcgccccgatgaatcttgacgtctcgagtctgaatcctcgctggttgcatggtttcggcaagtctggtcgaagggtctcatgacataccgccaacaatagttatatctattaagctaaaaccgcgagtgaacggaatgaagacctacaaaaggagtctaaatggatgaacctgagttataagacggcattgtatagagagaataaaatgaaggtttacacaagaaggtagaatgatgacttatgtgccatattaactacaacacataggcacaactattcataatttgaaggctacaaactcaggttgagacaaagaagaccaaggatgaccaactacaaatgtctgaataatagagatattttattcaagaccttgatctggagaaatggatgtgaaccaacaattattcaagatagtagtactaaagaaacatattgtactcatttatcctaaaaatataaatgggtatatcagactaggagaaaatatatgaagaaattaaatgatacaaaaatatatgttagaaatatacaagatcccttcaaggcatgacaaaccatgctactactcgaagacgtatgactgaaggaagaagtttacaattttggcaagtgccaagagtttgatcggatattgacaatgtatttggataaaaagggtgcgagccatctacgacaaattttctttaaagattgaattcccaattttctctacactaggagaatcagcatcgaagtttatgaatcaacaaggagaaaataattagaggacacaaaattattggttgaaaatataccttgaacaagatctatccagggtattcattgtcagatccagcgtattcagacctgaatggactcccactctctcacgatgtggccgccgcaagacaagaacaggagaaaaactagggttctaagttactctaggacaaattaatttgctttttcatgccttcttctccttacggcgctgggttatatactcccagtcgcattttcacccacatgttcaaaattacagcgctgctgacataatcagagtaaaaatcgtgctcgcaggcaacgacaaatactaaatagtgaatagtacaagataactccttctacacctttggatcctgcggtaaagtttaatttccttcatccggccgtccatcttcacttacgttctcagcgaaacgatatgtcctgaactctgcttcttctctgcttatctgaacttctctgcatgtctgaatatttgatctccatttcctactctgaaactccccatcctgacattcatgaccataaaaatttggagattcatgactagagctagagatttgtacttccgacaagtgcaaggagtttgaatttataccagtggtatatctggataaaaagagcataaagcgtatatggcaaattttcttacccacaatagaggaatcaagctaccaattttctggacacactcgataaacactttcaactccaagagctatattacaggccaatcatttggaaagcaagactattgacgtacaacaagaataaaacgacgaataaaagtgcgactgaatggaaataggtcaatataagtaatacttgtacgcaacaatggaaaaaattcaagaataaattcactaccatctaaattccatggattttgaaatatctcacaatatttcttaagcgaatgtagtgaatcatacaccctgattgctaagaaaaactttcttactccctccatcccaatatattacaacctaggatgggattagacccatcctaggactacgaagtcctaggttgtaatatattgggatggaggtatgtgactcgcaaataagcaaccaagacttggatttctaatgaaggaaatgggtagatatagttaaagaatatgacttcaatgttcgatcctattcaagaagggataatgtaataatcgccataagaatacaacatctggttatggtatgaaaagtaacgaagaaatatataaggagatgatcagttactatgaacaaagtattattcatggacatgtgagacagtacaaaattagaagtcaaaaatttaagttaaggcgttacaaaaggttggaagaaaataatgttcaaaagaagatcctgcagccgacaaaaacagatgagaatcatgcaccagttttatctcgaggatactagaaaaaagtctgacctcctcaataagtgtatatatatatatatgctcgaaagatcgaatcctatgcagaaataccctatgacatgtctctatttggaaaggctgtcaagtgtcggattttcaaactttgaaccacatgaagttaaatcaagtaatctacagctttttattacccaatgcatacatccaagaatattccaagaatacaagttatctaccagcagattaatcagtcggatatccggaattttgggaaggaccaaagaaagaataaaattcccacactactacctggactcttcagaaatctcgaggatgagattatttaatggggtaggtttgtaacatcctaaaaattaactattttctagtcatgtgtcatgccgattcttatatttctaataaccttctaaacctagaaaaaaataattagagagacctcctaaaactaacttgcataaaacctctccttggtattcaatctcttttgtggtttttatttaaaaatatattttgttaaattgaggaatttcttgattgaaatctaattttgaatattaaactttttttattaaaaatcctttattcaaattatttgaaacccttttatgaattatggtccaagaaaatcctccaaaccaaatccttgcaattccaattttattggaattaattgttgacccgtctcttgatattaaagctatccttagttctccttccaaatattccaaattcctccttttgatttagctactaatttaattcatatggcttgattcctcttgggcataagaatagtactagaaaggtctcgcgcgctgcgccgcacgggtgtaatagacgtgtctaagagccgcacgggtgtaatagatgtgtctaagagcctaagacacatgttattggagcttacctgtcacatcctgatttttgtttcaggatttataaataatttaataaattaataatagaatttatgttaaatgttctttaatttacaagtgaagtaaaatgtgggaaataaaatttcctaaatctaaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaaccctctctctctctctttccctcggcccagtccggcccaatccgccgagccgccgctctcctctctctctcagccgctgacaggtggggcccgtctgtcaggcctgtcttcctcctcgcgccgccgccgccgcccgaaaccctagcgcaagccgccgccgtctccttccaaatccggccgctcctttccttctccggccgaatcgatagaggggaaacaatctcctcgatctcctcttccttttcccctttggaaacatcggctaaatcggcttggaaagtgttggattcgagatcgaatcggattcctctctctctcccgaacccgatctttccttctcgtcaccggtcgccgtgggccttcgccgccgccttcttgcacctataaaaggacccccgagctctcctctatccgccgccacctttgctttagcctgccgtcgcgtctagcgccgcctccgcgtagccctagtcgccgccgtcgttgccgttggttcagccgcgtcgcgccgccgttgcagccgccgtcgtcgatcgccgtcgccaccatcgggttcgcaaggtcgtcgccgtccccgtctgccgcttcaccgccgccgaagaccgccggagcgccgttgccgccgtcgacccgaaggttgccgccgcttcttcctcgtcgccggcgccgtccgttgctcttccgccgtggttttggtcaccggtgagttcgccgcgttgtcctctatccgttggtgccttccgttcgtgtcgaagcgccgccgttcgccggcgagcgtgcgccgtccgagccgccgagccgccgccgccggaggtgacgtcgtcgctgacgtcatcgttgccgttccccgtgagccggtcgtggaccgatcgatctcggccgtccgttttggatggattgatctcggccgtccgttcgcgtgaaccgtcgcccgtgcgcccggtccaccgaaaccctagccgctgacgcaataattctcttttccttttcaaaaataattcattattgcgtcataatttaattaaaatccatataaatgcgtcataatttaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacaatcctttgagcatgttgatcctatatttaaattctctatttatttcaactgtgcatttattttcgaatgtcattgggtggaattaacctattctttgttatggcccttttgttcttgattactttattccttgttaccttgggttattataattggactagttgagctttatatatatattggttcaactagatattagatataattgcttagccatgcttagaaacattagcacactattgggataatttatgactcattattatttaatgatggcttaatgatagttcacgatggtcaatcgtgattggttaattaattatttgccaactaaaacttgatgatggtgggttgtgagcacatggttttgagagtcgtgctcatgacaattaaggaccggttcgcgagctactgttgtgaaatattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataactatggatgttatacctggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgttatatgctcaccttgcaataatcaatcaacctcagttgaagaaaaaggatccagaaggagaagacgtttggcttataccccagttgagctgcctgtgggagtggagccggagcttcgctagattttattttttccgctgtagttttcttcatggtgaggactaagtgcctcataagtaagtatttatcgttttagttaatttgatgaatctgtatattaaattgtcagtttgtgtacctcggctgattcctggacgaggatttaatgcacaaataagttcggaaattactatagaatttccgggcgtgacattaccgaaagtgttatatttagctggctatttagcctgtgtgggaacaacagaacaagtaacgcatttcaagctgtaatgagcttgattggttttttagatcgtaaagagtctttcccacccaaaaagctagccaatgagatgaggggctcccccacttatatcttagatccttttttcttccacaaccaatgtgcgactattcaacaatctccccattcacacattggtgtcctttagcccttcaccgccccttcaccgtttctccacagtcccttaggtatacgggtcccgcaggcacccacgatccatcaagccagagatgttgaactagccaggctttgataccagttataggatcgtaagggcctttcccaccccaaaagctagccaataaagtgaggagctcccccacttatatcttaggtcatttgcccttccacaaccaatgtgggactattcaacagttttttgtttaaatttgggctcttacatactgctatgatttaaggatgtacacctcctgttagattcaggcactcagtaagttagcatgttctcaagcttggattacatacggtatgttcatctgttagagccgttgtttgcacccaaatttagcacctatggatgaaataggggaaaattgtcaaagtttggaaagcgtcgggtttccttcacagggccggtcagaccacaggtatgtgggtggtttgaccggttagtagggccggtctgaccgcagtcagggtccgagcccgaatttgttttcatcgggtctcggtttccttgctcgggaaggctatgtttcgtgtttcctttggtttctatcccgagttggatgtggacaagggtctgtagagggcaagaccaacccctatttaagggacaatgccggttcattgtaaatcccccgaatacaatttacttgaattgttcttttatcatgttttctattttaccctagttttagtccatctttgtcgatttgcgttgtaaattgtccgccgccgctgcgagagtgctgcacctctttgtaggtttgtcctgaaaaccttctgttttgcccacgagacgggtagttatcctcatatcgatctaaatcagcttagaggctgattttaatatctaaatcggcttttctagccggtttagctgtttttctacaaaaccatcttcatttggccctttggctagatcgaggtggttggcgactccatatcaccgcaaggcgtttaggtgttgtgatcgtgcttgttgacttgtcacaaaaaattaccaacacacaatttttgacgactccgttagggaacaatctaatcggccatatcacggcctaatttcgtttaatctagtagttttcgtcaaaccgatagtttcggccaaacggccgaaatcaatctatgcatatactgccgtcgttgcattgttttgtcatctaatcgagtgtttcggccgtacagctgaaaccgatctatactcgcgtgcgtcaaggcagcagtagcagggccggcagcatcttgctgtacacggcctgaaagttttgagtctcaatcctattcggtttgctgtgtacaaattcctaa

SEQ ID NO: 41755 - DNA, 6106 bp, Oryza sativa
agttttgtcactgaagttgcagtttttatgaaatttactctatttcagtatgttgcttcattattttttataatatcctatgtacctatttagttcatcttcacttagttgttatttctcccttctctaattaagccatataacatcaattgcttttagcgcttaaatgattaatctatggtccaattatctccctccttttcttctctcgttaagttatatcacctcaattgttttaagcccttagataattaaaatatggtccaaactatctccctacttttattctctcgtaaaaccatatcatattacttttatatttgaattatcattttatataatatttaaatttaaattatcacaaaccacatcaacttacataatcttatatagtgtaactatcttacacattatttttacttattgatatcctactgaacttccacagcaacacacaaagtttcacctagtttaactaaagctaggtgacagtggtgacatgtggtcacattgttatggacccacatattagtgggtcaagggcacctaccgttacgatagaggagctgcttccggaaaattgaacacactcaaatagtgtcaggttaatttctttgtactagctatcatcgttaacactgaaacatatcaagacaaaattataaaaattaaagatgtttttgccggtattttgctacgtcatccgtgtatgagtcggtttttaagttcgtttgcttttgaaaatacatatccgtatttgagttggattttaaaattgttcacttttgttaatacagaaagaattatataagaaatttatttaaaaaaactcgcatgctaacttgagacgatcggagtcctaactgcagctcatgattttctaaaaaatatatatccaagcgaactcccacagtgaatttcatcttaactaaaccatataataacaagattaaaataaattttacccgttgcaacgcacatttttttctagtcatcaagacaaaagtaaaacaactactatagttattaatttagatccagacaaaaatgaaacaacgcccatagctattaattttattaacttgtactccttcagtactaaaatataaaaatctaaaatcggattggatattttttaatttcttatattttgtgagggaatataaatttatagagttacatatagaatactgaagtatatactagttgcgtaattgtgacgccccgattttcgttcgggattaaaaatcatttaataaggcattttctagaaattaaataaaagttaaagctagttaatcaagtgaaattattgagggaattaaaatttcctttaaaattcatggccgggaatattttgtaatattctttgtgccctaatgtactctccggaattttccgtgaattttcggagctcaagaagtaattttaatagcacaaagttcatttaaccaattagaataaaaagaaaagaaaaataattttccccttccttgctttcgggctcggcccaaattcctcccctccccatctcgggctctctctctccctcggcccagctcgccgctcggccctctcctccccgaagtctactttgcctccccagccggcctccctctcctctttggccgacaggtgggacccatgggcccacctgtcatccccaacctcaggccggcaactgccgttgccgccatggccgccgaaaaccgcccacgtcgccaccattcccggcctcctcgagccctctctcgcgtgggaccgggagccacccctctcctccacctcctcccccgcttttccccaaattttggcgccgaatcgagccccacttcgcccacgatgtcgcccacgtcgccggccgttgccgcttcaaatccgccacatccggccacgatttctcctccccgagcctataaaaatgatccccgtgccatcctcccccttttccccaattttcccgaacccgctgcactccctaccgctctcccctcgttgctcccgcgctctgctgctttccggcgagctccggctgtacgccgccgtcgctgtagccgccgccgcgccgcgccgctgcaccgtcggctccgccgctctttgccgcacaccggccaccgccccgtttccacaaaactccgccgaaacaccacatccaccgtgcacccgagccacagccgcctctcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctctccgccgccaccgccgactccagccgcgtcgcgccgccgcttcggtcgacgtcgactcgcgccgttgcctccctcagctccgcaaggacgaggaggacctcggccgccgcccctcttcgccggaaatccgccggagctcctccttcctcggtcgccggtgagctctacctcttgtcatcgccatcggccttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtaaggatctctcctcccttccttttttttcccgtccccctttcttgccgaccgccgcctcttggggtgcgtcgccgtccccgtgcgcgccgctgtcctcccgcgcccgccgccgttccacgtcgccggctgctgcagccggttgccgcctcccccttgccgcctcccccttgccgccgcctcccccttgccgcctcccccttgccgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggttcctgtggaccgcctcggtggtcccagtccacggtggaccggcgcccttgtgccgctgaccggtggggcccgcttgccggcgccgcccctcccccttgatgacgtcagcgagttccatttcctttgtaaaaataaataataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgttttcttggtttttattagagtttttcctcgttttgcgtgccagcgtgtagaatccgttgtttcggaagtccgcggtcgcgaggaaaagagttcggaagattgttttgaagaagcaaggcaagtcacacattccccttgagcatgtttatcctaatttataaatgttttaccgtttacaaataaatatgcatgttttgctaattacatgggatctgggtattacctatctgctcgcttgtgccatgtttacttgatatctgttctttgtcaaccttgggtaataaatcgactagctcatgttacttatgtgacctagctagaactatatgcttagccatgcttaattactactagctcagttgatgggataattacagtattagacctttttagtatcagaatgagctatgtgctcaagacatctggccatgcttcatggttataattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgttcaataaaatgttttacaaccgcctttatgcaaatagccacaaaccgtccttgtgttccccttgcacgcctgcatcgttggtgtggcttgctgagtacggtggttgtactcagccttgctattattccctcttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtgtattacttgtcgttttgtgtaccctggctggtcctggacagggatttaatacacaaaatagtctggaaatttgggctaaatttctgggcgtgacagtaatcatgtacgactttgcattctagaacccctttatcccagtagcaccatcccatttgctgcccatgctaacctctcctcagacctagcttccatctctacctccgctggcgcaccgccctgaacatcagcctcctcttgctcgtcgacggcatccccattcttctcctccggcaaagcctccacaaccgctaatgctcctcccgatgacagcgacgatgatcaatttgttagtgtgaacgcaaatatgatcttgcggctaaaccaagtcggcagagagatttttttggacgatcgctacagtgatcgacctctcaagaacatccctgatcgggggatttaccgcctcttctagtgccggttccccctgtgtatagtggctataaatagagataaatacctaagtattaaaccctaagttttcctttgctacccgatcaagcaaaacccactgaaaacacagggaagaaccgagacacgattatctctgtgcttccaaacgaaaagagaagaaagaagaacaaaagacagagacatgggaactcctggagatcaaggtatgacccaatcccattccaatttgtagttccattttgtgccaaaccgatccaaatcatgcaatccaacaatggtatcagagcaaggttggcctcaaattggaactcagtaagtgttctgtgcaatccaattaaatttgttttagtgtttatgttcaagttgttcttcgtgttcatgcccaaatccctctgttaaagttgaattgagcccaaatcatgcaatcctgaggtataagaaacgaaattaggcctactagggtttcggcttgaagaaaatagaagaaggggaaggcaaatttcatgcaaatctcagaaattccccaagaaccaaaaccctagcaacagtaaaccccccccccccaaaaaaaaattccccaaatcatggtaccctaaccctaaaatcatggggaaaaggagcgcggcgggcttacctaagggccatggtggccggtggcaaccaccgtgtcgccaccgacgctgtaagaggcgagcgtgcgctcgaggacttggtccccgagcggcctcgtgacccgccgtgctggcccggctcctccttgcatgcttgctgtcgctgaggtagccgttgccggccccgtctcgccgtcgctgccgcagatctcccttgcgcgagcgaccggcgggtacattagggcaccgtcgagcaacgctcaacggggatgcgcgccagctatggcggcacgcagccccggcgagcaaggctcggtg

SEQ ID NO: 41756 - DNA, 1666 bp, Oryza sativa
tgcatagtaacgggctgcatagtaacgtgtctaagaaaaggattgggctaaaatgatattacaattaaatttttctttttaaagaattatgattatgattattgtgtttaaactttaaatatattttataatgctttagttaataataataaaaataataagtgactttattatatggtaaaattctcttttatttatctgtttattttatgatcattacattatgtttattacttaaagttattattattttatgcattgtgagtttatttgcgctgcaaataaatattgtaattaagtgtgacaaacaattgtcattctggccaaagctgattgaattttatttgatcacaaaattttattaattcaattcaaatctggccaaagttgttctgattgaattaataaaaggagttttttttaaacaaattaataaagtgtggtttgtatttattattctggccaaagctgttatggatttgaccagcatcttatgcctcacaaattgctggaataatgggcaatattgaacaacttaatggaagtaattatgcttcatggaaggagaagctggaaattactctagctctgttggatattgattacgccctccataataatcctttgattgagcctagaccggaaaatgagaattatgagacccttaaaaaggaatatgatgaagtaaaggcaaaatgggatatttcaaaccgtaaattccttatgattatcaagagctccattattgacgcaataagaggagcagtcccagagactcagacagccagagaatatcttgctaaagttgaggaacagtttaaaggctcttctaaagtttatgccaccactcttattaaaagattggtcaatgaaaaatatgattttactggaaatctgagggaacatgttatgaagaaatgtcacgtggcctttaagcttaaatcaatggaaatgaaaatctccgaaggtttacttgtccatttcattatgtcatctctgccccaggaattttctccgtttacgatcgattataatgcaatgaagatcaagtggggcattgatgaattaatagccatgtgtgtgcaagaagaggaaaggcttaaggcagaaagagttgatcatgcgaatctatttaaacactccgagaagaaaaggtataaaaaatttaagaaagagtttttgaagcctaagcctagtcaatttaaagaaaaggggaaatgttcaaatcaatcccagtagaataaatctggaggaaatccctatacagaagaaaagggaaaagaaaaggatgggtgctacttttgtggaaagagtggacaccgccaaaaggactgtattgggtttatgagatggctcagtaagaaaggtactgatgttatttcttttgttgatgaatccctgaatattgattatgccatcaattcttggtggattgactcaggagcaacaattcatgttgcaaattccttgcagggattcactatgaggaggaccctaagaagaggggaaagaagaattaaagttgctaatggagttgaaactgaagttaaggccattggagacttcattctcacacttcatactggcttcaaatttcagctgcatgacgtcctttatgtaccctctatgaaaaggaacttaatttccgtttcacgtttagataacg

SEQ ID NO: 41757 - DNA, 1084 bp, Oryza sativa
gataatgagacttcttcgaaattatggcactatcgtttgggccatatttcgagggggagaattgagcgtctcattaaagaaaacatcctctatcctttggacttctcggatgcagacattgatcactgcattgattgcatcaaaggaaaatattcaaagcaaatcaagaaaggtgcaaatcgaagtatgggagttttggaaatcatccacacagacatatgtggtccatttaatgtaaagtcagtggatggatttgatttattcataacattcaccgatgactactctcgttatggatatatctatccaatcaaagaaagatctgaggcattagacaaatttaaaattttcaaagcagaagttgagaatcaacatgattgaaagatcaaaattgtaaggtctgaccgtggtggtgaatactatggtagacatactacttatggtcaaattcctagaccttttgcgaggttcttacaggaaaatggcattaaggcccagtactcagcaccgagcgaaccccagcaaaatggagtagctgaaaggcgtaatcgcactcttatggatatggtacgaagtatgttaagtcactccattctgccggtaaagttatggatggaagctcttcagacagctgcacacattcttaacagggttcccagtaaattagttcctaagacacctaagacagctgcacacattcttaacagggttcccagtaaattagttcctaagacaccttttgaattatggactgggaagaaaccaaccctaaattattttcatgtgtggggttgtcctgctggagcatgagtttttaatccaaacatgagaaaagttagacctcaaaacaatcagttgtcattttatcggttatcctgataagtcaaaaggcatatagattctactgcccaaatcagtttacaaagtttattgagacaagacacgatgtgttcttggaaaatgacataatcaaggggagtatgacacccagagaagttgttctggaagagaaactgaattacgttccaatgcctctaattgaagaacccgttttctcaacacatactcgtgttacaccttcaat

SEQ ID NO: 41758 - DNA, 8961 bp, Oryza sativa
tcaaggcagtggtatctaaagtttgaccaaatcataagacaatttggttttaaagagaataaaaaggataattgtatatacgctaactttaaggagagtaagttcatcttcctaatattatatgtcgatgatatactcttggccagtaatgacaaaaatatgctactggaaacaaagaaatttatggcctctaagtttgaaatgaaagatctcggtgaagccacctatgtgttgggtatagaaatttaccgagacagatcgaatggtgttttggggctatcctagaaagcatatatagaaaaagtactgaagaagtataatatgcataattgttcagcctcgcctgctcctataatgaagggtgataagtatgaaaaattccaatgtcctaagaatgagtatgaagctgcacagatgaagtcaataccatatgcttcagctgttggaagcataatgtatgcacaagtgtgcactcgccctgacttagcatttgttaccgggatgcttggcagatatcaatctaatccaggtctagagcactggaaattagctaagaagaccttacgttatctacaaggcactaaagacctcatgctcacatatagaaagtctaaaaaccttgaagttgttggttgttcggactctgatcttgcagggtgtgttgatgataagaaatccacgtcaggttacattttcacccttgcaaggggagctatatcatggaaaagctccgaacaaagagttactgcatcgtcgacaatgcaggctgagtatgtggcatgttatgaagctactggacaggcaatatggctgaagaattttatcctgggattgagagtggtcgacagtatatcaaaaccactcaaattatactgtgataacaaaccagcagtatactatgcgagtagcaacaaatcaagtgcttctgccaagtacattgatatcaagtaccatgttgtgaaagaaatgattcaggatcagacaataagcgttgaatatataaacactaagttgatgttagcggatccactcacaaaaggcctaacacccgttgtatttaaagagcatgttgccggcatgggtttggtagaaaagcctttgatcctggaataagaaggaacctatatggcactgactccccataaaactaaggcggactcattttgaaattaaataggaaccatagtcacttggttcagtggtgcttaattgattactgtaatctaatgtcttgatgtactgttttaatgaaaagtgagtccataagtttgtatatgcctaatgtaataagttcaaagagctcgtaagattaaagaagtttattttaaaatataatggtgtgctatagtcactggattctgttatgctttatattggtcactgtaatcttttatcttggtatgctattatgttgagagatggacttataaatttagcctcacgattaagggggagaatgttagtgtgaaagcaaatatgatcttgcggctaaaccaagtcggcagagatattttttttgggcgatcgctatagtgaacgacctctcaagagcatcctttattgggggatttaccgcctcttctagtgccggttccccctgtgtgcagtggctataaatagagataaatacctaagtgttaaaccctaagttttcctttgctacccgattaagcaaaacccactaaaacatagggaagaaccgagaaatgattctctctgtgcttccaaatgaaaagagaagaaagaagaacaaagacagagagatgggaactcctagagatcaaggtatgacccaatcccatttcaatttgtagttccattttgtgccaaaccgatccaaatcatgcaatccaacaccattctcctccttattcttcttcttcttcaccttcgatgatgacgatgacgatgatccagtctcctccttattcttcttcaacttcgccttccgcacctgcattagggcgtcgtggacgttcatggcagcgtcggcgtgcggggcgtcgcctctgaatgcattagggcgtcgtggacgttcatggcggcgtcggcgtgcggggcgtcgcctctgaagtagtgcaccatgaccagcccgagccggccgtcctcatggccatccacgccatggctcagccaccgggaacggaacgcccacagatcgatcatggcttcgttggccatggcggcgttcttgtccttgacgtcaaggtggttttctttaaggaattcggaccattccaggatgagccggtaggcgtcgttgcagttgaggaacttgcacttgaggtcgtagtcccggccggtgcggtcgtaggcctgcactcgcaggccctcgtcgccgtcggcggcggccttctccgccggcgtcaggagctcctcgaacgggaacggctcgtcgccgccgcggtgcgtgttgtgccagcccttgcacgacatgagcagccggtgctgggcgacgctccggtccgtgaacgtcatcttcttgccgtagacgcgcgccggcggccgccacggcgaggcgacgaggtaccaaaggttcgcgcggaggttgtcgtcgacgacggcgatgttgtcgagcgtcgcgcccgtgtcggaccccgccgaggtcgtcgacgccatgtcgtgccctagtgcggtccagaagaacgcgcggtggtcaggcttgggcttcttggctcccggcggcggcgtcgcctcatccgcggcgacgtgcggtggtcggccggctcccaggatggcggcgccgccgatgagcttcttctcgacgggacggggacgccggcgcgcggccggagcggcggccctcaggccggccagcttgcacttccggacattctctttcatgctcggcgtcatcattgcaatggcgtcttcttgccgtcgaacacccaggaggagggtgtcagtgtcaccgccgggaggcaggtcagccggtgcgccgccgctgacgctcggcgggctctggtcctcggcgaccatcttccccttccgcagccggccctcgcccaccaacgtctcgccgccggtggcgcacggcgcgctctggtccgcggccgccgccggagctccaccatctggattgccgaccatggacggcgtcgacggcggcggcgcctgagtcacagtcgccatctcctcctccaacgccgccgccggcgatgtctcccgccgggagaccgcgtcgaacgacatcggaaagacgaaaacctgaaagaaatcgacgaacgatctgggagtccggaagaatgacggtcggtgcaatttatttataaactgttatgcgtatagataccatttgtactggtaactgtagcagatgcgaactctatctcgttattttgtattttaaattttatagatagaaaggtttagagattcaccgggttatcttttgtcgttttatattccaaaaatattaaaacataaaagtaaattaaagtcacaggtggttccatggtctagcggttaggacattggactctgaatccagtaacccgagttcaaatctcggtggaacctgtttttgcaacttttttttaacttttttttccagtggtgtaacgagcatatgatgtttaaatttcattgtcaagataaatctcctatgaaatcgcaattctcaagctgattatttcattgttaagataaattcctatgaaatcgcaccgaattttctcaagctgattaggacccctttgaatcgcaggattgagaaaacgtaggattttataggaatataagtgtaaaacataggattgcaaaagcacatgaataactattcgattgaaccgcaggaaaaacacatgaattggatgagaaagataaactcaaaggaaagttaccaagagattgaagctcttactaaattttctccaaaatctctatagaattatccattccaaaggaatttcaaaggattggatagaatacaatcatttgtttcaaaggtcttcataggaaattttcctataggattgaaatcctccaaaattcctgtcacagcctgaatttcgtttcaggatttataaattatttaataaattattaatagaatttatattaaatgttcattaatttacaagtgaagttaaatgtgggaaataaaatttcctaaatataaagcatggttggatttaatttttattaaattctccatgattaattatactctctggaattttcttggattcttcagagctcaattattaattttaataatacaaagaacagtttagcaattatttaaataataaattaattattaaatgatctggatattattatattaaatactttgagtgtccaagtatgttcaagatttttcttggaattatttgagcattggaagtatttttaacaattgaaagatcatctcattagttaatttatttggaaaagtaaataaaaatcctcctcctcagcctgggccgaatccagcccattccctcctttcccctctcccttcctctcagcccagataaagtctgtttaacctccctggcgctacagtactccatcttcctcctccagccgactgtctcccgtgccgtgcacagtgccgccgcctcctcccaccaatccgacctccccgttgctcctctttccaaattagttgcgggaatggaatcccctcaatctcctcttccttttccccaagaaatccccaaaattttctatggaaattctttccaatttcgcggatcaaatccttcctttttccggcgagaaccctagactttcccgagtttttcccgtcgttgtgggcttgatcccgagctcccgtgcctatataaaggaccccctagtcgtcctctacccatcccctcaagtcccgtccgccgtcgtcgccggaatcgctctccccgcgctctccctctctctccacctctggcagccgctccagccgccgtgcgccgtcgacccggccgtcgccggtcagtgccgccacttccctcggtttcgcagtgaagagctctaccccggccacccgttcttttgcgccgaaccccgccagaagtcgccgtccccgtgaaggccgaaccgttgccatgttttgatctccggcgaggccctgctgctcatcccgtcgtcgccttcggtcgccgtcgcctcctttgggttggcagctgcgaggtgatggccgtccacccctccgttatcgctgctcgtcgccggaaagtcgtcgccgccatggacagtacctcgccgcccttcgaagctcgttgtcggccatcttccgtcgctgtccgtcgttgcgtaagtgttggtaagaatcgccgtcgccttctctacctcccggtgccctccgtttgcatttttttgtgccgttgttcgccggcaaccgccgctcccatgccgttcgccggtgtaggtttttccctagggtcttaatccaatataatctaatccgcggtttgtctagcgttgtcgtctccatgtgttgctatcggaacgttgtcatcatctctccctctccgatcattttggttcggtgagacttctatccgttttccctcggtttagtttttaatctcccgtttttgttgtcgagtagtcgtcgctctgccgtagccgtgtgccgttgtcgctgtgccgtcgccctaaccccagccgcgtgtctccgccgagtcgccgccgcctagccgagccaagtcgccctagtgccgccgtgtcgcagctgtgtgcctcttaaacctagccaccggtttagccgcggtcgttgttgagtcgttcgctcgttcgttcgaacgaggtgttccccgtgcttcgtccgttcgtctgtgttgagtcgtcctttagtttagagcctttcagagccgccggttccgttcgccggtttcggttgatcatttgggtgatcccgtgtcacgtagaattgactcgttgagtcggtatctcgtgaggttcgcttgcaagattaatcttagccgtccaaaattgatataaatccgttctttcttttcaatgacatattattcctttttaatatatgtcatctaccaaatatgatctaatctttttccggaggatgttttaatcttctgtctcagctataaatcatttgtaaattgtttaattaatttggaatagtcttttctttaataggtttaattggaatttaatcttgtaaaatttgtaactaattcatatgaaatcggaatgaggccgttcaagtctctaaattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaaaaccgattattgcaaggcaagtcacacagatcctaaacacaatcctttgagcatgttgatcctatatttaaattctttatttatttcaactgtgcatttattttcgaatgtcactgggtggtgtgaatctattcctttgttatggcatgtttgcattgattactttattccttgataccttgggttattataacatgactagttgggctatatatattggttcagctagatattagatatgattacttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacggaggtcgctggggagtccatgccttgtttataagagggtgattatgatccaggaaaggtgcgctgtggtggattgtgttgtgcaaggggtattgtcacagctcctttccgagataccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaatagttatggatgttatacctagtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaaagctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgtctcttaaggaagtatttatcgttttagttaatttgatgaatctgtatattaaattgtcagtttgtgtacctcggctgattcctggacgaggattttatgcacaaataagttcggaaattactagtgaatttccggacgtgacaattcctatgtttttcctccaattcaaatgggcccttagtggatttgctcctcgtcaatttgctgacactgatagagagaagagggaggagtgaggataacatgtggggcctaccatttttaattattttgtgtgtcgctgacacgtgggcccacggttttattatttttccgggatcaaattgccacataagcgccacatcaatgccacgtgagacgaatacctagtcaaaagagccacataggtgcaacgtcagccaaaatcaccttgggacttatgttgcaccggttttgaccattgagggacccgttgtatctggttttctggttgaaggatgaaataagtttagggaccttagatgaacttattcctttaaactatggcagaatatatttagggaaggcaacgggacgggtcgggggtgggtggaggtagaatgcccccggccctggcccagcattcttcgccccgcccccgacccagaccaagagttcggggcgaaatctacccccacccccgccccaggcgggtccccggaacccgaccgggcccccgcattggatgcacaacagcaaaggagaacgatgggggcagcacaacgaagcttgtgggcggaagacgttgatggtagtggggaagcagcgaagagggttggagctgtgcttgacctgcacgttgggggacgatctcaaccatcatgcatctgagggctaggaatcaacaaaagacgtcggtcttcaattcacgcgagcattctcttgtttgaggctaccctttcaggcttcaactcgggaggaataggagaggagaacgtgcgccgagggcacaacgacgtggtgcggcgccgggcgcaaggaaatgcgcggtgcggtgccggacgcgattgcgcgaggagcagtgttgggcggttgcgcaacaggtatgcggcggcaggagatggatggggattagggttgaggtggattgcattgcatctatacctgctcgtgtgggcttctttgggctgattttttaatgggctatcggattgctgctggacagattatacaagtttgtcttaggctggattttcctatggtctactggatgtccgggtccccatgggggcccgcggatgaactagctgccccgcccccgtccctgcttgtttgcggagccccgccccccacggggtcatctttcgccctgtccctggccctgtaggggc

SEQ ID NO: 41759 - DNA, 1496 bp, Oryza sativa
gaccgacggctaccgcggcgcgctgtggccggatctagtcgtcgtggatccttgtggccatcgcagatctgtcgacgtcgcctctctctctcatcgccatgccgctggtgaggggcaagaaggggaaacaccaggggaggaggtaggggacagggcactgggtcgccccaacgcgtagtctcgaggaagtgtctctggaaaagagaaaaagagagctgaggagccagaggcgtgcgttcccctcgtgggggtcgcgcctccctacagggacacgccgcgcggacgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgtgcacagtttttttttttaaaaaaaaagcaaaggaaatgtgtaaggaaaaaaaaattaaaaatggaaataaaatgtttaaaaaaaagtaatgatttactaatgttaaaaaatgaaaaaatggtatttaaaaaatggaaataaaagttttttaaaaaagtaatgatatgctaatgttaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatc

SEQ ID NO: 41760 - DNA, 2554 bp, Oryza sativa
attttccaatatttcaaatatttttgtttcatgtgaaagacaggttcagttagaacgtcatcattttcgtattctttaaataaagtaacaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactctccaaagttaaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacacaggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccgtgccggcccgctacagtagccgtgccgtgccgtgccggcccgcgtgctcggccagcggcccaagcacggcccggccaaacgggccgcgccggcacggcccgttactgtagcaggccgtgccgggccgtgcctgctacaggtccggccgtgccgcgcgcggcccgtttggcccggcccatttggccacctctacgcggacggtgtgagctggggaacgatccaggggcacgcattgaacagcccttaggaatgcttcctgtcacaagtttcagctgtaccggataattctgatggcacttagcatcaatacaggagctttggaagagtttccgctcagtaccgtacgtcatcattcttagtgttagtctacagataattagaatcaacagaaggaaatttactagtcacaactcacaagtcataaccatttgtcttagaggccaaaagactgggcaatggcagccaaactaagagtttacaatcactcatccaggagcatcagtgcatcactaccgagttcaggccagatctgaacactacatatcacagtctacagcaccaaaaa

SEQ ID NO: 41761 - DNA, 2521 bp, Oryza sativa
gatgtacttccagttcagcactgacggctgtatggtccggactgcctcagcagtgccctccccgccagagtcatcatcctctgaagacctcgtcttctcttcctcattgctagggtctacaggtttctcagcctgtacacaatttcagtaacgcaacaagagtttgaaaacctcagaagtcggatcaagatattatccatgttctaaaaggcatttagaaataatcaatcaactatgataatgtcttgcgctgacagctacgtctgagatctcaaacagatatgctgcttacaaacttgtgcgtctttattagaaagaagaaagcggaattacattgcaacagaaccaagagaaaactgtttcatacatctgtgtgttaatccaagaaatttcaatacagttgtacaattaattcatgtaaacataattatataactatagctcaattgttaaaagaagttttactacacaatattttaaaagtaatgagatagactgacttgagtacatacaaatgcgtacttactacgaatgagagattgactgacttgagtacatactacgaaagtgtagttactaccaatgggtacttgggcttttagttgctaacacaacccaagtcgtacctgagaggttgagcccaatctggccatcttacacaaagctcaacctaaccacaaacttaaattggcaggttcagcccaaacccaagctagacctaattacttcaccacagcaaatgttaacttactaatggcatgagtatcaaatagttgtggatgatgtcgaccaagcagcagcaatttataccttttttgtacagtatgaaaaagagaatcaactaaagataattttcaccttagtctgtgatgaagaaaaatcaggaactatttcctccgctaatttagtagaatgaagctcaacatctttgccagtaacatttttgctcaattgagtgtcatccttaacacttcctttgcacttctgagccaatatcttgtttttctttgtcaacaacgaaatctggagccatcagaaaagaaatcatcaaataaatatggaacagcaacagttcaacttactgcttaacatagattaattcacatttggtagaatatgagttcacactgtatttagtgtagcacgagtcatacgaagttttccttcctaaaataatccaaaacacttaccattgcttgaattggaaaacaaaacacaccatgaaaatagtatcatgtcagcttttttccaccacaaagttttagattttctgtttacattcaaaaggtacatgcagatctttgaactttgatgcactaaagctaggtcacaatcccccactgtgtaagtctcacctcacatcatgtattgtcttgcttaccttttgcaacaagaataaccaaactttgcaaataatgaaaatggttcatcggtctaaacacaagcatggacttcgaacatagtcataaacagatatttggatttacttagaatactaaaaggtaaggttaacatctagtcttttttgtatcaactcatgtcttgctaaatttggaagcaagaccaatccacagtgtcattcaacacagtaaaattaaaaggtctaattgaagatttgtatctttttcttgaatcatgtgtttccaaactatgcacgagtagcatgtatatataaaaaagctaaagtattgacaacggcaacaaaagtgtattcggtcgcgtatagacctgttgatgaagtcgttctctttccaatgcaagttttgtgaccaaatcagtaattatttttgttctgattccaatatccttgacggtagacatcttaacatggttggcttcatgtaatgagttctctagactttctgctcgacccctcagaaacgatagctcctcactaagttctaagttagtgtctgttaacaatgtacacttagattcagcattctctgctctggtttcagcttttaaaacctttcccttcagatcatcaatcatatgttccatgtccgacattgtagatctcagcatactctgctgttcaacagtggcatcaagagatgcctttgcatgctctaattgggtatgtgactccttaagtttcctctccaaaaggctagtcttttctgaaccatgacttttaagagagtttagctccccattaagttctatgttagcttcagttagctgcatgcaccttaactcagcattttgtgctctactttctgctcttgagacatcttctttgagactcttaataatgttttctaatgtgcttatctcggcatgcagcacattctgctcctcctgaaaagtttctgctgatgcctttgccaactgcaactgtgaatcagattccctcaactgtttttctagctccttaaccttatcctgcaaggatggcaattcaggacttggatgagtttctgtgcctccactatgttgactcccttcttgaatattctctgcgttgacttgcagtgaagataatcccatcaagctttctcctaacttcgactccaga

SEQ ID NO: 41762 - DNA, 11690 bp, Oryza sativa
ctcacttgctatcgattgttctaacatctgcaaaacatttcttcgttgatcctctgtcctcatgctagtgtgggatgacacaataccattttcatacccagcgtctccagtaatgcctgtataattgtagttagaaaagagtgctaattgatgcatataaaacccagggtaactgagcattaccttctttgtcatggggaaactctatggctttctcaaacttggctgactcttttctgatatcagaaactaattccttcatctgctttaaagacaccatagcagcatctagcctagctttaatcttgcctccagattcatcttgacaaaccatatgctcaacattttgaatatcagtctcaagagtactgatcatgtcatctaactcccctacttctgcatctagaaaaccatataggatgtccaattcaaaagcactctcggcagtttcagaagaaacagattcgtcttccaatgtaggaggctcaaaatcagtagccttgcgagctatctccatcaccaacatctctagatttagtaatttctcagaggcaaatgcaagctcaagttccactctagtaataatttccatacttcctccttctacattcattccatctccattacccatgttttgttggaaatggtcatcatccatactgttctcaacatccataactccttttctgcctgctacacatttggttatacacaaaaagggagacatgtgagatacaagaaatgcacaaataggaatattaaagaccaaaataaataaaatgaaaaagaaacaataaaaaaaattatctatcataagtgacgtttgtagcttctggttcatctgatggaccaaaggttttaagagctaatagcattccaaaaacacctaagagtgtttatattaaaaaaaaatcagaaaatgtacacatcagaaaaccaatcatgttggagcctgattggacaagaacattatgggaaaatcaagcttatcaggcatcggtccaaaatgacataggtaggtagaaaaggcccagcttacatgttcccccgatatcgtcaaccaatttaacaagcattaacctcggtaaggactgggacgcaatactactatttgagagaaaaaatggagggacagaaagaaacacctccccgaatgaactaacaagaacagatcagaaggaaattcaacctcatgatccaacaccaaatagaatgacaattcgtcctatgtgctccattcagcacaggaaatgctgaaattgggcttctcctaactcgggtcagtaatcctgatggattccccctctcctccaagtcggatttgctgttcatggtcactatgaccgtacaaaagtgctctgctttcgtgcgcactacatcatacaaaaccaaaccaaagcgccgtatcagccgttatcccaattcccaccagcaccagctagtccccccacccacggggtgatccagattcggcggccctccgcgcgcgagcggttgacccgaatctctcgctgctcgcagctaaaagcaacaacctacctaccagtgaaccacacggactagactacagagcaggaggcatcctcacgccgcgcgcgagcaggaggcggcgagatgggagaggttgcctgcggcttgccgttacctgggctcgtcggaggcagcttgccgccgccgccgccgtcgccctcgcgatctccgccgggaagcgaggcgagatgatgaggtggccggattcggatgctgctccactcctctgcctcgcctcctctttgcctttctctctcctccctttccttttcagaaaattaaaaggaaatggaaaaaacgaaagaagtgggggagacgtgcgtgccaactaggcgcacgtgcggcccagaaacggacgacgtggaaacagcccacgggccggagagcccctttgccttcgtcctcctcagcccagaacagccgatagagagacgtccattgccgccgagaaaattgggtattcctaatgggcgggtgatcgccgagaatgctaatgctaataggcgggtgatcgctcctccgtccgcccagcgatcacccgcccgccccctcccctataccgtacacttatccctcctctccctccttcctcctccccttcttctcttcctattacagtacaccacataaaatttttttaaaaaaataaaaaattagaaaaatttatgtatagaaatacttatatataaaaattttgaattcaaattcaaatttaaatcgggtatataaacttttgacttataaactttgggtctataaactttaggtgtataaactttagatgtatagaaatactatatatatagaaaatatttgaattcaaatttgaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcgggtatgtaaacttttgacttataaactttaggtctataaactttaggtgtataaactttagatgtatagaaatactatatataaaaaaatatttgaattcaaattcaaatttgaatcggatatataaacttttgacttataaacttttggtctctgaactttagatgtgtaaacttaaggtgtataaactttatgtgtataaatttactaaaataggaaagtaatgcggtgccaaaaaagaaaaccaggtggaggggtagagggagggaggggggaggggatcgatcgctaccccagtatccgggcaatcgatcgcccattaggatcccccgctttgtatgccatattgtattttgatctctctaaattactattttcaaatgatgtttagtttggtctatccatagaaaaacagacctataacctatacagttgggtggcacacgtctgataggatgtcaatggcatgctagttagacgatgtacttctccatatccctctcttgcagcacataacgacgatgggccaaacaaataaagtgaggccaccggagttttagggcctcatcttttcgtgtatgctgcttatcagctaaaatttgaattttcaatcttaaatttgaaactgattttgagatttttttttatcaaagtttacttttcagcctttgattttagatcgctaagaatacgtatataaaatttatattcagcatttgcaaataagccatttcgtttattccgcaaagagatgccaaagtgcattatcttttaaagtgataatttaatgaagccaaaataacccgtcgttgaagattgcatagcaattttctcatggccgccgcggccgtggtggattggttgactggagggagctgttcgtctttgacgccttgacgggttcccgcgggtaaggagaagtaggggccaagaaaccctaggtttccagttgattggagggtttgactgctttgcagcgagtacaaaaactgggctcgacggcggccatgtcgcagcactctttccgcctccaaaccactggagcagccgcagcaagcaacctcttcttcttgttctttcgccgcctcacaaatcacaatccccccggtatgcaaatgcaattcctccttgttcaaatgttgaggatgcgatacttcatttttgtttaaatttttttagggttgaggggattatgtcaagtactgtagtaacattttggtttgcgttttttttccatgtgcttcatcagggtgtaaatgaactaaggggaaggaagggttctagactggagattgcattctggtcatataccaaggtactagatttttgctttgattgtgataaatctacaggaacgaattagattgtagataagaatcacagttttcaatagcctctgtttgcctgcaaattatcatttaaatatcaaatctcgttgtagcaaacttggaataatcccataccttcaattgtttttgaaaaaccaacctctttgcatgtatttcatcagaaaatgtttaaactcaggtctgagttattatttcagaaattttagtgaattagatatgaaaagtgaaatagggacgagatggctaatattgaagtagatatggactatccatataaacgaatagatatttcaaaattgaaattcgaatataatcttgccattaaaactagactaccaaatgtgctggggatggggatctgaaggtttacagcagtgtggccaacttccaaaaacaaaagctttaaaatttaaaaagcatgacaacctgaaacatttcctgaaaggcatgtcttttctgtgatagttgtgatttagtgagaactttcaacaaatttgctctgtacatattattgaatcaaaataatctactcatagatggtattgtctgttaccctccttgctttgttggattttgctactttgcatcaactatagctttccatatacttcacaagataactatttatctgatctgtttcatgcgactttctttgtcttgcattatgcaaataattctaacttttttgccacaatattctgttattctgttgtttactctcagtaaccactttattttctatcacaaatcaaagctgttcacaagtacagtttatttgggggttttgcatactgcattttaaatcaatctaccattggaccatacactggattcgtttgtagtttgtttcaggttttttgtacattacaaaaaatgtttatttctgtatttaacacccttttgttggttcattaggaaaagagaaaatgtcatctagttatgatgaagggaaaagttttgctcggagggaccttttgcttaagatccaatctgaagtgcaaaaatgttgggaagagaacaaggttttcgaagcaaaggctggtgatacacctccaagccctggtgaaaaattctttgggaatttcacatacccatacatgaatggcatgctacatttaggccatgccttcacactatcgaagcttgagtttgctgcagcataccacagactccatggctcaaatgtccttttaccctttgctttccactgtactggaatgccaatcaagccatcagctgataagcttggtaaagagatacaacagtatggaaatcctccagtgctcccacctgccaacaaaaactcaaaatttgagttgacaaatgatagaatttatggccagaccactgctagtgcccaagataagtacaggagcaagagatctaagtcagtagcaaaatctggctcatacaaatcccagtgggagatcatgaggagctttggcattgctgatggagagattgtggaatttcaaaatcttcatcattggttaagctactttcctccgctggccatggaagatctcgaggattttgggctaagttgtgattggaggcgttcatttataaccactgatatgaatccattttatgatgcttttgtccaatggcagatgagaaagttgaagaaaatgcacaggattgtcaaaggcaagcagtacatgatctactccccattagatcgccaaccttgtcttggccatgatcgggcatcaggtgaagaggtcgagccacaggaatatgtactgattaagatgaaggttattccgccatttccacccaagttgatggtcctggaaggcagaaatgtgtatttggccgcagcaacactcagacctgagacaatatatggtcaaaccgggggcgaagctacaggtaatcatcggggtcagtagaccccaacgatgttttgctaatgtccagtacccctcttattttaccagctatgcccccaatgaagagctaaactagaccccagtgacatccttgattgttccatcaaagagcaattctatactagtggtacctcatggtacctcctcaagaaccgtaaaattgctctccatcaaagctcaactggttactataggaacgagatactagcaagcagcaaatagaaaatgaactagcagttatgattatacaatggcccaatatgcatatacgattgatatttgagcccataaataagatcggaagacactactccacaaattccctggttgcatcatcatattcctcgttgtattgcatcggcatcgcacgtcctgacatcatatttatcatattttattttatttccagcataatggaaggcaaataattagtggttttgataatctttgatgcatttggtgtcttttacagcttgtaaaataatccaataatgtacatgttttaataattttatcgacagaagctgtaataggcaagatgtaacactactacaacaggagttggctttattttaataattttgtctcgtagtatgtagtctctaattacaagctgtaataattatgtagttttatttccgatttactgttggattccaaccagccgtatggcatttttcgcaaaaatttgattaatcttgatcaaattttggtctacttttttttattcaaaaaataattctcgaagaccattcaaaatttcactcggaatctacttttgccctgcgtggaaacatcaaaattgcatggttttcgatcggttttggttgaaaacgtaaatcctgattagtacgaatactgaccgcggtaactatttatcctggcttcgcccctgggtcaaacaaactgttgggtcctccttgatggaaagtatgggccttttgagataaatgaaaccgatgtttttatattgacagcaagagctgcacgtaatcttgcttaccagatgctatccagagttccagaaaagccaacttgcttagttgagctgcttggcacagatctgattggtttgccattgaagtcacctcttgcctccaacgaagtcatatatgttcttccaatgcagaacatattagtagataaaggcactggaattgtgactagtgttccaagtgatacaccggatgatttcatcgcattacaagagttggtaaaaaatcaagattttagagtggcatgtggagtgaaagatgagtgggttttcccctttgaagttataccaataattgatgttccaagttttggaaataaatcagcagagaaggtttgttttgatctgaaaatggatagtccagatgagaaagaaaaacttgctaaagcaaaagagatcacatatttgaaaggcttcgatgatggcataatgattgttggtgagtttagcaaccgaaaggttcaagaagtgaagccattgataaaggaaaagctattgaaggcagatatggctgttttgtactatgagcctcaggagaaggtcatttccaggtcaggtgatgactgtgttgttgctctcacagatcaatggctcataacatatggtgaggctgaatggaaacaaaaggctatagaatgcttggacaagatgaatacattctcagttgaagcccgtaatagttttgagcacacattgaactggctgacttcacgggcccgttcatgttcttttggactaggtactcggattccatgggatgagaagtttcttgtagattctctttctgattcaactttgtacatggcctactacaccattgcacatatactgcaaaatggtaacatttatggatctgacaactcttatataaggccagaacaaatgactgatgaagtatgggattatgtgttctgtaatggtccggcaccaaaaactagcatcccctctactgttttgacaaaaatgaagcaagagtttgagtactggtatcccttcgatcttcgaatttcaggtaaggaccttatgcagaaccatctggccttctgtatcttcaatcacacaacacttcttccaaaacatcattggccccgcggattccgttgcaacagacaccttctgcttaattctgagaagatgtctaagtccacaggaaatttcaggacccttcgacaggccatagaggaattttcgtctgatgccactaggtttgcacttgctgatgttggtgacggtatggatgatgaaaactttgtctctgagactgcaaattctgctgcactaagactgacaaaagaaatttcatggatgaaagaagtttttgatgataaatcttcctttcgacttgggccaccatctacttatgctgatcgcgtctttgctaacgagataaactttgccatcaaagacacggaaataattatgatgcttccatgttttgagatgctctaaaagccggattttatgatctacaggcagcacgagatgagtacagattttcatgtggagcaggaggtataaaccgtgaattattgtggcgttttatggatgtccagaccaggcttatcactcctatttgtccacactatgctgagcatgtgtggcaaaagatactgaagaatgaaagatttgtagtgagagctggctggccgattgctgatgatccagattctactttacgaattacaaacaagtacttgcagtcctgcatagttttgatgaggaaatcgcttcataagcaggaatcttgtcacaaagtggccaagaagggagctgcagcctctacaacatttgcggaaaataaattatcagttggtctaatatatgtgaatgaacactatgatggctggaaagagcaatgtttgagagtactccaggacaaatttgacactgaagcaagatccttcactcctgatgaagacattattgatgctctggtgaattgctcttttggacaggagctaaacttgaaacaaataaaaaagttaagtgtatgcctttcattaagttcaagaaagatgaagcacagaatgttggttttcaggccctgtaaccaaatcttccttttggtgaaatggagattcttgaagcgaacaaggaacagatcaaaagacagttgggtcttaatcacatagagatattgtcatcctcagatcctctgatgaggctggtgcaaacagagctggttcatatgcttccgtgctcaggaaaaatccaccttctcctggaaaccctattgcaatattcttaagtaaactggagttccagagtcaaacttgaaaatcactcacttggtttcggtaataacagaacactcaggttgctcctaacttgtcttatgcagataccactcatgctgcctttcaaacaaatagtttgttgtgtataaaatttgtcttacagtttagaaagcacaaactgtatatgaacctcgtatagaaataaatcattgtctgaacattgtacagaaatgaaccttgtaaataagtgtcattctatctgaaatttgtaaaggaatgaacctttgttatgtagactttgtttttagttgtatgtagtatgtactgctaatcattgcttcttcagtgccttgtgttcatcgtcccactgttgtttagttattagcagtagaagttccttaatttgagagaatccattatatgccactgattttgtcacacgtctacaatttaccatcgactttatcatgttctataatataccatcgacttttgcttaaattctacgatttaccatcaccatccggttagcctccgttgtactgtacaattttgtccaaataaccgaaatacccctaggacaaaaactttcaaaatttggataacaaattcaaaatatcatattataaatataagattgtaaacatccaaaatttggccaaaaacataaaatcttatattttagaatttttatccaaattttgaaagcttttgccccaagggtattttggtcattttgacaaatttgtacactaacggagactaaccggacagcgatggtaaattgtagaagttaagcaaaagtcaatggcatattatagaacgtgataaagtcagtgacaaatcgtggacgtgtcacaaagtcagtggcatgtaatggattctctcttaattttaacagatactacatgctgtctatctcgttgtggacttgtggtagagttcgctaaagaagtacggagtactaaattgaacaaattattggtctgcattagtattctatatttttgtatcgtactattgtagtagctcaaagtgatagccggacacagtggaatgctgccggtgatctcaaataaaacattagagatttttatagactacaaccgcttaggaatgtttttttttctttttctttttcttttttttaaaaaagagcatgcatgttaaaatatgtctcacagacaaaagaatgaaaaaaaaatggtcatatgtatctctactattataaaaattgaagatgttttgccggtattttggtacgtcattcgtgtatgaatcggtttttaaattcgttcgcttttggaaatacatattcgtatttgagtcgggttttaagttcatttgcttttagaaatacagaaggagtaggataagaaatctctttttttttaaaaaaaaatatcgcatgctaactttagatgatcggtctcctaattgcagctcatgattttgtagaaaaatatatccaaatgaattctcatagtaaatttcaccttaactaaactttataacaataataagattaaaatagcttcctttgcaatgcacaggtattttttctagtattaaaaggagagaaaaattaacgtgcttttttataacctatgtctttatcttaaacttcagttaacactacacctagtttgaacttatttgcaacacatggattttgcagcacttttatataaattaaattgattcatgaatgaatgctttatatatagttcttgcattctaaagaatgcctttggtatgatctgaaaccattcaagcgaattgcgccctcaaatttccttgaatttatttctgaaacaagtagttgtaaattgttttgataaaaatatatatattgagaagtaataggcaatagcacttgatttcccaagaggtgagttcaccatcaaatggtagaggcaaccaaactcaaccatatgcaagtacccaaacacattctcagcgcatctggcatcccgtccatctcttatacaaccaaccaaacactatcttacactatccagcctcatatgatacagacaaccaaacactttattttgcactcactcatccaggctcatgtcagcctggatggttcatacgggtcagggccaggttggagtggtgcaaacaaccaagcacacccttatttactggatgacatatactgcatagaaatattattctttgttggctaattactctcacacgtgggccggttgttgaaggacaaacttaggacaagtatgcgtataaaaaagagtaaattacacgaaaccactaaaattatagtgcaagttacataaaaatatacaaactagatgaaaccccgcgcattgctgcgagaatttaatatgataacaataaaaaaaatagcgtgtaagatagctagataacattaagattaagtaaattaatgtgatttataataatttaaatttaaatagtatgtagaatggtgattcaaacgtaaaaagtaaggtggtatgactttatggaagaagaaaaatagggggatagtttggaccgtagattaatcatctaaaggctaaaacaattgatgtgatatgacttaattagagaaaaaaagaagaaagataatttggaccatagattaatcatttaagcactaagtgaggatgaactatataagtatataggatatcataaaacataacaaagatatacattgaaacattatgtgaattatgttg

SEQ ID NO: 41763 - DNA, 14317 bp, Oryza sativa
  unsure (1)..(14317): unsure at all n locations
atggcaatggtcaaataatgagcacccatgataaaccaaaattgctggtcttttacatctccattagctgaaaacctataatgaaatgctttatggccctcaaaatataacaaaatcacttattcattcttatgtgtgatgtttctgactgacaagcgttctggacgaatacgtaaattggatttaaacaggccaggaataatttttttctgtggctttacctgtttgtgttcaattaggatcaatattacctgatctcctacattagggcattttcaagtattttggttatatgtctaccttgtagaggggaagggaggatcggcagccagctactagatttcaagtctttgacttgctactggtgtccgcgaactttagatgtcgatgaaaatcatgtgaagagcacttgtaaaagaaagggttaaggctgtgtttgcaaccccttgttcccaacccctcttcctcattttccgcttgcacgcttttcaaactgctaaacggtgtgctttttgcaaaaagtttctataagaaagttgcttaaaaaaatcaaattaatccatttttgaaaaacaattaggtaatacttaattaatcacgcgctaatggaccgctccgttttctgtgcggagggaataagttcccatccaccacatgcgaacacagcctaagggctcatttggtaaattgctgcagtttgccactctttctctacttttaatattggagtaattggtggtgatagccgttctacattctcatccttgctccgacttcacatcaacttactgatacatatataaaatcttatttcctgttggaaaattagttttttttatgcttttagtataaggaaaataaatttccgtctaaacacatatgcgcacttctagttgtcccaataatgtggcataccatgatttttgtggcaagaaaattgatgcgcaaaatttgagaacttgtatcaatggcatattggacatggggttaagaaagtgtggcatcccaagtttggcaacaaattgccaaacttatcaaagtagaatccacaaaaaactccctaaatacatcaagctagtatacatactgaaaaagttgtatatttgtatgtatcatcagttgtttcatatccaaaattttttacgttaatgatatcatttctggaaggcaatagtcaaacttgggaaagtttgaacttttgtagccgatcaactcaacggttctgaagctactgttcccagttgctgtctgccatgctattggtcatgtaacaagcaccgtgtcctttgctgctgtagctgtctcatttgcccacaccattaaaggtactgcaacagtatcttgattttatttttgtatttttggccttttgcgtttcttctttatgctgagatttttcctgcaaataaaatgattgcagctcttgaaccatttttcaatgcggctgcttcacagtttatccttggccagcaagttccattgacgctgtggttatctcttgctccggttgtgataggtaatctcattatgccttttgcttgtgttcctagcagtacatcacttgtatcttaacatcaatgcaataaggacatatgaaagtaggtttcatggttgtcaaggcccctgtgcaggtgatgcctcagcatccaagcactccagtaacatttccatgatcagatgccttgccttatgatgagggcaaatgagaaagagccaaattgatacttatagtcctttctgttgtgcagagtggacacatgttcctataggttgggccttgtgccttctttatttctttcttatttctctctaattcctatagcgtaatgaccatttctttctcctgaattctggtcatcatgatattacaatggcatatcaataagtggtgtgctacacgatggcatgcttaatgaaacctaccttatcgtgcgataaacgcaactctgtgtgtgggctttgtggggggggggggggggggtaggctgagctgccttggttattcgggaggagggaacagactaaagatgagattgaagaaccttggagaaactacagtttgattatttcactgtttattgcttaattccacagattcctccatgacatgcttagataggaaattaatattaatattctagatattatataagatgaccagggaaccagggatactctttactatcagttgtctcagtaacattcctcacagcctccatgcatctttaatcatttcaagcatattatgttttaggactttctagttgtctctatagcatctctacttctgtgcattggtaatcatttggagtatattctgttttgaaataatcaggtgtttcatggcatctctcactgaactttcattcaattggactggtttcgttaatgccatgatttctaatatctccttcacattacggagcgtttattccaagaaggctatggtttgcttgttacctctaatgatctgcatgcatattcactcttccttttgatactcccgtttcatttttttactttgttgctgttctttatcacagactgacatggatagcaccaacctgtatgcgtacatctcaataattgctctccttgtctgcatccctcctgcaattattgtaagtctaattttatctttatgcatgtttgttacatatttaacacttcagctgttggtagcaaataggtctatagatacctaaaaaggcatatcgcaacatagccgatgttaagcatagcatatttatcgagttatcaccatcttgttgtttatcactgtgttaatgatattttgtcgttaatttattgtaaaggatttgaaatacagtagaaaattattcagtattcactatgtaggaaaacaagtaaagaagtgtaatgaccagagtctacagttcgaatccatggagagaactagtaactagtagttaccagtttttctgacctggcctggattttgtgcactgaccatattgcgtatgttacaaaaaaggcaaattttgattatatgaatttgaagaaactacgaaagaatatcatgcatgtgttctacaattgccaaccaccaaggatagaatttgatccataaaccagtaaaccactacataatttagcaatttttaggagttcattgttgtgagtaaccatgttttgcaatactcttgcaagtagttgtgatttatgcatgcatgcaactcttgtgtttgttggtaaataatataaggcattttttcaattcagactaatgtgggggcataaagaaagatggtcacaatgattgtattcatttgacaacaattcctgattttcctcctaaggtcaaaactacctagtgtatgcaacacctccatttctctaattaccctaatcatgtgttctgacatggtaaaatccaattttccctttcatgctcaaaccactgttcctctatccctttgaaaaactgcacaacatttgaaaatttagttccatcacgaaacatcgcttcatgtgcttgcacatgatcttttgcagtaagcaagtaactgcatttacttttaaaattagaaatttaagatattacctgcgtggaataccagcctaggagcaggattttactcaaaattgttgttgtttttctataaccctgataataaccatttattacagtttgcgaatacatattagaaaaagtgattttagcagtttactttttgcaaagctcctgttgttttctcattccagattccatgttgcagcagagcacaatgccttcaaagttcaaactgggtccaaagcgcagagcggtagagaaatagtctgaaaataatcggagatccactgtaaccttgctactaaagtaatttgaacatcatgattgactactaagaaatgaaaatcactctgcttgtgaggttgagaaaacttgaaactgatgtcacagcttcctgttaattagctgtggttggtggccacatttgggaggaaattggacaaaccaaataatatgttttgtattcctgccctgctaactnaacctggcctgtaccggcctctccctgtccctccagaggaaattggaacgtctgtttagaaatgtgctcatgcttatatgctgtttgtataggtgtatgtatggttgacaggcctgcaagtggcctaatccaattttgatgttcgcctgtacatgtcttatgcatttgtctttggtattagtccctggactgatggtacaatgtactggttgtgaggatcaagggtagggattcccactcatctagctattggcaggtcccttgcatgatgtggtacaggctcttgaggcaaggcaaggttaaaccatagatgtaggtactgctcatgtgaactaaccgtactgtaggaaggcatgctcagctacccgcagggccttagcccatagtagtgtggttaataaaattcttttatatgatttcttttttttagagaaggtattttttacccggcctctatatccaatcggatatatataaccatttaaattaggaacttagcccctcaaacaatacaatctgaaattcgctcctatgaagatttgaactcaagaccttggggtactactcaggtcactgcaaccactaggctacatgccctttctcatgatttcttaagtccgcaagatacctttaaagtcacctacgcattatcattgactttcatgttgattctttataacacaaattttgcagattgaaggacctcaactagtgcagcatggattcaaagatgctattgctaaagttggattagcaaagttggtttctaatctccttgtggtgggcttgttctatcacctttataaccaggtaaatagcttaatgtcataatttgcccatagatcaagaatatcatgaaacaacatggtttatagatgaaggttaaaaacaactttaatcactattacaaacaacatcctcaaataacttagtccacatgtcaagaataaaaacaagcatttcccacatcgtaagttcgtaactatcaatattttgaaactaaaactttttatagttgttcagatatagaaataaatcatagtattaggcaaatatggataaattttctgccattttgtgatgatagttggtattctctcttttatccaggttgctacaaacacattagaaagggtgacccctctaacacatgctgttggcaatgtgttaaaacgtgtcttcgtcattggcttctcaatcattgcattcggtacttttaattttaatctttcataatgattgtcgatcagtatgcatattcttgttcttgccattggcaagtgttgtactctttttttgtagaacttcatatacatagttttagtgtgcaaatgatctgatgtttttgtgtaatacttggtgaacttaatgttgaacaggcaacaagatcaccacacaaacaggaattggcacttgcattgccatagctggtgttgcactctattcttatatcaaggctaagattgaagaagagaaaacggtatgtgtgtatactatatacattctaaatctcaatatttgcaatgcaccctaacgttacttcttttttttagaggaaccattgcaactgaaagtaacataaactacactagtacacacatttgaagcaacctgaaaatttttgggttttgtttggaaattttgtaaacttttttcaacatggcaagaatcagaagatactttggttgctaatacagccaagcatgaaagcacaaaatgtaaaaaaagaaagaccaagagtttccactatcatcttttggggtttacaaataaacatcacttgaagggtaaatgaaattaatatggatatatgtgcacgtcctgttttggggtttggaaaagaacatcattcaatagacaattcgaacgaccttagcttatatcttgatcttctaagtgaaactccattgcctgagtggttgagcatacatgacatgctagtccagtttgagtttgtgcgcctaattgatctttgagctggttccatcttgttcttgtgattgatgcagcaaatgaagagcgcataaggagttgaatctgtggatatagttgggtagctgctttgatcgatctgtattgcctccgagaaataaaatgagctgtaagatttataacaatctaggtgcctgctgtatctcatcttgtttgttattgtcgatttcgctttgaacagcaaaagctaccgatgcattttttttttttttgtaaattataactgctaaaaacccgcagaaacaaagcctccatcatcccattttccccttccttggctatttggacttttgatgatgctcttaagtttgagcagctatacgtaattcgttattgtctctttctggtgagggtttcaagagaaattgacaggtttttttttcgcaaatgttgtcatgacgtaaatagacaatttcatttgcttcaaatttcctatcactgttgctctcagccctgcatttggtctaaaatgttaggtacaagggtgagtagttgtcctacacaaccttttccttttttttcttccaatcctttattactccctccgtattttaacgtatgacgccgttgactttttaaacaacgtttgaccattcgtcttattcaaaaattttatacaaatacaaaaatatttatgccatacttaaagaatatttgatgataaattaagtgacaataaaataaataataattacataacttttttgcataagacgaatggtcaaacgttgatcaaaaagtcaacgacgtcatacattaaaatgcggagggagtatttattacttcctccgtatagaaaaacccaacctagctaaggatgtgacatgacaattcagtttcgttgtattatgttgtgtcttaatgtcttaactttaattagattggattttttttttgaatggatggggtatatcattatgaaatctctctttttcttctggttaagccacatcattttgacatagttcaaaggacacaaggcaacctaatcattaacatagtttgcctggatttattagcttacaatttaattttttatttagcatttccatggttgatctaagatagcttgcacaaaaccataaaacgaatccgccttcatacaaaacaaatgtatctgggacattacaagtgtagtatttcgttgtgtaaatctctcgcaacactttggattctcatctatataatcagcaacatgacaggagcgatagtacaatttcatacaaaatagaatcatggtttgtacttgaacaagctacaaaaatcagaaattatatatgcttgggctagttcgacattttcctttcctttttttctggtgactgaagatttggttgggtgaactcagacacgcgtctctgtatccaattgttgagacaaatgtgttgtctccaagcaatttttttctttacctctgttacatcatcaaccaagatatttgtcgtagtcacccaaacatgaaaaaaaaaaaaaaaggaaacgagggttggatccaacaagtaataatagatctaattattcacattactaatatattaaaccagtcagtgtgtcagaccttatctcctaccaattttaaaaaattatagcaaatccaaatcatatccaagcacaataatatcctgaaccaacttaaaacaataatatcctgaaccaacttaaaattaaaactattgctcccgctccgtctgactgatgaattagaaatagtaaatatgatcagttctctagtctcaagattatcacttaaaaaattctactatagtactctctccgttccctccgtttcaggttataagacgttttgactttgatcgaagtcaagctgcttcaagtgtgactaagtttgtaaaagaaaataataatattttcaacccaagataaatttattataaaaatatatccaattattgatttaacgaaactaatttggtattataaatattactatatttgtctataaacttagtcaaactttaaattgtttgactttgatcaaagtcaaaacgtcttttaacctgaaacggagggagtataacaaaactacaattttactaacatatatctctactattataaaaattaaagatatttttgccggtactttgatacgtcatccgtgtttaagttagttttcaagttcattcgcttttggaatttcagatttgtatttgagtagattttaaattcatttgcttttgaaaatataagagtcatataagagatctctttaaaaaactcatatgctaatttaagatgattggactcctaattgtagctcatgatcttgtaaaagcaatatccaagcaaattcctacaatgaatttcattttagctaaaccatataataataataagattaagatagccttcatcttcgcaacataccggtatttttttagtttatataaaaagaacgatggttataagttgggttgctcaaggcttccaggtgttcgacacgtcatatcaatattctgtcatcctcttgcagcgttgtacgtgtaaaagcacatgtacggcatatccgaattttgatattgtcaaattcagtcacaagtcgctctcgcgaacactagctagcgaactagctagaacacgtacggacggtcgatggctcaaaaaagtcaaatcctttagcactgataaaaaaaagaaatataatactccgtatctttatttttcaatatatgaaaccattccatcatttgtcttattagtttaaaattatgtaagtatatatatttgttgttacgtgttttatcacgccaaaggtaatttaaatgacttatttttttatatttatattaaattttgaatatgatgaataactaacgatttcatacatagagattatatatgaaaccaccattaaattctgaacctgtcgacgattagtcattatatattgggagtgcagcttcgtgctagaagtggcgtagccgtagccccggcagccgaacatgcccattattagatggagcgtgtcagaattctccactcaaaaggggaaaattaacaagctaacccgtgagagtacttttcacacctcacggaaagaatcacggtgactaaccttgcaaaagtcaattttgttttattttattacaaagggacttagcaaatgataagttagctataggattaaaactgtgggctaaggaagcctttgcctgattttacaaaagcagacatgaaatacgctgaatgatgcgctgggaatgccatcccatccttcgctcacacattcgtaggaaagtctgttcaaagttttagcaactactatcttcgtttttaatgtatgatgcttgatcatttatcttatttaaattttttatgtaaatataaaaatatttaaatcatccttaaagaaacattcggtaataaatcgataaatcaagtcacaataaaataaataataattacataatttttttaataaagatgaacggtgaaacgtatctcaaaaaagtccatggtgtcctacaaagtttaaatcatggagtccaaagaaacacaaattaagcaacataaaactagtgcattgcactgctgtcctgaaggctagcaaaagaagtggaatatgttctttttgaagcagcaacatgtgcactcttcatcctcagcactggagccgttgcagtggcgccctccagccaaacttcaatttgaattaatgatctcattttgtaacctgccttagcagtcgatctcctcgtcgtgactttttcttgtttttcgaccaaagtctttgctaagaaaactcttgcaaaagccaatagcgtgcacatctatacaatctcaaattctcaattctacaggaattctgttatgaatttcatatgaattagttcagttccgtagggagaaagagaaagcctaaaatggaaccagcaatactatcatgtaatgtaaaattatacatgaatatatatacacattagattatcatcaataggtaaacattctgtacattatgtcaacttgtcaagcttcatctcgaactaaattaacatgataatctgacacaacaagcaacagctagctaatctccaatggcagcatcagccagcagctgagctgagctgatcgatcaaaccggcagctctaaccggccgccggcggcggcggcggcgagctcgtcgacgacgtcggcgcggcagatcgggcaagtcgagtgcgagctcagccacgcgtcgatgcactccacgtggaacatgtgcttgcacgccggcagccgccgcaccacctcgccgacctgcaccagccccaggcatatcacgcactgcgcccaccccgacccggccgccgcgccgccgtcctcgccgccgccgccgttcaccctcttgtactcgaacgccgggatcgccgacacgatggccgcggcggcgacatcaccgccgccgccgctgctgccggtgctccgagcagcctgatgagcccccacgatgaagaccacgtcgttgggcgccgccgccgccgccgtgccgcccacggcggcgcgccgccgccggaccctgaggtagaggaaggacagcacgacggcggcggcggtgatgacgacggcccagatgaggccggcgacgaggtagaggatgacgaaggagaagaagatgccgaaggtgagcagcaccaccagcgtgcggtcgccgtcgtcgccgtcgtacggactacggccgcccggctgcaggtcatggtgcaccgccggcgagatcccggacaagaacatgctaaccctctaggctctagctcaaaaattatcaagtgcatatgcccaaattaatgcatgttcatctttgcaatgtagtaacacctgtacatgtgggtgattaacttatgtgcttaattgcaatgttaattaattacatgcattatagggtagctgaagcaattagcagcatagttaattcacaggataatttatttgtttgtttttgttttgtccagaagacagagtgatgaccatttggccaatgaggaggagtaagagttggggttgttaatattgactttcttcttgttgttggagacatgtacaaggcagcactcaatccagacattaatgcttggatttgatcttggtttagtatttaattgtgggagacaaatgcatgattacacttgaagcagttcagttacatcgtcattgtccattaaggttagctgaatctatgtttaagtgtatgtttgtttgggtcatgcttttatacttgtcaaccaacttgcacggaagtgatctactcggtggttggttcttcactaaataatccccataaactcagattaattcccataaactcagtggaccgtgatagcttaatcttcataattcgtgaactggagtaattgtgaagcttaatcctttctaaattgttcaactatggtgaacgaaagttgtatggttatattttcgctagaatgtatttgaatgatattttatatttgatatactaatttatttataactaaataacagccaggtttaggttgaagggtgtaaagtgaatgttttgaaaagtcaagggattaatagtctagcctgaaaaaaaatatagggttgactttcatacataggtaacaagttaaaagtctaggagaggggccggggagactcaatcggtgaatagtaccctctccgtattcgtaaaggaagtcagttatgacaatgtttaagttaaaccttgggagataaatcataaataactctcaagttgttgagtttgaaaacgtaaaaattatatgaatagatttgtcttgaaaaatacttttataaaatcatacacatatcactttttaataaatatttttatagaaacaagaagttaaagttgtgttttgaagaccatgtcactgtccaaaacggcttcctttacaagtacggaaagagtatctaggttaaaaaaaatattagggtagattttcagacttctatataagtaaaaagctaaaaggtctaggggaggggagaggggagagtcaatgggtgaatagtatctagtttgaaagaaatagttagggctgattttcagacttccataagaaaataagtgtggtggtagactatttcctgtccttagtgatttattatatttttagcacattttattttaaccataaagactttatctttgaagcaatcaatacatttgaatttcgctaaagtgaagggcattctaatcgctttgtatttgtattggtataaatgagattggttaaaatgtatttactccgttttaaaatataacaaattaggataggataaaacatattataatattgcatttttggcatagagagagtagcgtctttcaggcaatatgagaattatattgtggtatgttttggtgaatgagtgccaattaatgcaaatgttcaagaaccaattttgcctctttttcttgtgatcatcaccgcttaatatactccctccttttcaatttacttcttgttatagtaaatctcctaagatacccttattaattataatttaatcatctttttaaagcaagcattaaaaattcctttcaaagtactactatagttgcattgataaagggtacaaattaagagaaagacgcaagtgctttctaacgtgagaatgataagtatcttgacacaaattttaaaagttagaataatttaaaatggagggagtacgctgttttctgtcatttgcacttggcaatgcttggaaggatatcgctagcttcagagttcagttcattacctaacgacaatcagtgcatcgaacaggtccgatagatgaagatatgtgcaaggtactaccttacaaataattatattcaatacatttagcacttgtatgataggcaaatattaaattaaaactcttcacttcactagttacttcggttcagtttttatgtcctagacacacctacattaataacaagaataggaaaatctgacatattttctccctttcgttcttacaaacatggtcagctttaacattaaatgatatgccattgaatatctcgccactacatcaggtcaaatattcaaaacctaaagcattctcacaaaatatacaaagcttatgtggacttacgactaccgagtagatatgccctaataagtttagttaaattgcctcaaacacatctgtcttacagaaaacagctaatagcgattacaactaaacccaagagaacagtaatattaggcagttacactaaagtttagaagaatgatttcaatcaacaatgtctagactcatctcagatctcacacctgaaactaacaaaaatcagcagttagtgagttcttcgattaaagtgccatgcaaactgatcaacagccaccattgcttgtgaagcagaaccaagagaaccatcatacctgtgcattcagatagcaatgccagtaaaataaatttttggcaggaacacatttgtataatggaagtaattaaaggaaacctggtatttagagttctgtaaatcaaaagttgaacaatgagatacgtacatacaaactaacaagtaagctccaatctccataactataacaccttcaccttctggctgtactgcattaacgcaacgagcacagaaccagtgttcatggattgaggtgaccaaatctgtaaatgcagaactggcaatcacaatattgctggagataacaaatataaaattagcgtttgacgtttctatgagtggtacggttgattcagattcataatgtgagtctcttacaccggtttgagccaatagagaagaattccatctgcagattgttccgtcgaacaaagtctagaaatggtagcagatcaacagctttcagttcagttccttcttgctctgctctgggcagttaaaaaagaatatttgaaaattttcgaccttaggatcttcatcattcatgtatcacaacaaataagttcatttctttgacactgaaatctatctaatatattcacatctgctgttcagttacaaaactccgtatctagtaaagtattccttgatttagttctgcgagatctgataaaattttgtatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41764 - DNA, 784 bp, Oryza sativa
atttatagataaaatgagttttggttttcaaacaaagggatacgaagaatttaaaggaacaaatttgctagtaagcatagaatttataggaagattaactaatagaagtgcctccaaatacaaaataaatgtaaatgacgtgattgaaaatatgcactctaagggaataactttcatgagccctttaaaaataagttctgaagaaagggcaggagaagaatggaaaattagtgatttaatcgaaagcaaaactttgagtcagcctgaaaattatataagttatcaaaacagtaaagggaataccagcattagatttataaattacaaacccagaaccacagatgacttagaaacagaagcatctgatagaaatataatagataatagaagacatagtgtttcagagtttatggaaaaattagatcaagaaagtgagataaaatattacgaaaataaattaaaggaaataaatgaagaatataataaatctatgaagtgtgagtggcctaaaataagagataaagaactttatttctatagagaattagctagagtaaagaaagtaaagaagaaagaagatatggcagtagaaatttttaaaaaccacgaaaccatgatagaacagataaagaggatagagcaagataagcatggcaaagaagagcaaaatcttggtaaaattttaagtgaagaagagcaatgggcagagaatgaaagattatttcttgaaagttatgaagaacaaattaatctaataaatgagatggagaatatagaaaatgaa

SEQ ID NO: 41765 - DNA, 26246 bp, Oryza sativa
aactcacctcacttaatgaacatttcttaaaatgatagcgtgacttgaccatagaatctaatggtgcacaacactccccttcttgaatattgtcatcgattttcaaaacagggttaggtaaatttatccgaatagcatcaacgttgtacgatccatttagtttctcacatttttccatatttaaaggagtattcacatctaagcatatataaacacgatgcaccatataatctcctctattattatatttaccaatgacatgataattattccaagaaaaacatggaaaatcgtaaaatttcttctctaaggtatttagatcacaaggagcatcaaattagatataacctaaagtacataaagaagacaataatttcagctcttcttggtcatcagcgataacatagacatgtttattttgagtggaaaccaaatattcagaaatagaagtaatgtgttctttcactagttgtggcatgtatataagtgaagcattgcacaactctctcattacaagcattatcaatatcaacacaatctgaatttttagcttgtgataaaggcaaattagaaatctgttccactagaggttgctctaacatagcataattagtggacaattgtagcatatcgcaatctttcttaccttggtccagttgaccatcagttaaattacttgaaacactctcttcacctaatttaggttcttcattctccttttcttcaaaattgtttttaccttcctgcacgatgttagatacaatagaaggcacaaaaatattctcatttatcataggcatttttgtttctttctcaatctgactttcaatatcgcaagcaagcaaaagtaactgaaaaagatggctatgtgttttattttcaagcctattctgaatttttaaatcaagcccatgtaaaaaccttgtaattgtatcttctctagactcccctgtaccaccgtaaaacatataaattttaaactcccggtggtactctttcacggttctattcccttgtttcaaattttgtaatttcttttgtaaatcacgaatataataatcgggtacaaatctagctctcatcattgtttttaagtcattccaagaacccggtttcttactgacgagacaaatatcactccaccaaagagatgcaaaagtaaaagaactggtggcaactttaatcttttattcctcagaccattcataatattcaagttcatcttccacttctaactcccaatcaatatagttcttagtattaaacttaccaacaaatggaggcaacgatatcttatttttacaaacctcatcatgtacctcttcttgatgtgaaagccaatgttttatatgttcaatcccgttctctttgtacgctcctgtcattgttagtaaccaaaagaaactcacaagaaagtgttagttcctaacaatttatagatatttggagcttttgaaggcactcaacactcaagcatataccaattcttataatgttctcaaagaatgcaaaaacaggtcaatcaccatggctggttcatggcacaatgacacgcttgatgagtgaagcgattgtaaagccggacctataaaggttagtagtatgtggatcttggtagacctaactatatcacaaggaatagcaaaaatcaaatagatttgtgaaattgaataatagtccaaagtactagtcaaagttgctggcctagtctagactcaatccttgttcaagcaagcaaatgatcaacactcggactagaaacaactcgactttatcacatagtaagcaagtctctccaagattccaacaaaacaaatttccacactttcttttttttttctgatttgtttgctcttttctcttttttttctgattttttttgtgcggctcttttttttgcacctttttttttgccttttttttttgctttaacaagtggcaagtgcgtgcgcgcgcatgcacaaatacaagcagctgctagctattactgggagagaagatcacgtgcatgtatggaacttgcatgcatggctaaacaaaggaaatacaccaaggtaattacggagattaactactgaaacaaagaaaccgaaaagcaaggagactgaacttgtatgcacgagataaacaaagggcccacccaatttatgtgttgcgctgcacacagtaggagggaaacaaaagagataatctcccccaactaaaaggaaactgactgaataatttagaggaaacagatccttataatttcttgcgcaagcaacaaacttaatcatgaatcgatcaatctgctaattttcttcaacctataacgaacatgcagtgcacaaccgagatgcaaaactcaaaccaaggtgatactaggactaaaatcagcactccgacatgacgatggaccaaaaactcaacaaagcaaaactgaataaaaattgcacggctcaaaactagggttcggtaaagggaaaagtggtacggcaatttgtagatgataggtaggaaaaataaatatatacaactgaaatcctcactaggtaaccgaagctctgataccaactgataacaatccggcccaggtggggttggccgaggcccaataacttaaggttgctcggaccccaacaagctttggcacagctactcggggaaatgtccaatctccctaaaagactagtccaataggggaagggtggctctcccttttaaggtggctttctcctcccaagctaagcaaggtgggattattcagagcctcacacggtcgccgcccgactttagcgtctctaccagcgggtaatagtggagaatgtcctcatcattcccacccccttaaacaagggcacagctctgataccaactgatgacgctctctctcgtggcccgatcttctggtgaggggataactctcgttttgatcgagtgcgatgtttgcgacgtggctaccaaccagaacaagtccaggacgccgtgcaatcgctacaccacaaacgatgtcgtaccaaccgtgacgcgcggttgatgatccctacaatgcaaacgagagaacactgcaagaataagataagatgcaatctaaatattacgaataggtgattaagcacaaaggaatagttgcgattgaagtagtagatctaatcgacccggtaaatcgacacaccaactattgggggctctgaatctatagtcgccgactaatcgagcgaggactagagacaaggtgaatggcacatggcaaaattcatctaaacaaaacccaaatgtttttgaggatgtacaaagctatttataaaggaaaataaagctagggttaagtgctaattcgtggaggtggagggagatacttccgagatgggcctagtctattacaaggcccaaggcccaagttcggtttcagcaacagtactgtcttgttttggcgattcccgttgactcgggatgaatttggacatgagaccagacgcgtttgaaaggtagcgagataagctttccacaaagtccaagatcacccaaatcggagttggcatgaaggctctaggtccatttttgaagtcagtgctgtctccggaggccgaattagattccaaaactcattggactttaatatcttgtatatccaccattcatctgatgtattatttggaaatgttttatatttctcatgcttggtggtatgcatatacatgatggtcacatcaactcttctgatggccccccccccagctcaagtgcgcctgtggtcacccaattggatccttcacatcacctataccctagaatcatggtagacattttatcaaatgtgcataaaactggttcactatcatcatttttgcatcgcaggcaaatccccctagcatgtatttgttgcttaacgtgactttgacctgcaaggtggatgcaaagtttgaatttgggaagatctccttcatgaatatgtcgatgatatggttgagtactacaacaatggcgccatacattgccacgatgaagccatattagtcttttgaagcatgagttggaagagaagacgacccaaatgcaacagattgaagaagataacgagaagtgccttgcatagcttaaagagaacattgctaagttgaaggacaatgaagacatcagaagggtcctcaaagaattggacagcttgctaatttctaaaaaggatcgaacagctacaggggtaggggatgcgtttagtttggggacaaggtgcgatgggttagactcatccctgtttttaggatgggatgatcctatctgtttggaagaggggatgggatgatccaacttttgaaggaatgacccacatgtcagcgagagaaaaaagtgggttggattggtatgccgatttttgagggacaataccaacccgatcttcgaggaatattccctgtcagggaccatcctatcccacatgtccccaaactaaacacactgaaaaatgggttgaatccaacctaacccacccaaccgtttaatcaaaatcctcctccatggaagaccaaaagtaaagcaactatatataccagactattggatatatatagttgaaccaaaaattatttttctaaaaaaattatgtatatatgtatgaacatcgcaaatcaccctatgattacgctatatttcaggacacacatttgggcattagatagctaggatatcgaccttttcattatcattctgtaaatgaatgtgtcgattactgcctcaaaattaaagctataagatgaaatgtgatggggaaaaatcaatttgattattttttcactaatataaatcaatttatttttcacatattttcgcagcatacaaatgtatatgtgaaggatagtttatttttttcatggaaaatggccacaacacaaatacacatcaaataaagtaatgaggacacgactagctcggatatgaccatgactatcttatatcttatgtattcatcaaacaatggtgcatatgttctatatttggattttagatgcagaaaaaacaacaaacaccgaagcatcatatgcagattaaatgaagacgagcatgtgtaccttaagtactactaattcgtctctagcagatatttttcccatatacaagcagtacaaattttgctcatgtccagcaccagctggatgtattctctcgatcgaaaagagaattgaaggatcgatggaaaaaagacaagtcatatctatctctttgttgtcaacagactagctagtactccccccgtcccaaaataactgcagttttacactattcacattcaacgtttgatcattcatcttatttgaaaaatttttatgattagtatttttattgctattagatgataaaacataaatagtactttatgtgtgactaaatattttcaaatttttcacaattttttcaaataagatggacggtcaaacgttgggtacggatatccacgactgcacttattttgggacggaggtagtacattaaatttatttgaaaattttttatgattagtatttttattgctattagatgataaaacataaatagtactttatgtgtgactaaatattttcaaatttttcacaaatttttcaaataagatggacggtcaaacgttgggtacggatatccacgactgcacttattttgggacggaggtagtacattaaattttgatatgactatagctagggtccaaatatactgatatcaaaccattgcacagcctgaaatgtataattcaaatatttgtcatcattctatgccttaaatattagtaaatattctttcaggaaaagatggactgttgctgatacaattcttactcaaatctgaaactataaatgtggaactacataaaacccaacaagaacttggagtgtgctgcttcttgaactgtatgcaagcacatacatataggaagtcatagactaagagctgtagctattatttgaacattggcttgcacataataattttgtaataaaaaaaaacaacggaccaaactaattaaagaccagaactatcatgagggcatataagcctgtatagtgatcctagataccactaaactataagttggctaaattgatacaagaacatttgtaattctgcaaaataaattgctgctaaatttccatgcaaaaaaatagttgctgaattacgcagcacatcaaccaaaaaaacacaagtaagcacttcttgcattcaattcctagagcatgaaatggttgatttcctaagaatcatgaacgatcaaaaccaacagtagtgatttattttttgtttctcattatgatgtatatagaaatgcattctaaacgtactacggtctgcaatccagaaatttgcatgaacaaaatgcagatcattgtgtaaatttttgtatataattatacttgtgctggttatggttaaacttttctagcaattctcatgtccctgtagcctgtagggaccgacaacctagcacatatatatatacacctaacagattcactggcaacaataactgcaaacaaaaacataaatcagcaactctatggtaactgaagtacatcgatcagatcaatcgaactttctggtttataaattaaaaacctgtctattctattatattgttcttcgcgtatttatttgtagagccttcttatttgtaattatctttttagttcagaaagaaattaaacaaagaataatatatatacaacggtagatttttttttatggggagcacagagatcatttgagtctcgatcatatatatatacatacacggataacagtactataaccagaaacagggtaaaaatatcaagcgattttagatgcaacaaacaacaaaatatcatatgcaaattaaaagaagatcgacacgcatgtaagtaccactaattcatctctaccagagttctttttttcccaagtacaagcagtagtactttagcatatgcccagcatctggtgtataattctctgcaatgtagttctcgaaggggaaaaaaagattcatatctatcttgtattgactagctagtgcatcaaattttcatgactatatatggtccaaatgctgatcaaaccattgacccaagtaccccaaccttatatcatgcatcattcaaatatatgtgtcatcatcctaccctaaatgctgtgattctttctagaacaattaaactgctgcttaacacaattcttacttaaatctggcattaaggaactaataaaaaaacccaagatttagagtgtgtgctacttcttgaactgtatgcaagtgcatatatgtttatctggtctaattaatttgatactctcagaataggagaaggcgtataactaagttccagtgagctataatatgggaacactgatttataccctaattttagagaaaaaacaacggaccataagtccagaaactatcatgaataaacataagcccgcaaaaaataatgttatattagattctaattaaactaagttggctaatttaaggctatagacaaacatatatataattatgcaaaacacatttattggctgccgaaatttcctgcaaaaagaatcgcgctgctaaattacatgagtgtacacatcaaccaaaaacacacatgtgagcacatattgcattaattcgtcctagagcatgagatggttgatttcctatgaatcatgcatgatcaaaagacacagtgatcgatatatttttgtttttcatatgactagagctaatactgatatcactgtggatcacaatatggctgctggcgatcgatgctgacaggacagggagactggaatacactttcttctacaagccgatgctaatcgaagaccaaaagaaagctggttggacagtatattgtttatggcacagtgacatatatgctggaaagttgctactagctatgaagttttgtctgtcttggctcttttgtatttggctgtcagtttggaatttgctcagcccagacttgcctgtttttagtgttgttcatgttactgagcattgcaggatatgatggtattatatggcatcataacctggcaatttagttgggataatgtagttcagttctaatcttttaaatatgtaacctatgccactgattttttgcatttctgatcatatctgggagaggatatttctcatctatctcaaaataaaaaaagatattgatcatcagaagaccgcaccccggataaaatcagactactacgtatacatacaaactcaagataacagttttgtgatccctactggcacaagatataaaccagagtaccagaccacataataatatttcttataaaaaaaaacgtgccgaaggtctgactcatttcattgatactttgatagagaagagaaatgcaaaaccaacctaagaaaagattcgccctgaaaacaccaagctacaagcaccatacctcaagaacaccacaaataattaaagttatacactaaaacacctgctgcaaaagcaattcagcagtcagcacctgtagcatactagaacacaaaacataagcaacccacagatgccacgaaaccaacataagccctgctttgtagcccagaaaacgcttcaccacaaaatctcaaatggcagtatagcacacgcacaccacatcataaaaaaaaaacattgtttcaacttcttgttcgatcaacagaaaattaaagtctgacagcatactgataaaaactcaaatgacagtagcacaaggataataactagttgagttgatcaacatgaacgataaatcactactaaagcagtccaaaatgaaagttttaaatccagagagatcacataggatcatgatgatgccgaatccccttccttcacgcaatagtatggatcaatccatttgtcagatgatcacctcatccgacccaccacattgccgccttgtccttgacctgaaccagaggcgttctgtgacgccgacgacgatccatggccaccattatcggctgctgccacagctgccggagcagtagccgtcgccatggacgccaccggaaccggcaccatggatccgaagagctagaagtttgtcatccgcatggcagcggtggtggtggcggcggcggcttgccctaccatcggctcggaggtgtttgcggcggacggcgtcgacgacgagcccttctccattgcagctaaataaatctgatcaaaaaagagagcaagtgtcacgtacacaatcttgataagagctagcgagtgagataattaaataagtgtcacatacacaatcttgaggtgaaaagtggggaacacatttatttaagcagatgggagaaaaagattattataaacactgaaaaaacacacataaaccctagctatacttttatcctatttgcatggagacactatacgtttcctcatgaaatttttctacctgagcagatctattgaagaaaaataaaagagaatggttgtacatgtcgttgctcgcttaccttaacacagatctgcaatgaggagaaaccctgccaaaagacaaaagattatctatccggtagagaactagcacacaacagatccagatttgttttttcaaccaaaaaaacagtgaagaaatcagcatgaattaatcagacccaatgctttttcaatcaaaacatacagaaaatccctctccataaaaaaagacacaaaaatcaatctgaatcaccccagcacatatcagatctatataaacatcttgatatattcacatatggcagagaaaagaacaaatcccatgtagataccctagctacctcaagtcctcgatatatagtatcagaggacgaacagagatgctcctgatacatataaatcaatcttaaaacctattatattaattacctcccattcaaatttattcccattttatccccaactacctttttaacatccaaccatcccttatctaattagggatatcaaagtcttttctcctcaacattaatacgtgcaatgcttgcagagtatatggaatgttatgggtgcatatatggttttcctttatatgcatccataacagcttatattggtgttgattaattgcacccccaacatttgatcgagaggttcaaacattttctccattgggtatatctttttatttatatcgtacatctaatacaaatttcaattaaattttattcataactcaaattggaggtgtgaaattagtccaaattaattatcacgagtatgtggtttattttatgtgcatttgtgttgtggccattttccatgaaaaaaagagactatccttcacatatacatttctatgctgagaaaatatgtgaaaaataaattcatttatattagtgaaaaaataatcaaattgatttttccctataacatttcatcttatagctttaatttcgaggaagtaatcaacacattcatgtacaaaatgataatttaaagatcgatatcctagctatctaataccaaaatgtgtatcttaaaatgtagcgttatcatagggtgatttgcgatgttcatacatattatcatggttatagataccacatacccaatagtaattgactaagctcggtgaggcctaccatataccaagtcttatacataatcatatctcgtatatagaaggagttccggataaggaaggacaagaagagttatataaggaaactataagaactacccggattgtatccatatcgctctccctagttctacttggacaaggggagaggagggacagatcgacactgttaacgccaaaatttggtaaacccgaagttatcatcagcctagagtcaatatcggcttcagagtcctggaatcggccaatgggaattatcaagtcgccaatagccaaatttttgctatatttggtaaaggaaattaatctattaaagaaagtttatctagaagtgactgagttcaaggaggatgcggcatgacggtttatctattaattaggcagtatttgttagtttccttttatctttaggaaagtgtgtttagtgtccgataaggactttatgttttccttttatctttaggaaagtttctttcttgtcctaaaaggactactttctacccatggcgttgagccgagcggcctcagttgcaaggacaagaacatgttgccaccttgtccttgacctgaaccagaggcgttctgtgacgccgacgaggatccatgtccaccattatcggctgctgccatagctgccggagcaatagccgtcgccatggaagccaccggaaccagcaccgtggatccgaagagctggaagtttgtcatcggcacggcggtggtggcggcgatggcggcttgccctagcatcggctcggaggtgttcgcggcggacggcgtcgaggacgaacccttctccattacagctactgatctgataaaaaaaaggagagctgaaattaaacaagtgtcacgtacacaatcttgataagagctagttagtgagataaataagtgtcacatacacaatcttgaggtgaaaaatggagaacacatttatttaagcagatgggagaaattaaaagattgattattacaaacactgaagaaacacataaaccctagctacttttatcctatgcatgcatttcctgctcgtgaaatctacaatgaagaagcacctaaattaaccctagctacttgtatatatcttgtggactataggtttcctcctgaaatttttcctgctagggaatctacaatggagaaacacattaaccttatctacttgtatatatcctgtatggactatacgctttctcctgaaatttttcctgctagggaaaaatctacaatggatcagaaacacataaaccctagctagctacttgtatatggactatacatttcctcctgaaatttttctacctgagcagatctatatatcgaagaaaattttaaaagaacggttgtacatattgctgctcgcttaccttaacacagatctgcaacgaggagagagaaaccctgccaaaagacaaaagattctgcaaccgttagagaactagcataaaacagatccagatttgttttttcaaccaaagaaaacagcgaagaaatcagcatgaattaatctgacccaacgctttcaatcaaaacatacaatccctctccaaaaaaaagatacacagaaatcaatctgaatcaccccgtcacatatcaaatctatataaacatatcttgatatatggagttattcacatggcggagaaattacaaatcccatgtatatatgctctaggtacctcaagtcctcaacacagatatatagtatcagaggacgaatagagatgctccttacacatataaatcaatctgaaaccctattaggtctatacatctaagatatataaacagatttgtttcacagataagcagagaaagaacacaaatctcgcatatgctcttgcctctctatctctgtctacctcaacacagacagaaatcagaggacgaacagagatagatcgatagctagagattctagcttttgctggcttagctaggagaatatcgagacgagcagaaatcagaagaagagctcttgcgtcgaaatggctggagctttgcagatgagtttgggagagaggacgtgaggtgtgggtgcctatttgtagaggagggaaatcaatgcatgacaaatttgcaaaaaagagtatttgaaatttggagaaattttgtgggcgcgggctgcagttcacacatgcgcctaattcgaacgttaggggtgtatagatggtcttcctttttaagcatccatccatgaataatgacagcttccaagctattagctagcagcattgccacgtttgagggaaggttcaagctagcattcctttttctacttgctagttaaatatttttatattccaattttttcgtcctaaaaaaatatgtaagaagttcgttcaattttttcatcctaagagaaatttgaattcaaaaaatgctttgctcacaaaatacaaattggaggtgtaaaatgtatatttttgggctgcacatttttaccagggaagcttcaaatatactgcacgaaaaggagatgtgtgaaaaataaatcgatttatattagcggggcatgtcaatttgatttgttccagtcacgtttcatctcatattatgcttttaacttagagagaaaagatcgatatggtactacccaaatatgttcatttgcaacatggtaaggaaaagatcgatatgctactacccaagtatgtacctgatctgaagtaggagtagtactctagctagctagcagcttgtaccataaatatcttccttatttaggccatgtttagttcgttggccaaaattttttttaagtatacggacacatttgaagtattaaatgtagagtaataacaaaacaaattacagattaagcctaattaatctgtcattagtaaatgtttactctagcatcacattgtcaaatcatggcgcaattaggctcaaaagatttgtctcgtaatttatatgcaaattgcgcaattggttttttttcgtccacatttcaagctccatgcatgtgtccaaacatttgatgtgacatttttggccaaaaatttttgggatctaaacacacccttatcctttctcgactgcattggactagggtcttttagcaatcgccataaaagctagagagttgacaaaagggtgattcagaatgttagtacatataaggatttatagagtattacttgtcctattaattacctctcattcaaatttattcccattttatccttagctacctttttaacatccaaccatcgcttatctaattagggatatcaaagtcttttctcctgaacaataatacgtgcaatgcttgcagaggagtatatatatggaacgttatgggtgcatatatggttttcctttttatgcatccataacagcttatattggtggtgattaattgcaccccccaacatttgatcgagaggttcaaacattttctccattgggtaaaccttttatttatatcgtacatctaatacaaatttcaattatttttatttgtaactcaaattggaggtgtgaaattagtccaaattaatcatcacgagtatgtggtttattttatgtgtatttgtgttgtggccattttccatgaaaacaaaagagactatccttcacgtatacatttgtatgctgcgaaaatatgtgaaaataaattgatttatattagtgaaaaaataatcaaattgatttttttcctataacatttcatcttatagctttaatttcgagggagtaatcgacaaattcgtttacaaaatgataatgaaaagatcgatatcctagatatctaataccaaaatgtgtatcttaaaatgtagcgttatcatagggtgatttgcgatgttcatacatattatcatggttatggataccatatacccaatagtaattgactaaactcggcgaggcccaccatataccaagtcttatacggaatcatacctcgtatttctggataagaaaggacaagaagagttctatatggaaactataagggctactcagattgtatttatatcggtctccctagttctatttggataaggggacatctatgtgtatgaatagaagcccccctagggggagagaaaggacagatcgacacacaagttagaatagacaccaacacacgctgccaaacatcgacattagagataagcctagacagacccaatatggtgcatgaggaggccgacaagagggatctagcgccatctctgatctcgatgagttcgtactcgaggaggaagactactatatcgtcgactacgtgttggttatctatgctgccaagtcgacgccagctagataggttatcccaaatattgtacttgtgtgatctagatgaataaagagcaacatcggctacggccaacaggagtagggctattacctgtcagataaggggcccaaacctgtataaaaatcattttctccatcttttttacctcaatctcgcatatactctggtaccaacgatctccataccattcaaaaaccatagtcgtgacctcaaacgtcgacatatatatacataatatttttagaaaaataattttcagttcaacccctcgaatagtctgatatatatagttgctcacttcccctaaggggatatccccctacccccatagttgtctgatcctttttggagattaacaagttgtccgattctttaaggtcccttcggatgtcttcattgaccttcaatttatattagcaacgtactcttcaagctatgcatggcacttcttattatcttcttcaatctgttgcatctggttgtcttctcttccaactcgtactttagaagactaatggcttcatcgtggcaatgtgtggcgccattgttgcagtacccaaccatatcatccgacatattcatgaaggagatcttcccaaatccaaactttgcatccaccctgctggtcaaagtcctgtaagcaacaaatgcatgctagggggatttgcctgcgatgcaaaaatgatgatagtgaacatgttttacacatttgagaaaacacctgccaggattccagggtgtatgtgatgtgaaggatctaatcgggtgaccacaggcgcacttgagctgtggggggaagaccatcagaagaggggaggacagcactacatggagtatttcggttgatggaggaagaagatgaactctgcatcgccatggatcctaagaggaaagtgaaaatgcttaggtgtggacagagagcaatgtggcctggagacttcgatctgtattaattgagaggaggagaaaagcacttgtagaggatcagagctgaatccattgaataatatagttttggtacatacgtgggccaaatgaaatgacattttgttccatatacgggcgttagaaaatgagtggaatagcaaaataaaatggaatacctttgaggtgtgggatgaatggcatgaatctcgcgaagggcgatgaacggagatggttgtagggggacatacccttaataaggatcagaagagtttgccttattttcactagaaatactcttgaggttgtcgatttgcacctctagtgtttagtggcatggcattaatattaacaccgtagatagtaagtttatcaatcatgcaaatatatttacactatgcccttcgcaatgcagtagtgagcctacgacacctggtctgactagcaattctaactatacattgatctaattcaaaactcctatagtctaagccgacttattaaatgtggactaacatcggtctggctatgcctcaaaatggtttgactgcctatatcgcttgtttgaccagccttttgatacgtatgaccgacagtaccgaaaatataccttgacctctcaagatactagaccactaccatcaacatcgtagctgatttttgttaatcatagtataatcatcaccatgttttcatagccccaacctaatatgtatcattcaaagttttggcatccaactctaaatattactatatgattcttcttagaacaattaaactggtgttggataaattcttacttaaatttgatagattcttacttaaatttggcattaaggaactaggaatatatatctagagtgtgcttccagctagattagttatatatgcaagcacgtagtatatatgtttatctgatctatttttttgaatgaaattatctagtctaattaattagaaagtctttagaacaagagcaaatgtaaccaagttcaatgctatatagtcatatgtatatgggaacagtgtgttgcatagcttgcagctaatttttgaaaaaataacggaccaaattaaagtccaaaagttaccatgagagaacatataagccttataagcctgtaaaattaataatgatattagatactaaattaattttgctgaagtcataattataaacatttataattctgcaaaacattccgctgctaattaaattacactactatatcaaacaaactaaaaaaacttagcgtatagaattaataagaacaaaacaagcttaattcaatggaagctatctcggaaattttgactcctacctaattctctagaaaacaaaaatataactatattctaaatgtgtcttcatcaattgcagtagcgcgcttaattaaaacaacaatcatacatatgttatattaagcctactttgctaacattgtatgcaagtctgttcattctctcccaatgagaacaagtcagataaaccaaaaacacctagcatatcctgttgatctagaacatgaatgtgatgttgatctgccatgagcatgatcaaagtgtacacctcaaggatctcagatctcacaaattagtgcctcatattatgatgtatatgcaagacttcatacttttatatgaaatacatgcgctaaataattacaattcagaaatttagtgttttttttataatgggtagcaattaatccagtctctcttatatatcgatccacatgtgggtatacacagcaattcagaaatttagttacctaagcaaatgcatatcacactgtttgaaatatctgccaatgtgcatacatatactagatatatagatcaatatggtcctggttatttttttgacgcgagaagatagagccgactctaccagcttatagagccattacattgatagaaatgaagaggtacaaagtttttaaggttacaaaatgaaagaggaaaagtataaaaagagagagggagggaaggatttaaaggttacaaagtgaaagaggaaaagtataaaaagagagagaggggaagggagaagaaggtaaggaggtgaggaaatatacaagggagatatatacagtagtctgaggcgggtctcatccccacctcggaggagtgaacagctacaaattctacaggagttcatgcccacctcggaggcagctgaaacaagggagttcctatacccggattctacaattaatttccgctgcaaatgcatatcacttgctaacatatcatgaatccctttggaaacctgcggaatacacctggatcagaatagtccccaataattgtaaaattttcctttggttggcctttaaaaacaaactaaacaccaaggctaatatatatgcaagcacgtagtatatatgtttatctggtctatttttttgaattaaattatctggtctaattaattagaaagtcattagaacaaagagcaatgtatctaagttcaatgctatatagtcatatatatggaaacattcacttgcatagtttgcagctaatttttgaaaaaataacggaccaaaactaaagtccaatattaaagttatcgtcatgagagaacatataagccttataagcatgtaaaattaataatgatcttagacactaaattaatttttgcgaagtcataattatatataaacatatataattctgcaaaacattccgctgctaattaaatcacactacatcaaacaaactgaaaaaacctagcccaacaactagattatctacctggtctatagaattaataagaacaagacaagcttcaatggcagctatctccgaaattttgacaccgacctaattctagaaaacaaaaatataactatattctaaatgtgtcttcatcatatcaattggagtagcgcgcttaattaaaataataatcataaatatgttaagcttactttgctaaaattgtataaaagtatattcatttcccaaaagaagtcagagaaaccaaaaaaaaaaacacctgcgagagctagcttatcctgttgatctagagcatgcatgtaatgttgatctgctttgagcatgatcaaagtgcacaccttaatggatctcacaaattagtgcctcatatattatgatgtatatgcaagacttcatatacttttatctgaaaaatgcatgctaattaaattacaattcagaagtttagtattttttgtataatgggtagaaatctggcctctatatcgatccacaggtgggttaaaacagcaattcagaaatttacttacttaaccaaatgcatatcactgtttgaaatctctgaaactctgatgatgtgcatacatatatagatatatagatatatatacttggtgcgggttatggttgaatttttcaaggtgtatattctcatgacttgtagccgacaacctagctagcacatatatacagctagttagcagattttgagtggcatatgcagacaaaatcataaatcagcaacgatgatcaatatcttgatgatttatgaattagacaagcctattctattgttccttatgtatctacatatacacatgaaaattaaacaaatgcttttgtaatcatttttttagttcagaaagaaacagaatagtatacagtggtagacttttcagggggagcatagatctattaaggtggtgtttggatccggggattaaattttatagtccctgtcacatcgatcggatgtttggacactaactaaatgtattaaacttagattaataataaaactaattgcataaatgagagccaattcgcgagataaattttttaagcctaattaatccataattagcacatgtttactgtagcatcacatatgctaatcatggattaattaggctcaatagattcgtctcgcgaattagtgcagggttatggaatagcttttgtcattagtctacatttaatacttctaattagtgtccaaacatctgatgtgacaggactaatatttagtctccctggatccaaaaatagggtctagatttcatgcaaacgataacagtgctaattaccagaagtatgcaggatgaaattaaaaatccaagggattttaattagatgaaaaaaacaacaaacaccgaagtatcatatgcagattaaatgaagacgtgcatgtaccttaagtactactaattcatctctagcagatatttttttcccatatacaagcagtactaattttgctgatgtccagcaccagctgggtgtattctctcgattgaaaagagaaggaactccgtgccataaagttctcgaaggaaaaaagacaagccatatctatctctgtgttgtcaacacactagctagtacattaaattttgatatgattatctagggtccaaatgctgatatcaaaccatagctcagcctgaaatgtactataattcaaagatttgtcatcattctataccttaaatattactagtatatattctttcaggaaaaattggactggtgctgacacaattattactcaaacctggcactataaatttggaactaaaacccaagaactggagtgttctacttcttgaattgtatgtgtaatgtttatttggagtaattagaaagtctcagaataagagctgtacctattatatgaacattgggttgcacataattttgtaaaaaaaaaaaaacaacgaccaaactaattaaagaccagaactatcatgagggcatataagcctgtataatgatcctagaaccactaaactaatttgtctaaattgatagaagaacatacataattctgcaaaaataaattgctgctaaatttccctgcaaaaaaatcttgctgatgaattacgcagcacatcaatcaaaaaacacatgtgagcacatcttgcattcaattcctagaccatgaaatggttgatttcctaagaatcatgaacgatcaaaaccaacagtgattcattttttgtttctcatatgatgtatatataaatgcatgctaaacatactacggtctgcaaatccagaaatttacacctgaacaaaatgcagataattgtttgtcgatgtgcatacatataataatacttgtgctgcttatggttaaatttttctagcaattctcatggccctgtatctagggaccgacaatctagcacatatatactcctaacagattcagtggcaccaactgcaaacaaaaacataaatcagcaactctatgctaagtgaagtctcagatcaatcgaacttttctggtttataattaaaaacctgcctattctattgttcttcgcgtatttatttgcagagccctctcttatttgtaattatcttttttagttcagaaagaaattaaacagagaataatatatatacaacggtagaatttttttttatagggagcgcagagatcatttgagcctataaaaggataaaaatatcactacaaccagaaacagggtaaaaatatcaagggattttagatgcaaaaaacaacgaaatatcatatgcaaattaaaagaagatcaacacacaccttataataagtaccactaattcatctctaccagagtttttttcccatgtacaagcagtagtactttagcatatgcccagcaccagctagctggtgtataattctctacattgaaaagatcgaaggtactctgcagtgtagctctcgaaggggaaaaaaagatccatatatatatatatatatatatatatatatatatatatatatatatatatatgtggtccaaatgctgatcaaatcattgacccaagtacctgatatgtatcatgcatcattcaaagatatgtcatcatcctcctaaatgttgtagctagatattcttcctagaacaaataaactggtgctgaacaaaattcttacttagatctggcattaaggaactaataaaaaacccaagatctagagtgtgtgcgtgctactccttgaactgtatgcaagtgaatttatatggtctaatttgggagtctcagaataggagaaggcgcgcgtaactaagtaggagtaagttccagtgagctattatatgggaacactggtttatacataattttagagataaaaaaaacaacgggccataaatccagaaactatcccgaagaaatataagcccacaaaataatgttatattagattctaattaaactaagtagggtaaggctatagacaaacatatatataattctgcgaaacattttattgtctgctgaaatttcctgcaaaaagaatcgcgctgctaaatattacatgagtatacacatcaacgtaaccataattataacacatgtgagcacatctttcattcgtccgaaatggttgatttcctattaatcatgcatgattaaaagacacagtggtcaatatatttttgtttttcatatgactagagctagggtccaaatactgatatcactatatatagatctcaatatggctgctggagatcgatgcagacaggacagggaaactggaatataatgcactttcttctggacggtatattgtttctggagatcgatgctaattaatcgaagaccaaaatagagctggttggacggtatattgtttctggcacggcgcgacgacatatatcctggaaacttgctagctatgaagttttgtctgtcttggcttttttatttcttttgtattttggctgtcaatttggaatttgctcagcccagacttgcctgtttttagtattgttcatgttacggagcattgcaggatatatgatggtattatatggcatcataattaacctggcaatttagttcggataatgtagttcagttctagcctttaatttaaatatgtaatgccactgatttgaatttctgatcatttctgggagaggatatttctctcctgtctcaaaaaataaaataatgatcatcagaacacaacaccccggataaaatcagactaccatgcatacatatacaaactaaagatagcagtttgtgatcttactggcacaagatataaaccagagtaccagaccacataataatattttgtttataaaaaaaattgcgcggaaggtctgactcatttcattgatactttgatagagaatacaaatgcaaaaccaattacctaagaaaagattcgccctgaaaacaccaaactaacatatttgatcaacatgaacgataaatcactgctaaatagtccaaaatgaaagttttaaatcgcgcaacatatttgatgatgccgatcatctccttccttcacgcaatagttatatggatcaattaatcctttcgtcagatgatttcacctctcatccgacccaccacattgccgccgacgagctcgccgtcgatgggccgtcgccgccgtagcctgagcccgatggaccagcaccaccagccgccgccggtggccacagcggtggcgccggcacaaggaccctcctcgcggtccacgtcgagaccgagaagacgggcacgtcgcaccagcagatcacggggaagcacccgccgccgtgcgccgccctgagcaccccggcgccggcaccgcccccgcccgccgccaccatttgctgcgcgagcgtctccgtgctcgccagcgccctggccgccgtcacgggggagaagccggcggcgaccatccgctccgcccagcgccccagcgtctcgtgcctctcccgccgccccgtgccctcacggacgacgatgtccttgatctcctcgccgagcacccaccgctcgacgcacgcgcgttcgtgcggcggcacggccgccggcggggtggagctcgcctccagggcgtcgaacagcgccgcgtagtagttgagcgcgttccagacgcgcgccccgagctccgcgacgttgtggtcggcctcgttctccgtcaggaccaccagcttcgggttcaggtcgcggatggcgcggaggagcgcgtccgccttcgtcttcgtcgccgtcgtcatcgtatgctggctggatccggattgctccgccgccggcctcctgctcgcgacgccgtccacgtagtcggggaaggcgaggaggcggtggatctggaggttggcgacgacggcgaggggctggccggggatgacgacgaggcgggatccgattgatccggtggcggtggcggagagctcctcgatgctggatagcaccggatggaactggaggctgaggtcgaggcgctgggcctccgcggcgacgtacgcggcgacggcggagaggaagtcctccgactcgttgacgacggtcaggcggagcaggcccggcgggccgccggggcgcgcggcgacgaggcggacgagctccacccactggttggcgtcgacgccgccgccgaggtcgacgacgtggacgaccgcccgctcggcctccatcacctcggcgatggacaggttggccgcggcggcggcgaggcggacgaacgggcacatcgcgcggaacccctggcgcgcggcggagacggccggcggcggcggggcccgcgtgaggtggagcgagcggcacaccccgtcgcacggcaggatgaagcgcagcgcgagcgcctcggcgaacgcggacgccagccgctgcgccgacctcccctcgccgacgccgccgccgtcggcgtccccgccggcgaggtcgacgacgcagctcagcccgtcgttgacctgcatctggcacgtcccgtcggccaggaacgccgcgatggaacgcaggaagctcaccatcagaacgtcccgctccccgtcgccggcggggtactccgccgggccacctagggcgaacgcgtcgggctggatccccgccgccgccgccgccgccatggccgccaaggaggacccgaacccgagcccgaccaccgggcgcttccccgcgttggtggccgccggcgccgaatcctccccggccgccggtagccgctctcctcccgctccccctcctcctccacccagggctagcctcgggatctccaccgccatggtgaggttgcccgaagtaccctgcgccgccgccagattaagttggtccgaaggctaaagacactcgcgcagaaggacacactcacacacgacacgggggtccttttatatagcggcgggcgatggctaagggagactggtcagggactcagggcgtcaggcccacttggttgccctagtagcttcctcgttgagtaccgtagtttgtttcaagaaaaaggaggaaaaaggttgggccgtcggaagaaatgattagtttctttaaagtcaatttgttttttttataaccccatttcgaccaccgtctttcaaccaaaaaaaatgggtaaaataaccttcactgcatcgatttgaattagagtaagggggtgtttggatccagagactgaactttagtccctgtcatatcggataaatttggagtattaaacatagcctacttataaaactcattatataaatgagagctaattcgcgtgacaaattttttaagactaattaatccataattagcgcatgtttactgtagcatcacataagctaatcatggattaattaggctcaatagattcgtctcgcgaattagtccagggttatagaatgggttttattaatagtctacgtttaatatttataattagtgtccaaatatccgatgtgatagggactaaaaaaagttttaatcccatctaaacaaggtcaatatatttccactagtttatgtcgtgtcttagctattttctaggtatcaataaaataaagtaaaatccaaaacttttgaacacatttggtaccgatcgactaggcaagaggacctagctagttactcaagaagtgaccggccggccaccaagctaattgaagccacgtgaggctaagcttgggtggccaaccattctggtcaatccagttggccacctagcctgaccgctgcggggcaccaggctagtcagcatcaccgacttagcctaaaggcgaattgacctagcaagaagcccaactaaccaccaagtacactctgacaagccgatcggcttggcgtaggatgtacccgcctatcgaccgatcacttcataaagaaatgcgagggacaaaatcacctcctagtagaaatctcagacatcgcagaaactagacagtgccacattgcataggggagggggataacatcgatcatgggagggttatagccccccaactcaattcacacaccaccacatttcacacccaccatagcagctccattttgttatttttagtcactagagtatcctaaggctgtgttcgctccttcaggttgggaacccatctcctccacacgaaaaccggagcgatccattagcgcgttattaattaagtattagcaaaaaaatttcaaaaatagattaatttgattttttaaaagcaacattcgtatataaatttttttacaaaaaaacgcatcgtttaacagtttaaaaagcgtgcgcgcgaaaaacaggagatgtgagttgggaaagtgg

SEQ ID NO: 41766 - DNA, 2056 bp, Oryza sativa
aagatgatcacctcatccgacccaccacattgccgccgacaagctcgccgtcgccgccgtagcgtgagcccgatgcactagcaccaccagcaccagccaccggcagcggccacagcggtggcgtcggtgcaaggaccctactagtggtccaccccatcacacagaaggatgaaccgcagcgcgagcgcctcggcgaaggtggatgccagccgcagcgccgacctctccccaccgacgccgctggcgaggtcgacgacgcaactcagcccatcgttgacctgcatctggcacgtcccgtcggccaggaaggcggcgatggaccgcaggaaccacaccatgagaaggtcgcgttccccgtcgccggcagggtactccgctggcctacctagggcaaaagcgtccggctggatccccgcagatgccgccaccatggccgccaaggaggacccaaccacctggcacttccccgtgttcgtggctgccgccgaatcctccccggctgccggtagccgctctcccgctccccctccgcctcctagggcaagcctcgggatctccgccactatggtgagcttgcccgaaccctgcgccgccagattaagttggtccgaaggaattgaagctaaagacactctcacacagacacactcacactaaacggggtccttttatataacggcgatggctaaggaagactggtcggtaaggcccactttgtttccctagcttcctcgttgactactactccagtttgtttcaaggaaaaaggaggaacaatctaggttggaccgttagaggaaatgattagtttatttcaactcaatttgtttttttttgtaaaacccactattggccttttagaaaatggtaggcatttgtgtgtgtgtgtgtgggcgctcgcgcatgtgggtgtgggacgggcactattggtcaaaaggcacttatgaggcaaatgcctatgcctattaagaaaatgtgtctacaaggtatttttgttgtgaaaaaaatttgctacaggatactcaaaaagtgtggtctttactggtagacagtggacgcattaaaatacattatcaacccaattgataagagagaacccacgtaaaaggtcagtgtttccctcatctttttctctcttctctcggttttcctcctatctttttccttttgtccttttctaggactcattgaccaccaagcgcttccttgtgctcgtggccgccggtgaatcctcctccgctgcagccatcggtggcaccggtagtcgctctccccctccccctcctcctcctagggcaagcctcgggatctccgccgccatggtgaccttgccggagccctgcgcagccagatttgttaggtccgaaaaaacgaggaagctaaagacacacacagtccttttatatatgccgattgctaagggaaaccggtcagtaagaccacttccttgttgactacaagtttgtttcaagtaatagaggaaataattcaaagtactttctttcaagtcaatttgttttatgtaaaaccccattttgaccatcatctttctatgaaaaaaattgggtaaaacaacgttcaatgcattgatttgaattagactaatatatttccactagttttgtcgtgccttagctattttgcatgtatcaatcaaataaagtaaaatgcaaaaccacaaaatctcatggcagtatagcacaccacatcataaaaaaaaacattgtttcaactacttgttcgatcaacagaaaattaaagtctgagtgcatgcatactgataaaaactcaaatgacagtagcacaaggataataactagttgagttgatcaacatgaacgataaatcactactaaagtttttaatcaaaaatgaaagtttttaatccagagatcacataggatcacgatgatgccgaatccccccttccttcacacaatagtatgaggccaatcacacacgaagacacacatcaggaatcatgcatcaatccatgcgtcagatgatcacctcatccgacccaccacattgccgccgacaagctcgccgtcgccgc

SEQ ID NO: 41767 - DNA, 8478 bp, Oryza sativa
cattagactagaagtctatggtgtccctcgaccacgtggcgcgtgaagaggacccccacggcggcgttgaagtcggggtgtggagatggtgatgtaggttgcgatggagaggtgggcagcagccgctacagtgatggtagggatggctagggaggagagtgaggcaaggatgagatagggagcgaggccagtgccgcggtggcacccaccttctagccctccggaggggattgtcctccctagatcgatggtcagaagcctcctcgtcagttgccattatataggaaaaagggagatgccgggggcagagagaataggtggagagagaaacacaagagaggagagagagagaaaagaaagaaaaggataaagctgaggcatgacatgtggaaagatatctaaatagtccaatgctgtgcatctacactaattgctatagatatctaaattttcaaaagaaaaataaagcatgagtttattggttgcttatattaatggtggtgggagattatgtagtacgtggagggcatgttgcaacatagcgagtgataggcattatgacgggtgggctacggttgcctaggaaacaatatggcgggggcactattggccttttagaaaatggtagtaggcatttgtgtgtgtgtgggggcgcgcgcgtgtgggtgtggggcgggcattattggtcaaaaggcacttatgaggcaaatgcctatgcctattaagaaaatgtgtctacaaggtatttttgttgtgaaaaaaaattgctacaggatactcaaaaagtatagtctttactggtagacatcacaaaaacgtgaatttgtccgaggacactggacgcattaaaatacattatcgagccaattgatgagagataatccacgtaaaaggtcagtgtttccctcatcttcttctctcgtctctcggtcttcctcttatctttttccttttgtccttttctaggactcattgaccaccaggcgcttccttgtgctcgtggccgccggcgaatcctcctccgctgcagccatcggtggcaccggtagtcgctctccccctccccctcctcctcctagggcaagcctcgggacctccgccaccatggtgaccttgccggagccctgcgcagccagatttgttaggtccgaaaaaacgagaaagctaaagacacacacacagtccttttatatatgccgattgctaagggaaaccggtcagtaagaccacttccttgttgactacaagtttgtttcaagtaatagaggaaataattcaaagtactttctttcaagtcaatttgttttatgtaaaaccccattttgaccatcatctttcaacgaaaaaaattgggtaaaacaacgttcaatgcattgatttgaattagactaatatatttccactagttttgtcgtgccttagctattttgcatgtatcaatcaaataaattaaaatgcaaaaccacaaaatctcaaatggcagtataacacaccacatcataaaaaaaacattgtttcaacttcttgttcgatcaacagaaaattaaagtctgagtgcatactgataaaaactcaaatgacagtagcacaaggataataactagttgagttgatcaacatgaacgataaatcactactaaagtttttaatccagagatcacatacggtcatgatgatgccgaatccccttccttcacacaatagtatgaggccaagaacacacgaagacacacatcaggaatcatcaatccatgcgtcagatgatcacctcatccgacccaccacattgcctccgacgagctcgccgtcgccgccgtagcgtgagcccgatgcgctagcaccaccagcaccagccgccgccgacggccacagcggtggcgccggtgcaaggaccctcctagtggtccaccccgtcgcacagaaggatgaaccgcagtgcgagcgcctcggtgaaggcggatgccagctgctgcgcagacctccccccaccgacgccgccggcgaggtcgacgatgcaactcagcccatcgttgacctgcatctggcacgtcccgtcggccaggaaggcggcaatggaccgcaggaacctcaccacgagaaggtcccgttccccgttcccggccggatactccaccagcccacctagggcaaacgcgtcgggctggatccccgccgccgccaccaccatggctgccaaggaggacccgaccaccgggcgcttccccgtgtttgtggctgctgccgaatcctccccggctgccggtagctgctctcccactccccctcctcctcctagggcaagcctcgggatctccgccaccatggtgagcttgctcgaaccctgcgccgccagattaagttggtccgaaggaattgaagctaaagacactctcacacagacacactcacactacacggggtccttttatatagcggtggctaaggaagactggtcgataaggcccactttgtttccctagcttcctcgttgactactactccagtttgtttcaaggaaaaaggaggaaaaaactaggttggaccgttggaggaaatgattagtttatttcaattaaatttctttttttttgtaaaacccactattggccttttagaaaatggtagtcatttgtgtgtgtgggggctcccgcgtacgccgtgcgcgtgtgtgtgggtggtcggtgtggggtgggcacttttggttaaaaggcaattatgatgcaaatgcctatgtctattcagaacatgtgtctatgaggtattttttgttgtggcaaagtttgctacaaggcgctcaaaaagtgtggtcttcgctagtagacatcacaagaacttgaaaccacgtaaaatactttttccacccaattgatgagagagaaaccacgtaaaaggtctcagtttttccttcatcttcttctctcttctctcagtcttcctcctatatttttccttttgtccttttctaggactcattgaccaccaggcgcttcctggtgttcgtggccgctggcgaatcctccaccgctgcggccatcagttgtgccggtagtcgctctcccctccccctcctcctagggcaaacctcgggatctccgccaccatggtggccttgccggaaccctgtgcagcctaatttgtatggtctgaataaaagaggaagctagagacactcacgcagtccctttatatatgtcgagtgctaagggaaactggtcagttaggccactttgtttcccttccttgttgactacaagtttgtttcaagtaatggaggaaaaaggttggaggaaataaaaatgtctagttaaaattattttcaaattcaggcaaaaattgttgaaaaccttcacaacttcacaatttatttaaatcaagaaacaacaccttttctttgggcccctttcttttctttctccttcttttctccgatccaaggaataagtccacttcgattccctcaaatattctaccaatatgattcgtatcccttaaccgcaataccaagtatcttggccccatatatatatatatatatatatatatatatatatatatatatatatatatatataattgaaaaagtttcatactcatttgaattgggtatatactcaatttcaacaatggtgcccgggcaccatggagcaccaaacaaatttactatatatatatatatatatacatatatatatatatatatatatatatatatatatatatataacaagcttctgaggctgtctaagtaggattcgccaccctgcaaagatcctaaagttaaaaaattctctcgaagtgaacagtattgaacagtaaactgaataggaatcagtcgaataaatagtgtttttgaacagtgtatattgtctgaagtataaagctcatattcattaattctttcttcagactcaagattaggtacttctaagttgtcgagtttaggggaggttccaccacgctttcgtacctctgagatatatggaacattattcagaacattttctaagttctgtattttcgttaaattcagaacttgagctgtcaacttaaattcagaacaaataaaaaaggcaaaattaatataataaacccagagtattcccctgttctcgtgaatccacagtagcttgttgtcatctcgaaatgttagtcttctgaagtataagtggtatcagagccagtcatcatagagaaatcaaattcagaagctaatattggaaaggtaattactaccaaagataatctgaatataaggtgtacactaaatcacattgaagaccatagttggcactctaacaatagtcaattaaatttaattgttgatctgatatataatttttatataaattgggataaaaagcaggaagatttagagcgaaggattgaagatttgtttaaagaacaaaagcaatctgaagaacaatatttgcttgtcagtaataaattaaattcagtgccaaaagagctagaggaatataagataaggcagaataagatattacaaaacagtgactatatcaaagaattacccattaaaacgactataaaagaagaagggtattctaaaaaacccacatacaaggaatgcctaacaaaaggagtggatccattagatggggaatatattgattggaaaataatagaaaaatttgtagaagcctccccacaattaaagaaggaattaaaggaagaaatacttaaagaattaaaacaagaaatggatcagaaatttgaacaaataaaaaaggcagtaaatgagaaattagaagtttctttttctgatctggacactatggatcttggtggtcatgggcaaccagatgaatagaattctttaagctaaatatgtttttcaatatatattgataatagaatatcaacaatttgggcgtggaagaagaataaacgaagatttcagaagactactcaagaaggaatccagaagaaggaatccagaaggacaccctataaagcataaaggaacaatatagggtgcggtgaatgacatatccctgtgaagaatataattttcagcaactttcggcggtgaatgacatatccctgtgaagaataaaactttaggcaggaaaggcatcaactttagcctgctctcgtgaatccacagtagcgaagagataagcaggaggcacaagcgacgccacccctgacctctataaaaggaggggcctgcccagctgagggaagaacaacaacgaagacaccattcagagcaaagcttccaagcgcactctcaccctccattccaccgtttttagtagtagtgactttagcctaccttgcatagtatattgaagcaaggagttctgttataacgctgtgtgaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctatagaagaaacctcttcggtttgttctcgtttttagcctgcatcttgcataggcgtttggagaatcggtatccgtagagaagtgttcccttcgggtggaactgcttagggagacgataaactcttagctagaacaagtgtgatttggaatatctttttaagttgcttttaaaaagacagataggtgaggcatacggtgagtaccgagtaggactttacatcatctgaaacaagcttctgaggctgtctaagtaggattcgccaccctgcaaagatcctaaagttaaaatatctctcgaagtgaacagtattgaacaataatttgaacagtaatcagccgaataaacagtaaactgaatagtaatcagccgaataaaaatcagccgaataaatagtgtttttgaacagtgtatattgtctgaagtataagtggtatcagagctagtcatcatagagaaatcaaattcagaagctaatattggaaaggtaattactaccaaagataatctgaatataaggtgtagactaaatcacattgaagaccatagttggcactctaacaatagtcaattaaatttaattgttgatctgatatataatttttatataaattgggataaaaagcaggaagatttagagcgaaggattgaagatttgtttaaagaacaaaagcaatctgaagaacaatatttgcttgtcagtaataaattaaattcagtgctaaaagagctagaggaatataagataaggcagaataagatattacaaaacagtgactatatcaaagaattactagaaataataaattctagtaaaggaaaagagatagttttggcttcaacatgcataattacctcgtctcaagctattaattcagaaaaatggacctatctaggagtttgtttagaagaatagcaagcagagacgataaatctttaagttgtattgataaacaaaaaggtaaaattgaagacatagatgagcttgaagatattcagaagtagacaaacagctcgaaagatatcaaagagatactctgagggcaataagacctcaacaaatatattgcatgggattttttgagaataaaaatgggttatacagaatatctacagaagtagagttaagcgttttaacaaagccagttgagttaaaaattgtagccaaggaatttgaaaatggattaaagtattcagggtataaatatattcaccaaggtatgtatataataggaatcacaggtatgacaagaaagaaattaggagctaaagttttaataactctgttagataaaaggtgggacacaatagataaagcagcattaggatttttagaaagtgatatgaatgagaatatgttgataacatatatagccccagatctaatgatgcctataaaagaatttatagataaaatgagttttggttttcaaacaaagggatacgaagaatttaaaggaacaaatttgctagtaagcatagaatttataggaagattaactaatagaagtgcctccaaatacaaaataaatgtaaatgacgtgattgaaaatatgcactctaagggaataactttcatgagccctttaaaaataagttctgaagaaagggcaggagaagaatggaaaattagtgatttaattgaaagcaaaactttgaatcagcctgaaaattatataagttatcaaaacagtaaaggaaataccagcattagatttataaattacaaacccagaaccacagatgacttagaaacagaagcatctgatagaaatataatagataaaagaagacatagtatttcagagtttatggaaaagttagatcaagaaagtgagataaaatattacgaaaataaattaaaggaaataaatgaagaatataataactctatgaagtgtgagtggcctaaaataagagataaagaactttatttctatagagaattagctagagtaaagaaagtaaagaagaacgaagatatggcagtagaaatttttaaaaaccaagaaaccaagatagaacagataaagaggatagagcaagataagcatggcaaagaagagcaaaatcttggtaaaattttaagtgaagaagagcaatgggcagagaatgaaagattatttcttgaaagttatgaagaagaaattaatctaataaatgagatggagaatatagaaaatgaaatagacaatgcagaacaatataatgattttataaacacattagatgaagtagggttacataatcttgataatgcaatggaagctatggaagtggacttaggaacatgaaagagaaaaagatatggagaaggtactgtgaaaaacgaaggagaaagagaaagaccagctagggcagcaggaaaatggccccctgataaagaagaattttcatataactatataccaggacaatataggcacatgggtactaagagaagagactttgagaagcctgttaaatttcaaaaccagaggagtgatggtgctatattaaatttagccgcacatgaccctattgattggcctaatattattagtatttggaaaggtttaatagttcaaaaatatatacaaaaccagcacaatataggaagtaaagttgaagatatgataacctacatagaaacatttttaggtgaatctgctaaggttctatgggaacaatgggttgaaaagaatcctaataattatgaagaattgaaaagagctggtagcaattcgcataattttgcaaatgttatatctaacattattatagctgaagatccggaattaggttatacaactttgcagaatgaaaggttaaaagaaatagaaaaattaacgttaacaagttggaaaggcataaaagaattctcccaacattatttatataatgctacaactgctaaacaaggatataacaggggaatagttgaacgttatttcaataaattacctgacccactaggaagtatgatatttgaagaatataaaaaggaaactgaagga

SEQ ID NO: 41768 - DNA, 1969 bp, Oryza sativa
tagcctacaccttatattcagattatctttggtagtaattacctttccaatattagcttctgaatttgatttctctatgatgactggctctgataccacttatacttcggacaatatacttgttcaaaaacactatttattcggctgattactattcaataaacgaagatttcagaagactactcaagaaggaatccagaagaaggaatccagaaggacaccctatgaagcataaaggaataatatagggtgcggtgaatgacatatccctgtgaagaataaaactttcggcaggaaaggcctcaactttagcctgctctcgtgaatccacagtagtgaagagataagcaggaggcacaggcgacgccacccctgacctctataaaaggaggggcctgcccagctgaggggagaaaaaaacaacaacaacaaagacaccattcagagcaaagcttccaagcacgctctcaccctccattccaccgttcttagtagtagtgactttagcttaccttgcatagtatattgaagcaaggagttgtgttataacgctgtgtaaggtaagaacagcttgcttgtacctaccttcgggtttatatatatatatacacacacacatatatatatatatacatatatatatatatatatataggacactcatatggggcaccatggtgcccgggcaccatggtatctaatgcacaaaattactcaaatttttcaaaattttcaaattgtgagtatatacctagttataataatttgattcatacctatacttatcaacaaaaaaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatacatatatatctatatatatatacatatatatgtatatatatatacatatatatgtatatatatatacatatacatatatatgtatatatatatatatgtatatatatatacatatatatatatatatatatacatatatatatatatacatatatatatgtatatgtatatgtatattggagggtgagacacttatttgaagcataagtgtggtatacactaattaccaatatatgttaccaatatatgttacgtaacacttatataatcaaattcagaaatcaaattcagaagcataatatgttacatatatttatataccaatatagtgtttttttaagtgtatgttacacttaaagaaaaaaactttcgtacctctgagatatatggaacattattttgatatgggataaaagtaattccttgctcatgtattactgtggtttgtactgattgttgaaggaaccttaggccaattatcatgtcatcattaatcattgacaaatctcttattgtaatctcatctattatatatttagttgcattaatgtaaacctccatattataagctaactgattatgaattttctttattccggacatgtctgtggaaacttctgccttattgtcgtcaattgtgtgaactatttcaggacatcttatgaaatatttgtcatgaataatattctttgtacacccggtgtctactagtgctaatattttataagatacttttggtgtcaattttattttaacagggattcttatacctaatatttctttgaaaggcaatcttactatatatttatttccaaaattagttatggcctctcttagttgaattattttagcagtattactgtcttttaatgttat

SEQ ID NO: 41769 - DNA, 10040 bp, Oryza sativa
ctttcgtacctctgagatatatggaacattattttgatatgggataaaagtaattccttgctcatgtattactgtggtttgtactgattgttgaaggaaccttatgccaattatcatgtcatcattaatcattgacaaatctcttattgtaatctcatctattatatatttagttgcattaatgtaaacctccatattataagctaactgattatgaattttctttattccggacatgtctgtggaaacttctgccttattgtcgtcaattgtgtgaactatttcaggacatcttatgaaatatttgtcatgaataatattctttgtacacccggtgtctactagtgctaatattttataagatacttttggtgtcaattttattttaacagggattcttatacctaatatttctttgaaaggcaatcttactatatatttatttccaaaattagttatggcctctcttagttgaattattttagcagtattactgtcttttaatgttatcaattgctctttaaattcggtgttttgtatgtccttattctctggtagtgccttaatatcgcaattattttttaggttctctaattctacttctagtttatttagtctattttctaacactcgtactctactagatagtcttttcatctgattctaattctatttcttttctccatttttgtttatttgcttttatacattcagcacaagcttgttttagacatatactacaagtcactctattttcttgacttgggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgattcgtcatcttttatttcatcatcacatactaatatgttttcgtttacgctatctataattagaaccctctcttgttcttcatatttactagaatatctcttttgatctttatttgggcatgttctacttaaatgatctggcgagttgcatataaaacatctgcatattttgtcataggttttctttggattatatcttcttacatttcttttatgtaagaagggtgctctattatctgatcttcttaagaaataccttttctttgttctaatattattgttgtttctattttgatgtttataaatccttttacttctaggcttgtcttctccatatgacaagggtatttgaactattttattgcagaaattgtaatccgagtgtttcatagatctttgggcttggatacccgtgcatatttttcttagttgcttaaacacaaaagttatggcttgagagatgttgatttcagctccttcagtttcctttttatattcttcaaatatcatacttcctagtgggtcaggtaatttattgaaataacgttcaactatacccctgttatatccttgtttagcagttgtagcattatataaataatgttgggagaattcttttatgcctttccaacttgttaacgttaatttttctcatgtctgacactatacactattgtatagtgttttttacacactatacactgtccataaatattaaactatacactatacataagtgtgtatattatataaatattagcactagtagacaccgggtgtacaaagaatattattcatgacaaatatttcataagatgtcctgaaatagttcacacaattgacgacaataaggcagaagtttccacagacatgtccggaataaagaaaattcataatcagttagcttataatatggaggtttacattaatgcaactaaatatataatagatgagattacaataagagatttgtcaatgattaatgatgacatgataattggcctaaggttccttcaacaatcagtacaaaccacagtaatacatgagcaaggaattacttttatcccaaatcaaaataatgttccatatatctcagaggtacgaaagcgtggtggagtctcccccaaactccccaaactcgacaacttagaagtacccaatcttgagcctgaagaaataattaatgaatatgagcttagtgagaatatagacaactattatatatcaaattccaacatagagtgcataggattacaagcatttgcaccaaatcggtatagagatattaagtctaaaagggatatagaaaaaattattcaaagattagaagatatccaaattataggagaaattcctatgaaatattgggaaaaaaatgctattgagtgcaaaattaatataataaacccagagtatattattaagactagcccaatagaagcaactccgaaagacatagaagaatttaagatgcatatagaagaactgttgaaactaggagccataagagaaagcagaagtccatataggtctgcagcgttcatagtaagaaatcatgcagaagaagttagaggtaaatctaggatggtcataaattataaaagactaaatgataatactatagaagatgcctataatatcccaaataagcaagaatggattaatagaatacaaggtagtaaatatttctcaaaatttgacttgaaaggtggattctggcaagtaaagatggcagaagaatctatagaatggactgcatttacatgtcctcaaggacattatgaatggcttgttatgccattaggattaaaaaatgcaccagcaatttttcaaaggaaaatgcagaatatatttaacgaaaaccaagaattcatattagtctacatagatgacctgttagtcttctcaaggacttacaaagaacatattgctcatcttgaaatattttttagaaaggtggaacaaaatgggttaatattatccaaaaagaaaatggaaatatgcaaagaaaaaattaacttccttggacatgaaataggagagggcaaaattcatttgcaagaacatattgctaagaaaattttagaatttcctgatgctatgaatgataaaaagaaattacagcaattcttaggacttgtaaattatgctagaaatcacatcaataatttagcaaagttagcaggaccgttatatgctaaattaagaaaaaatggtcagagatattttaattctgaagacatcaaattagtaagattaataaaagagaaggtgaaagaattaaaacctctagaattaccattagaagagagttactttattattgaaactgatgcatcgcagcttggttgggttgctgtattaaaacaaaggcctactaaatattcatctaagtcagaagaaaaagtttgtaggtatgcttctggaagctataaattaaaaaccgtaggcaatacagatagagaaatacttgcaataatcaatgcgataaatgcctttaggttatatctagggttcaaagaatttacggttagaacagattgcgaagctatatgtagatattataatcagcttaatagcaagaagagttccactaggaggtggattttatttgaagatatcattactggcaacggatataaagttatatttgaacatattaagggaaaagataatcatttacctgatctactctcgcgattgcctattttgcaggaatgaagaagtccatgaattataatggagttgagttcttcacgtttggagaagacaataagctcaaagtattcccacagaatacctataagtttaagccaaaaacccacataatattagatgaagtccaagaatgcattttagataatttctggtatcaatacaataataagagggaagaaaaaggctatatgctatcaatattaaacagtcttgctgaatatttccatctaatgaatgatataatgccaacatcagaaaataatgaagtaatacagcaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcctaaaaacctacgtataaggaatgcttgactaagggagtagatcctttggatggcgaatatatcgattggaaaataattgaaaaatttgaagaagcatccccccaaattaaaaaagaattgaaagaagaaatacttaaagaattaaagaaagaaatgaatgataaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgtgggaagactatatttgcgaatgaccaaagtatgaattgaatttgaatcaatccaaaatgcaaggacagtgaatgacatttgactgttaaaaatactgtggagaatattactttcggcggaaaagaaaggcgcaggtacagaggtgtctccaccttggccaattcaaggacaaagtaagccaaaaagaagataagcatctccatggtgcgagccagctcgtgaaaatacagtatctagaagataagcttgaagcacagtcgagcctcccgagctcctataaaaggaggggtttgctcagctgagaagaacaacgaagacaccattcagagcaaagcttccaagcgtgctctcaccctccattccaccgttcttagtagtagtgactttagcctaccttgcatagtatattgaagcaaggaggtgtgttataacgctgtgtaaggtaagaacagcttgcttgtacctaccttcgggtttcccgaaagtgaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatacgtagagaagtgttcccttcgggtggaactgcctagggagacgataaactcttagctagaacaagtgtggcttggaatatctttttaagttgcttctaaaaagacagataggtgaggcatacggtgagtaccgagtaggactttacatcatctgaagcaagcttctgaggctgtctaaataggattcgccaccctgcaaagatcctaaagttaaaatatctctcgaagtgaacagtattgaacagtaatttaaacagtaaactgaatagtgtttttgaatagtaaactgaatagtattcagccgaataaatagtgtttttgaacagtgtatactatctgaagcataagtgtggacagtgtatattgtctgaagctatacactaattacctcgtctaaatacagcaatgctatttaaataattacgcttaaaaataattagtgtatattgtatatacactaattatttatatagtgttagtgttagtgtatagtgtggacagtgtatgctaattagtgtattctatttatattgcttgtataattacactaattaccaatacagtttcaccactacagtgtccacagtgtatatgtatatagtatatatatatacatacatatatacatacatatatatatacatatatatatacatatatatatacatatatatatacatacatatatatatacatatatatatacatacatatatatacatacatatatatatatatacatatatatacatacatatatatatatatacatatatatacatacatatatatacatatatatatatatatatacatatatatatatatatatatacatatatatatatatacatatatatatatatatatatacctaagtaattgaaaaagtttcatactcatttgaattgggtatatactcaatttcaacaatggtgcccgggcaccatggagcaccaaacaaatttactatatatatatatatatatatatatatatatacatacatatatatatatatacatatatacatatacatacatatatatacatatagatacatatacacatatacatacatatatatacatatacatacatacatatatatatacatatatatatatatatatagaaaccgttgcaatctgactcccatggcagtattggtagtagtatttgctgatgcgatgtccacgtggaatcccagacttcaaagaaaataaaaaagtgtaggacccatcagtcctactcccctcactctccctccttccttccctatcccactctctctccctcgttttcttagtggcaggcgagagcaggaggacaatggcaactaaaggcgtaggccttccacttcaagcggtgccccgacgaggagctgtaggcctgagcacctccttgttcatggcacgattctaacattagagacgatgatggagtggtggaaggcatcagggggagatggggagcgtgctccatgccatcgctccttgtccctgcttggcggcatcagtccagttggtgtcgattagatctatatgggtatgtgtagcacagcgttggaatagctcgtgagcacgtatgtggagattggttgcgtgtgtgtctaaccccttgggtttccccagcgccgggtcaccgggtgaatatggtacggtatccctcataatccatgtacctaccatctatttagatatgataggattgattatcttatccttaatccctttcttaaattacaagtaagccgcatggacctagggcactcggcccactgttggtatttcttaaccttacaaataaaatccgcaagcgcatggaaaatactgatgtagcacttcacccgagagtattctcagttatcgatttacacagggaacatgtgtgtgaactctaaatcgggttcatccaaggacacgaagctacagataggcaatggatagagaggattcactggtgagaaacagtgtctatagaaagctcaactttaatctaacgcgatacttcgggcactggccagctcgctgttcccagatatcgctctactgcgcacccgaacatgaaggacttcagtgataatgagggctatcaccacctctacacccacctcacacctactgtgggatgcggagcaaacaccgaaaattaaccacctagacacagcgtctaagcagactaagtacttactttaatgtttctcttagtaaatcattatattttagtttattatagtgaacgatgatcccgtatggtaattaggaactaaccaagaaataaatctcactaagcaaaactaaattactcgaaagatatttctattataatcagagtaattaatagagcaaaagaaataataaggggattatcgacaactccggaactcctccgacttcttctactctactgtctccctattctagtatacaataaagtacgatagagcctcttataattcagctcaagcttggagcgtatgttcaagttagtgaagtgagatctttatatagtggcaggtatgacggttgcacgatgcgaattgtcagttttgccctccaaccgccatcaggagctcatccggaccgtccacgccaaaacgtggatcgaacggttgtggaagtggttcggccgaacccatgtctggcccaacaggccccaactttggcctattgctccttctctgtctcctctatccatttctgcgaatgaaggcccttggagtctttttgagtgtagttcctagcccactctttgtatgaataggatttcacattcacttaagtctatttttggtccaactttgacagtttattacctgcatacaaatatacaccaacactcatggaatatgtcagaattaaccctatcactatgttggatgttttatttctttgattgatgcaggtattggtggcataaaatttgtcaataacagtcgccaacacccaccccttactatccggcataaaggcccaacatgagataattgcgtaccatgtaccctacacaaggacaacaacctaatataaactagctagatatatgattcctatgtcttctaattaattacttaagttaaagataaagctctatcgaatacttcgggcactggccctaagtttgctaggatgagtctagccttgagctctatgatgtacccgaacatggagggatacgaaggacggacagagctatcaccacatgccacctacctcactttccgtggagcacccaacaaacgagggtaatttatgacctagatatcacgcctaagttattaattactactctagccttgcacgagaacttccttctttatccagagtcctagtactagagcactcggttgcacactaagtgactaacccgcaccgatgagaatatatctcacttaaataaataattaaagaacataaagaaactcgaatgcttacataaataaagaaagcatccgctgaggtacaaacgagagaagaaggccgacaatctcggctttctctgaaactccgttggaagaatgccaacaccccggcactcctctgtaaaaattctcggaggaacctcgatatttcggggcactccttccagagcttcccctcactctctactaagccaacatactaaaaatgatactacaagtgagttgtactctacttgagctcaagagttgtgtgttgtgaagtgtgaaggcatcctccttttatagcttggaatgacggttgtatggcaattgtggaggtcggtgcgcccttaaccgtcattggggagctatcagggacgtccacgtggaaggccaagatcagagatgccagtggtggttcggccaaacccctagtttggccaacccctaggccccacttcctggcctaacctttggccaagagcctgattggtggggcccttatgacggttaggatggttcggtcccattttaagccagtttccactgacttgtgggccctccaatcctgtactcacacatgattggtcggatgttcattttcatcgcatgtcaagtatattttctccttaattaacctgtatacatatatttaccaaaactggtggaagtggttagtagtaaactcctaccaataagttttgataagaaaattgaatatcttttatgcagaagttgacgattaaagtttgcacttaactaccgtcaacactcatggagaaggatagtcacaagttttggtggttgggagcagaagttccaaagcgaatgtaacttccgtttcaagtgtttaatttctatgaacgcctattcaccacctcctcccctaggttcagaccaagtcctttcagaaagggttttctccatcgatgccctctatcgactttaccgggttcctctagtaatctcctccccgatagctcttttcatttcgctaccatcccgtggccttgtgctcttcattgcttcctcatttattgcctatcatcctaactactagaaacttctccactacctcccctccaaattctagcaatcgacttaaaatgtgttcactacacttatttgccttgtgtccgccgccaacccacccctccaaacacacacatgcacacacaatctctaataccacccccgcctcccccacccacaccccacatcaacacgcacacatacacacatggccacaccaaccattttctccatggtccatagtgccatttttcttgattccttggatgattggtcactgctagtcaatgcctggaagaaaggacaaacgaggaagcaatttacatatgaggaagcaatttacatatgttgcaatcctggtggctgatattaatattatttcagatatcaaaattttggaaactgg

SEQ ID NO: 41770 - DNA, 1463 bp, Oryza sativa
tcccgtccaacaaaaagtacctcgaggtaccggtaccaaatcgtttaagatcgttggatttgtaagttagatccaacgaacgaaaacaatttggtatcgtgagataccgatacctcgaagtactttttgttgaaccagagcaaatctcttatttggtatacgaggaaataaatgaagggtgaaacttcgccatgcttcttaacatgtgaatatttttattatctaactatatattacctatccacagcacatcgcactactcgtgctctttctcccatcaccacattctgatgagtttttccatgttggtaccacatggtggccttgcgctcttcactcatcctatcttcctatatagttggtacccactaaagagcatttactcctataaagcaaaacatgcaagaagccacatcgtcaataattttaagccatcagatcatatatatactttctatatagttggtacccactaacaattattagaagctaaagctcaacatgcaagcatgccacattatcacccactagcaattactattctagcccatttaaaatcccatgcaagtgtgacatcccggcccagggcttaataggattgatagaatactcatatcaacaagttgcaacttcttttccggaagccgatctcgaaagaactatgaggttaagcgtgcttggcctggaccgaccgggaaattcttcccgggtgcgcacgagtgaggacaaagtgtgcagaaaaggctagtgttggtctgtgagggtagtctatgtcctaggatagctgccagatgtaagagcgaccgggaaattcttcccgggtacacacgagtgaggacaaagtgtgcagaaaagactagtgttgatctgtgagggtagtctatgccctaggatagctgccagatgtaagagggctcggcctcgaagagtgtggggcgttacagatggtatcagagccgacccttgcagctatacgtatatatgaacatgtacgcggcatacggtgcatacgggatgatccacgaagtggtcgtatggcatgacgtatgtgcgccgaaaattgtctgtatatacgtggtgctaataggggacgttcctggcctggattgaccgacgattacgttggtatcttaagggggtgagaatgtgacatcccggcccagggcttaataggattaatagaatactcatatcaacaagttataatttcctttccgaaagccaatctcgaaagaactctgagaggttaagcgtgcttgtcttggagcaattcccggatgggtgaccgaccgggaaattcttctcgggtgtgcacgagtgagaacaaagtgtgcagaaaagactagtgttggccagatgtaagagggctcggcctcggagagtgtggggcgtcacagcaagcatgccacatcttcactgtgtggggcatcacagcaagcatgccacatcttcactcactagca

SEQ ID NO: 41771 - DNA, 2366 bp, Oryza sativa
cgttctgctcgccattaattgcgcggcgcctcatttctcttgcctcaccgcccgttctcggctctcaagtaaaggttgcagtactcgcgtgcatgcttgcctgctcccttcctctccgcagcacgctctcgcctcccttcgtctcctccagcacgctcatcgccagcatttagggttcacgcacctgcctcgccacccggcacgcttgcgctatggagtcagtagaggcgcagcactccgtcgacgcgttggactcggaggccatggagtccatcgagtcgcaggaatccatcttcggcgtgctgctggactcagtcgtggccatggagtccgtcaaggcataggactccatctctggcgtggtgctggactcgatcgtggccatggagtccgtcgaggcgctcgactccatcgtcaacacgctggactcggatgtggttccggactctatcgacatggtgccgaactacgtcgacatggtaccggactccatcgaggtgttgccagacaccgtcgacatggtgctggactccgtcgaggttgtgcagtgtgtgctctctgcggcacgttccacgctagtggcgtcttcggagaagcctgctaccaagctcgccgcgaagctcgcaggtatgcatgttgcagtcttgtacgtagcgattacgatctcacatcatggttgctttatgacatagaaaagtttgattgtgagctctacatccctgatatggagatgcttgaaatgaatggtgacacaataattctacccgatcacgttcaaatgaagttggacgagatctacaatatgaagaagttggaagatgcaaagctgaagcaagatgcaaagaaagaacatgtcttcttctaatttgctactaatatgcttgcatcttgcttcgactagcatgctgcaaagagaagaggcttggcatcttctaacattctatgactaatgggctgcaggaaggctagcaattgcttcggctagcaaggaagcttcacaagagatttgcaatggcagccgatcttctttctctagttttgcttttcgcatgtgaggaatcttgaacttgttgcatcctttcaccttcatagcttccatcaaaatactttgtagtgttagaaacattcagtttgctttgtgtgccgcatactctatgaatgcctacaaaacaagtgtgcaagaaatgaatcaatgagcaaatttgttgttgaagaaacaatgaaacatgtgtgaacaatttttttttactaaaagtactgccagtgctttgcccagtagtttaaattttataaaataaaaatatgtacaaagttacaaagggaaagaaaaacaaatatgctacaaagtttgtatccaatcagaaatggactgcttgagtggatctttcattctacacttatgcagaagaacttctatgacaaacatagatttccatgactgaagtgatggctggacagattgaaacattaacccattcctttgcttccaaatatgccatgctaccatgaaaaaaacttcaaggaaaccctttcgagcaaatctgattctcgccaagacaagcatttggaaaaactccatattacaattccaggaaatgcccatctgctgccaacaagccacactaaagggacatgtaaaaaagagatgaagcctagtctctctttgatgtgtgttgcacaaggcacatgtgagatcatcatcctcttttgcacaatgtcttctgtcaagcatgtcccttgtgttgagtctatcacaaaataatagccatgcaaagacctttatcttcatgacacatttggtcttccacagccaaatcatgggcctgggaggatgtagtgtggagaaattaagattataaaatcttttcgctgtataagcatttgatccccaaatgaagctccaagcatcacctcttcctggctgaagctgtgatcaaattacctcttgcactgctggaactagagcttctattgtttttcattcttcttgtattgaattgcttgaatagctcgaaaaaaaccaagtaaagaatgttgaaatccggagaattgggtggtttacaaattaggcgaatattgaatccttcttacttagcagcctcacaaaaaaccggatcatccaattttaaatgggaaggtgcattatcctgttgaatgaagattggtttgcccacatcttctcttggccatttggctcaaatggcaggtaacactttgttgatcatgaaatctctaatcacatctcttgtgatcgaagttatgggcttcataaccaggtctccacgaacaaggtcggttctctcattacctcttctagccggttcataagtaacaagtggaaaacaaccaatcctaccatcaaaaat

SEQ ID NO: 41772 - DNA, 8834 bp, Oryza sativa
aatatttctcagatttttgatagaggtagaaccatttttcatcaatgaacacaaagtcaaacaaatccttaaactttggatcatcaaccaaatcttgctcaatcatatcaacacaccacttcaacctagccttcttgttaaaatctgtgaggtatggtttgatgctactagagtggcgtctaagcaatcctttttttgaaatacctttgtatcctagctttgcttataccaactttactagacacatcttctatggtcattctttgcctgagaggaatgttgtgcaattgttccaaatcaagagggactgccttacaaccacttctacccttctttcgactagcaaccacaaccggaatgttatgagcaagttggattttacctcgcttccataagcgctggactgtccgaatgtgcactccaaagtccaaattgatcagcaacaattcttgtatcattcttgtgtagtatcccattcttgcttttagccaacaatgcttgataaacttgtttcctgacgtcttctgtcatgtattttctttgatggtttgcttcaatgggatcaacatgttctagtaaaacaaaaaaaagaatcatttgttagccacggcttacaatacaaatagtatatacagcatgcacacggcgcatgttaaaaaaaagcatgcacggtagatgttgtatgaaaatagtagaaacggcatgcaggtttaccaggtaggttttgtacgaagtgaaaatcaaccgctccatattgatctaatggaaagttcaaatcgattccagtccaaaaagtaaacaacaaactaagaaaggatggaatttgaaggaaataacaaactcaaacaaggaatcacattaccattctcgtcatcttctaaggcaatgttcagatcaaagccattgtcattatcttctaagcgaacgtttagatcaaagccgttgtcagcaattacatgcgatacatggaaagagaagagagggaaagtgaagagatggagcacggtaatggaaagagaagaggccgggggaaacacccccatttaaataggcacggtgaaacgttgcgcgctaaaaatacggcgccattgcaaaaatcacgtgccaatcaaaaacgaatgaaaaatggcgcgccaaaacatgtccaagcgcgcgctacgcccagccgatgcgaaaacgcgagcacaggcgcgccatgtagggcccaaacattcccatgtaaaatgaagcaaccagcaaaataaaagtggccaccgggaattgaacccaggtactcgcaacacatggctcgctccaagagccaactgagctttagttctttctcgtatgaaatgcacccacaatcctatttaataggggtagacagggaaaatacctcctagttaatcactccttggtaagcacaatcctatcctaaacgacatattttacgagtatggagggagtacaaagataaaaattgttggatcaagaaactacttattcatccaattcaatcatttattagttatccattcacctcctttgctccacctcatagtcacacatagcactgttacatattttgtgcataacaccatgttttccaaatacaactcaatttttgtttaatatgtgtgttttgtttttattatacatgataagatagcatataattattagatatcgttacctgaatctattttcagaaaaaacttcagtgaagtagagagatgcaaactgtctaactacaacgatacccatattgtacatgaaaataatattcatatattatagcaatacacactgacacttggaaaaataaagcatgaattgtattgtaataacataaggcatatataaatccacattattatatattttatatagagagagagttgcacctaaccatttaaaactataattttgtttgacgataaaactagaaaacacgtgacaaagacgcagggtgccaactagtttactgtttcttggttcaaaattttgccaaatagcttaagtggtcactacaactcccttcccaaaaaaagaggaaaaaggaaaaagtaaacatgcgcgcacacatggtcacaccaaccatgttgtcacacagccagtagatccaccatcctaacctgtttcctgcctggattgagatcctctgactttagggggttaaagtcagaggtgaacagtatcgtgactttgagctgcttttagccatccgatttgtagggaacggatgagatcgattgctatagtgatttgtgaatagtgactatgctcggtacatctcactgttttgcactgtagcaacatactcatttcactgtgcgtctctgcctttttcccctaaaggcggaggatccggatccttctcacccaccacatactaccctctcaagtgcagttaacattaatcatattatttgagttttattattaatttgaaataccatacaacaatactaaccatatttaagtttaattaattagttatgtgtggagaaggtactacgcacccatttgcttgtttgtaataatatcattcttcagtataatgttcaacattcagaactaattgattgggtgcattatatgaatcttacaagcttttaacacttccccaagtcctcttagcactctcgttcatttcaattcttagctttttgaggcttactttgtgacttgcatgtcccatcgtaaataagtactcacggaggtctataccgatatttgctgacaactatctagaaaaggatccagttcctccacatgcagagggccactgttgttgtgaggagaactgtaaataaatatagtgaatagtaccacttcaccattactacaaaattcttcttttgcatagtggtcatcgggatcgaagaagatgccatctttatggtagcagttgcggtggatgaagtggcacatatccaattgtatgttttcaatgcttttaccatctatgtggcggtcattttcaattctaggcctccgcatcagcagcatgagaagaaaatacttgttaatattattagtcttaccatcaattgaagaaaatccttcctcaaatctcacatatttttgggtcattggatgcgctttgtgattcatgcttcatgtgcttctcctccaacttcggcgacctcctctttttcttcggcgccgacaacaacccaaactctagcagacaacctacaacttagggtctcgggttgggcgagggtttaaggggtgggaaagggagggataagaagcgggtggttgatagacttagagggatggccatggaatacgacgacttgaagttagacggtggaacggctagtgttggtgacgggggcaatgtggagcaacccattaggagacgacggccaatggtggcggatccggttgtggggagctgtcagagacaaggaagacaacagcgtgggggctcctcactgccgttcgatagagggggagtagagggaagaggcctgactagggagaagggactcgccagcatcgttaatgcctcccagcgacgctgggcgatggtgagaagccagcaccatttcggacgtgcgggcgttaaggggaaaaggaaaacgaatctcgaagccatccaacggctcaaaaattgtaagattttgagggaatgattcatgtgaaatgtgtaatagacagtcccttctttattttggtttattatagttagtgcatctttgatttttttccccttcctttttttagctaaagcatcgtcggtatgtataccttagaaactaggtgattccccacgctttgttgtgggattactaagcaattctcagtatattttttcaatatgttgataagtatatgttaaatactataaaaatgatagttctatttgttaaaacattgttcaaatgacatgaggggtgatgattggatatacttgcatattgatttgtagaattaaatatattgtagatgatgattttgttaacagtgaaatttggttttttcgcgtcaacggatgtatgcttgcataaggctaaatatataatattgctagtgggtgatgatgtggcatggttgcatgttgagctttatacttagtgggttataattttatagaaagtaggaataagttcatctgaggtccctgaacttgtcagcggatccaattttcgtccttcaaccggaaaaccagatacaacgggtccttcaactatcaaaaacagtgcaacataaatcccaaagtggtttagaaggcagtttggcagttttgactgacgtggcgcatatatggctcctttgactaggtcttcgtcctacgtggcaattcatctcgaaaaaataataaaacccatgggacccacatgtcagctaccacacaatataataaaaaatagtagggcccatgtggccccatagatcatccttactactcccatcctatctatcttctctatcctctctctcccagcaagaaggtgggcagagcgacaggacggagcagccggccggggcgcgaagcgagccagtgaagcgaagcagggagaagggcggcaaccgctccactcctctctctcccttcccctttcagcatgtgggcggcagagggcgcagagcggcagcggccagagtaggccagtggagtggagcggggcgagcggcggccgacagcaggtagggtgaagcatcggcaggcgatagagagatgggcgcggcgaggccaatgggcgaaggaaggatgacgagttgtgggccttccccttctcctttccctccctagccacggctgccagcggtgaatccttgtgcgcatggaggaggaagaagaagggatcaggtcttcaccgctgcgccgcctggtcacggggtccactgcacgccgcatgaccaccatcgtcacgggagtcgtcttctcactatcctcctcatcgtcgtccccttcggcgccgtcctcccactcggcatcgcgggcccaatctggcgaggtggtggtgagaggactgggcgaaggggtggaagaaaatgtggttgtcgaggaaggcgtggaaagagtcatcgggaagcgtgcaatgggcatagaaggcgaggaggtggtaggcaatgaagccgatgagcgcgtgggagagggcagtgatgggccacgaaggctatagggaggagcaggccgaggatgtggtcggttatgacggcgggcgatggcaatccaccaactccacttcatccccgccaacatccaaatccgccatcccgagctcctggcgttgggatcctctttggcatcctctgcggtccgttcagtgccgcctccatgtacctcgtgtggtccatcatcgccggggctggcgccgcaaggtagaggaggtgaggggacatgtgggtcccactattttatcttcttgactacttcctccttttcacaatgtaagtcattctagcatttcccacattcatattgatattaatgaatctagatatatataacatcaatatgaatatgggaaatgctagaatatcttacattgtgaaacggatgaagtacctgtatattttgttttaatttttaattttaccacttttatttttggatcaaattgccacgctagcgctatgtcaatatcacgtaggacaaagacctagtaaaaggagccacgtaggcgccacgtcatccaaaaccagggaacaatactgccgagggaccttatttacacggttttgtaagttgggagatacgttatatccgtttttgcgttcagggatgaatttcggactcggcgacacattgagggacctaaaatgaacttattcctagaaaatatagatttgcccatgaagttgggctccaaccggcccatcaacccatctcgctgggccagatgggccggacttgtcagggctagtcctaccagcccggaccagcgaggcttcgtccacgtcgccattcacctctccgcacgcacccacccacccaccaaccgagcaaggaggaatggcgatggcggcggcgaggagggccctcctgagccacctgcgcgtgccggtgctggctcgtcccgccgcggcggcgggaagcgtccccgccgcgcggctcctgtcgtcggcgacggaggaggggtccaagggctcgttcctcgacaagggcgaggtcgccgaccgcatcgtctccgtcgtcaagaacttccagaaggtcgagccctccaaggtgagcacggtcgccgacgcgcaccgcacggcggattcggatctaggcgtgctcgggctgtgtagtgtattttttattcgcgtcgcattccttttgcttcctggaatggagaggattttcttcttccgaaaagagattctgtatatgcgtaagaagttgcaaagttttggtcttggtggatcaattggagccgagcctgaaacattaggggataggagtaggacaagaaacaaatcttgcactttgttagaagattagattgtatactagttacgaaaatttgattgaggaacatatgtcattcgtgattgatttggtccgtcctaggctgtcaatggatgataacactcttgtgatgacctagctccattaatccttgtgtgtagacaaattttgacattttggtgcctctagtgcggtttcacttgcactactagacgccacataccaaatttgaatagtttacccagtggccccatcttgattagaagcgatgtgttgcattgagtgggaatatgttttctttgtctcgtttttggctgctaaagataacatatagtattgtgttgtattttaattttctgcttttgttagcaaaatctggaagtagtgaacctcttgttggatgcactttcatctgatcgctgaagttggcaaatggttaatttactagaaaaagtcatcggtattagacttatctgtttgcacaatttgaaagtggggcaatatattatcaataaattttgtttacctctccacttgcatcaagatgttatgtttgatgaaacagttgttgtgactctgttccagatcaaaataattaatttaatttggataacaattataatcctttttttattaatagtctccataatatgcttaatgtatgtttgttagtcatcagtggcggatccaccatggggtctctggggtctcgagaccctactacccgtattgtaaccaagggagaccccatgaagaccccactaaaattttctgtgatacatctattaaaagaggggactataattttatatagtttgttcagaccctcctgttaatctttcctggatccgcccctgttagtcatgttagcatcatttgtttgatttgtcctgctactgtgttgctcttatttcaacctgttttgagtgtgttctgctactgcttgttttgatatttcttccatttgattaaattacatttccaaattctgtggactatttctaagggatataggtccttccatgcctaagatatgttagtctcaatgagcagctaaaaattgcgatgaagaggttacttgcatatgccttaatagccttaatagaaaccctgctgtggttcgtggatgttacttgtaccaggctccctgatacactggtacaacaaagaagtttgttcttaccttcaagaatttttagacagcaattcatgcagttgtatacttgcatacctgcattttctgttcaatatggcaaggcacgtgcagtttttaaaacactgagaattatctagcagccaaacaaatgggggaagtttttatcgttgttgggttatagtggtactattgtagtctgtctatattttctgttattcgctagacactgaactttcaatggcatggaatgatatttctctgttagtttagggaatgttggttcatatttgtagatgttgccactgtcgataataatcatttgtttatccaataaatgttgcaggtgacaccaaatgctcatttccagaaggacctcggacttgatagcttggatacagttgagattgtcatggcctttgaggaagaatttggcttcgagatcccagataacgaggcagagaagattgactccatcaaaacggcagttgacttcgttgcctctcatcctcaagcaaaataaggatcttgagaattctcagttactgattccattagatctttttttttttgttgcacgaaccaatctgtgtcaacagaggaccagttttcttgtgtttatctgcataacctttattctgaggttatgcttcttacacaacttgaataggaaatcagtttttttattaatattattggatgcgtgaataagttcgcaccattcggctgtttgtggttttatgatgcgatttgcatctaaactgatgctgcactgctggttgtagccattattgttgtgcaaacaaaggtgaatcgatagacccccccccccccctcccaaggggccttttcttttctggtcctttccagcctctcaacactgtataggaagcagagttggcgatatcatatcacttgccttcacatgaatcttgctaggcatttttttttttttggaattcatcctggtttttttactgacgcaccaaatcggtcatttcgcacgatgatgaactttcggatcacatgctagcaaagtgacagtttattggcttggctaatctattctgcacacattcgattcactggaaccgaacagatgatgtcgatggattgtcattttggtccatctctgctgctctcatggtctggacgagggttgtacattctgcaagatgcagagaactgagacacgggtggccgcagcgagtgacccgtgcatgcaacccaacttagatgctgtttcggagagtttctaccggctgtaacttttttcaaaatctttaactt

SEQ ID NO: 41773 - DNA, 21034 bp, Oryza sativa
gcctccccctgtactcctccctcttctctcccttcctcctccccttcttctctttttactacagtacacacaatttttttaaaaaaacaaaagttagaaaaatttatgtatagaaatactatatataaaaaatatttgaattcaaattcaaatttgaatcgggtatgtaaacttttgacttataaactttgggtctataaactttaggtgtataaattttagatgtatagaaatactatatatagaaaatatttgaattcaaattcaaatttgaatcggatataattcagattcaaatttgaatcgggtatgtaaacttttgatttataaactttggatctataaactttagatgtatagaaatactatatatagaaaatatttgaattcaaattcaaatttaaaacagtatataaacttttgacttataaactttagatctataaactttagttctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaataggaaagtaatgcggtgtcaaaaaatgaaaccaggtggaggagtggagggagggaggggggaggggatcgatcgctgatccatccccagggcgatcgatcgctgatccatccccagggcgatcgatcgccaaacaggatttccgcatgtacaaaggtagagtcagatatgagctctacattatttagagactagcatcctacaacagttatagacaatatagtctctaatcattaatgtattaaaatattttttcttactcttctttcatttctttcaccaccatgcaacaaaatttgctctaataaatactaagagtcgactctaagacattgttatgcataacaaccatactcctttctctttcttccatgtcatcaaatttacctgcatggcaatagagagatcactaataaagaccgttgtacatgccctaagaaatctctttaaaaactcgcatactaacttaaaacaatcagacacctaactgtaactcatgattttctaacaaaatatacatatccaaccgaatttaagagtgaatctcatattaactaaataatataatataaataagattaaaatagtctttatccgttacaatgcacgaacattttctaatagctatataatttaaaaaataaattagaaatcagaagctgaaaaccaaacttttttccgattctttggaagctggctatcgacagggccaggttttgagagactggaaccaggataggcagcagcacacaggaattgaaacgcgaacgcgtgcagatttgcagagacgacgagggcgaggcgaggtagtctgcactgcacgcgtcacaggtggccggtgcagggagggagggagggagggacgcccctgcgccggccgggcggccggcaggtgtgacgaggagtggaggaccctgtcgcccgcaggtcgcagcaggaagattgatgagattccttctcacagatacagataatgtgagacatatgctcaaggtcacgggagaagatcgtctatcgcaaggggttctaaacgcaatctaagggcccttgaatcaaaggaaggaattatgaaagaatttagtaggattaaatcctatacaaaattttttatgtagccctttaattcaaaggattgaagtttttcacatcctacaaaatttctatgaaatgtcttattgcatataggttttggaggaaactgggcccctttgaaacacaggataggaaaaacataggaatagaaaaaatataggaattaaagtggcatgttttcctaatcctgcaggaatggaaaacataggaaatatgaagagagtccctttgataccaccacaggaaacaagcaaagcataggaaagtttccaagaggttggacctcttgcttattttcctatgaaattgacctataggaatgtaatcctatagaaaattttctatattttcttatgaatcaaagggttttataggaaaaatttttttaggaaattgaatcctctaaaattcctatggcaatcctccaattcaaagggggtagcaagaggtctaacttcttggtaaaaatcctttgagtatatctctatcatccgattcctgtgttttttctgtggtctaatcaaactatcattcctacgtttttctatgttttgcaatcctctgttttacacttacattcctgtcagaatcctatgtttttcctattcctccattttttcattcctacaattcaaaggacccttaaggaattgagatttgcgaaaccagatgtagtgtacgtggcgtttcactcgatcgtaaaacactactccctccatcataaattatagcaacttttaactctcaggatttgtcccaaaatataacaacttcttcactaacattctcttcccaaccaattgttgagaatataggcatataatgatttaatatatttcataaataaatcatgacattatataagtatactagcattaacacatcattagatctacacatgtaaattaagtagtaaaacatgaacagatcaaatatgcgcaacttgtcgaacacgtaccgaggtggcggaaagaccggttgctcggcaagaactactcgcggttgcgagcgtcgacgaaggcgcgaagcacgcgagcggagaggaaggcgagccgtcgcggacgaatagggagcagtcgcgcgaagcgcttcccaaaaaccttattgccgccttctcccggtgcaggacgtcgaaggcagaggttccggagacctgctctcccgatcgccggtgcacgccggcgagcgggatggaataatctacgagcgacgacgcagtacagagtaggaggcaaaccctaaattgattttgcgtgtgttgcgtgaaggcggcggctcggtttatatagagataggtcgcttgatcagggcgccgcacgatctccactccgcataaccgaaccggataagtgaattttcctgcagcaaaacaaaaatgcaaaaggaggttgcatctgcgcaagggtgaggagccaattttgcggaccattcgacacgtacgtcgtgcaagggtgaggagccaattttgcggaccattcgacacgtacgtcgtgcacacgcgccgcatgcctgaggcgagcttgtgttccccctcttctctccaccacaacatgcttcgagtggctaggaggtcattctcccttttaaggaggtccccctctcctagaataagcaaggtggtactaaactccacatgcatgccatcccatgaggtgggcttttgtgattttctaaagaattaatcttcgaatgggccttagcccatctattaattccaacaccaatcacaacgctccaccatttactttccccatctacctccactactcatttaatcacaaccctccaccactcacttttacctactacttcttaataaccgtgtccaaccgtaaaattttttatattctaggataaccgtgtccaaccgtaaaattttttatattctaggacagatgtagtacttactttttatttgctgattcttcaacatcagcaggcagggtgttattggacatctacgtacctgtaattcttagtttcatccgagcttccgattttgtcatttagcaattctgaaagtagttttcttttcccacttttttcctgcacgcgcgaaaggattacacgttaatatattaggttttgtttccccgcttagtggaaatgccaaaggtagaacacgggccattgttttcccagataactccacagaaattctctcagaagttatagtacttggatttggacagctcaacttcaaagtacgtgaggtgaattagagatctcgtcagatagctccaaagcgattttatgcctccctgactgacctatcacgcacggtagttcacttcagcagaggagagaggcgcccacacgcacggggcttgttttctccccattctaggctagctacttgcatgcggcgagacggcatgcacggcgctggtcctcgatccaccacagtcgcctttggttctttctcctgcgcatatatacggggtgcatgtgcatgtgagcaaaacatgcgtcgatagacagcatcatttcaacatcaattcttggcctcctgtcctgtgtgtatatatatgcggctgtggtgtttgttgttttttctttaattcaaacaaaaattgcgcaagctgaattaatccaagacaattttaatctttttcggtgagattgattggatagagctcctaccaatccactttcttgtttggcgtttcatgcagtcttaaatattcagagttcttcacgacccaaaaacaaacaaaaaaaaagaacttttcatgtggccatcgaccaagtatataactgcgggaaaataaaaaaaaggaacagtttcagggagcccatcaggattcaggcattgcatggctctctcaccggtgagaactgtaacagtaacagcaccaacaactactacacaccggatcaggcttctccaccttccaaatcacctgactttgacactaacatatgagttcgatgaaccatagatccatatgtcagtgatagagtcatggtgcttttgaggtagtggatctcagtgcccacggcggcatgccacgcgccggaaactaccaaaccgaggagaaatcgtccgcttccaaccgcctgcgcatgtgtgcaaccaccgcaccgcaccatgcattattgcccttctctgcaggtgattgcttaggaaacagaccaagacacagcgttatatagcgtctctgaccatctgcgttcttgccatttcggtgctttcggctggctgcacagcacagccacaggagagctagctctcatcacgggccaaatccaagggggatatcgtatttcctgtgcatcgatcgtttgctcattcacgagctcacagactcagagtctcacagggagatcaaggagtcggagaaacctcctctgccttgcatgccagtgagtgagtgcgagagataggttcacttcagggtggttattggggtgagcacctgagctgatcagcagccatggagggcgtcggtgttggggttagaattagagcgctgctctgctgcattgcgatggcggcgatgcttctcagttcctaccagcaaggccaggttctctatcttgctgatgttgtctcttaagtctctctttgaattggaaacaattgtccggcctcgtgtattattctgatatcttctccattgaaggccgaggcctcttacatgccatggccgccagctacgccgccgccacctgctgctgccgctgccaactccacctccaccgcggcggcgaacaactcgtcgtcgtcgtcgtccaccaccgcgccgccgcagcagccgaccgccttccccatggtacgcccatcaaaacgatcacagattatgaaattaatccacattgcgctcatttcgtcctcctctccgatccgttcttgcagtacggcgtgacccccggcagcctccggccgcaaggtacacgtaatctccatcgatctctcgctgaattaaccaatcaattaagcattgttaactaggagtaattaagtagcaatcggtggaataatgctgtttggcagagtgcgggggtcggtgcgcgtacaggtgctcggcgacggcgtacaggaagccgtgcatgttcttctgccagaagtgctgcgcctcctgcctctgcgtgctgccggggacctacggcaacaagcagtcgtgcccctgctacaacgattggaagaccaagcgaggaggccccaagtgcccctagttaattcttttttttttcattttagcagcaaattaaaccaccattgttgagggagggagggagggagggaggaaggaagccgccatggctgcaagcttttcagcctttgctctgagctaaggcacggccctcatgcatccagagtttgtgaaattcagatgcgactctctgtgttcttttcctcttgttttttttttctgttctttttggggtatctctgctagagtggttgtttgtctgtattgatttcgtggatcttaaggtagaagatgagttgtcgagatgaattttgatcgtgatgtgtttcgagtttgtttgtaatttgtatgcagtattgaggagtaatttgtatgctactatgggttcttttctctcatttcccagcttctaccttttcatttttcacgtgcatatttgtcgaacaattaaatagttttattcaaaaaaaattctatacgtaagttgtttcaaaatctgttcaatctccctccgttttaggttataaaacgtttcgactttggttaaagtcaaattacttaagtttgactaggtttaaagaaaaaaaatattttcaactcaagacaaatttattatgaaaatatatccaattattgatttaatgaaactaatttggtattataaatattactatatttttctataagcttagtcaaatttaaaatagtttgactttaacgaaagttaaaatgtctcgtaacctagtaaaacggagggagtattaagtactccatccgattcatatataacgttttgatttctttccaagtctaatatttaagatttaattaaatttataaaaatatagcaatgttttaaaaatacattcactattatatttaataaaaattatttggtatacaagatgttactaattaaacttatactctcttaatccctaaatgtttaacgccgttgactttttaaatcatgtttgaccgttcgtcttattcaaaaattttaagtaattattaattctttttctatcatttgattcattgttaaatatacttatatatatatatatagttttacatatttaaaaaaatttcaaataagacgaacggtcaaacatatttaaaaaagtcaacggggtcaaatatttaggaaaggagggagtagtaaataggaaaaaaaagttaaagcggttaactaccggaactttttatattagcttcttaatttttggaaacataatttccacgaaagggaaaaatggcgctttactcgcacgcctccttcttcccgcgcgaaaatcccccctctcccgcccaaaacaaaataaaactccaaacccacctcccctccccccaaatctcgcttcccaaggaaaccgtgagagatcagacgccgcgcgccgcgctcgagctcctccaattccccacgccgcgatccattccgaccagctagggatctcgcgcttctccttctccttctccgatggggaggccgcggaagccggcgaagcccgcggccgcggcgtcctcctccgcctccgccgccgccgccttctcgatcggtacgtgaccggaaaccctagccccccacgcctcgatccatcggatccctactagtgtttgtttgcccgatcggattgcgtgatacggaaaatggggcgcgcgtgttggcaggcaactgcaaggtggagatccacgggagcagcctgaggtgccagtccacggagcaggaggaggaggagctcaccatttctgggcccaggggcgcgaagatcgtcgtgtctggtcagtgcgccgggtggcaattagtggtcctatttatttctttggtcgcagatcatcttgttcttgacatttttcttttgtgtgatctttgtgcagtcgacggggccaagagttcttcagttggtgagttctagagtgttcaaatggaggactagtggaaggggagtttagtctgtatttcttttcattgatgcggtctgatctttaagtgttatctgcaggtgacggttttgatttcatccttctcagtccgagtgatgtcaatgagcgaaacaaggcattgcttcaggtggttaaattatacagcttctgcattaatcatttccagtgcaccagcaaagcaagtgaaagtggtacattatctcgattttatatttcttttgctggtagagtgcacttgcttgcagagctagaaggtttacatggccgcatattggctgtgcacactactattagtagatgtgtaattcctttttgcacaaatcgatttaaagaaaagaatagctgtatccatggtgacaataggattttcaaatactacctctcagtcagtggctgattccatattgcaaaaccattgatcatcgtatcagaaatatttggaataggataattcattggcgttcttatactgattttcaggaggtactattgctttataagcaagaactcccaactatggattatgctgctaacactggaaggaagtcagggtttctcgaaaaatgcgtgacaaatgggtacaatcttattctcttctttatcataaagtatttccatacccacggtataatatgacatatattggcgatgctgatactactattcttgtgtttctttttatttgacacaactactgcattttgattgtaaaagtataaacagtttacattctggttgtatgtcatgtacccaggaagtacaagactctagttctgagctctactgcaggttatgaagaggtaagcattaagaaccagtagcatcatctaaccatgtacatctatttcacaatgcataaatactactccggagtctgcactgatttcttggattgcttgtttgatgttaataaatatcttagacatagcatatgatccttaagatcagtgtggcaaaaaagttattatgacaagatgagatagaagatttgaagtgttatgcttctacctaaacttgatattttatcctcagaagaaaaaacctaggatgccatagatggttgagtctaccaaccagctcatttccaattatgtgcttactatgttgatttaatgtaagatagtgttacttttaaaccttgtgcctgttttcactttggttaattgattattggctcacaagtaggcagcagcacatatttaatgattacatcaggccaggtatgaagtgcttaggtggcaataagaaaacatccataaagggcaaggagataaataagtctcttaagtgatcacagcttcaattcccctgtcatagtttccaattatctaaaagatatccccgattaaactgagtgagccattaacttggtatggcaacttctgatccaactattctcattttcctttcatctcacacgagcatcctgcttagcgcttgagaattaatttagcacttctaaaaaattctgactaagtaaactatggatagtggctaatgtctaatgaaacagagttttctctaattagccttgaagaattttctgttcgctgcaggccttgcaattaaactacatttgattaaagctaattaatctttgacacaggtaacagctgccttatcatatcagctagtgccggctgacacacagtatgctgaaatacctctggcagtcgtgagacctccttatcaacgtgtggtatgatcaatgtaaattatatttcagtatcaaaactagcatccgttgcaagtttcattcctatcctctttgcactaagttttaaatgaattgcctctgcaaaatttcttggtacttggcttcttttcctacatgagatctgtaggactaacaccccgtcacccaaacttgaaaaactaatagatttcttcctgcgagttgcttatactctgtcctatatatttgcagtcattgatcgatgaaattccttaatcctttttattttttaccctcttaagcttcataacttatgtaattctttaaatgtttatctcagggtataggtcagctcttgtacaaggagcttagccagaggcttcgaaatgttggcgtcacaaccatattctgctgggcagataatgtctcagaaggattttggcttaaacaggcaagccaaaatagatatctaaataaatccaattgttttcatttccatttgcataatgaatatgcctttattacttatggtcagcaaatgctagagactagtaatctaatgttggcactattttaaagatcgtgtctcacttaagaaactaagctactaagcaagtctatgtcctctaagcatcaaaatctggaaatatgacaatgtgagttttcttatggagtgttctgtcatcgtgatcagtagaaaagaaatgcctgattagtgattgtttatgtattctgccaatcattagctcctaaaatcttatactccatctatcctgagttaaaattataattggcaagtgccgccaccagtcacacttaatggctacctacaagcgacccaagtaatgtcaaccgtgggcaactaaatttccctttttgtagcattttagttcattatttgttagtggactattagtcttattaacagatatatcctactttatcagcacagataatcaattaagacttggaagtctatgctaactagatgcttggtctttgcttgtgagtcaattgcagggttttgaatctgttggagaggtagatactaaaggcaagatttgcagaattccagtaagggccgatatcaagagggcattatgctttccaggtggttcaatgcttatggtttcacatctgaaggatttgccagctcctcaaaagagtttactttcatctcagcaaacatatcagtttcacacgtttgcaccagatagtaagtctaagtgaattcatattgctaattttcttttgggttctggtatctcaaacccgctatttcctggaactaattgtctaggcaactataattgtgatatgacatagattacatgcaatttagcaattatatgcttatatattatacaggcttcctgtagttctgagccacttttgtgacctattacttggttgcaattttattataatcacatgaatacaattaatctaagtaaataaaaaatgtaaagaagatcgtagtagcctaatatgcctcacatggtagaccagtatccatttatgactcttcatttgtcttattaattttgactctcaccaatcaagctttaaccagcaatatttttaggatgtctaataacatagcataaagtttgtatggctagatttgtaatcaaagttagttaatttaaattttgtatatttagagatattttcttttgtgatgtttaaaaattaaccgtcaaagttatatctgtcagcgccaaaattgggctgtaaatgtgagcagtgatggaataagccttgtggtctttggtccttgtggtccttcttttgcttttaggttgtttttccccttttaggacagcatcctttcagttttgcttttagcatctttcggttttgcttttagcatccctaggacagcatctagcatctcctttatgctttattcagtttggatgctctctaggacagcatcgcgttcaaattttagactagtgtgggcagcaattagctagcagccatccagccaactatagctatatatatgtatccaacctccctcgggaaggcatggcttttgtgtttgtgaatgaagaaaaccagaaaattgcctcatctcgagtgccatcctcttctcaatgagagtaaccattgaaattctaacatctggtatcagagccacactttcctgtaggctaaacatctcctgttccaccccttcccaagctcggttgagcactcagccagtagcagcagcagcaccagctgctcctccttcccctttcccttacccctctccacacagtagccccccggaggcgcgccatgtccgacgttcggtctcggcgttcggtcgcctcgagcactcggcgtcagcaggacgccgagctcgccgcagcagaggagcgcaggcgagcaacggctcagactgctgcagcagcagcgagggcggccagactggcggcagcggagttggcagcagccagggcggaggcggaggcagaggtggcggaagatgcggcacgtgcggcggaggtagaggttgagaccttgcgcagcagcatcaacggctccatcgccagcgacatcaccgctgacagggagcttgaggagctggcaagaggaagggcgcgggagcgggcagagcggtgggcagcagtccacccccacggcggcggcggcggcccaagggaccgcgcgcccgccgacgggaacccggacgggcgcgggcgtgccggcggcagcccggagcccgcgcgcggccctcgcaggcagcgcggctctccctcccctgaccggtgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtctggtacagcgacgtcgactacgacgaggatcggcgggcactggatgccctcatcgctgcagtcccgcccgagatgcagttctcactttcccagaagcggactgccaaggaggcctgggacgccatcgctgcggcacgcatcggcagcgaccgcgcctgcaagtccacactgcaggcactccgcaaggagtgggagaacctggccttaaagccaggtgaggatgttgatgactttgccctccgtctcaacactcttttgcagaagatggtgcagtacggcgacaacacctacaacgaggagagagctgtcgagaagctcttccgctgcgtcctagagaagtacagacagattgctcgctcgatcgagtctctgctggacctctccatgatgtcgatcgaggaggcgttgggtcgcctcaaggtcgtcgacggtgatgagccacagcctctctcggggcctaccaccattggcgggaagctccatctcactcgggagcagtgggaggcctctcagggtgacagaagaaagggggagtcttctccctcgacaggcggcctcaagccacgcaaggcacgcggaggtgtccagctgcggtgggcgcgaagacgcgccgagggtggcgctcgcagaggcgcccagggcggcgccgccggcaaccacaagccggcacgagacgacacctgccgcaactgtggcaagcttggctattgggccaaagactgtcgacagccacgacgtggccaggcgcacgtcgcacaggtggaggaggaagagccggctctgctcctggcacacgcaagcatcgagcttcctccagcggcaccggccgcagtggctttcctccaccttgatgagccgaaggtactcgtctccctctgcaacggctccagcaacgacaaggctgatgggtggtaccttgacaccggcgccacccatcaccgtgaccggccgacgggagttcttcaccgagatcaagggcgttgtctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggtactaattgactctacatcctcggcgcgtaggtcgcacaaccagtttgcctcgacgctcgtcgggacgacgaggcatggcagtggcacgagcgcttcgggcacctccacttcgaggccctgaagcgcctcagtgccaaggagatggtgcgaggcatgccgtgccttgaccacgtggagcagctctgcgacgtctgcctggtaacgaagcagcggcggctcccttttccccagcagacgaacttccgagccaaggagcggctcgagctcgtgcacggggacttgtgtggcccagtgacaccggccacaccaggaggatgacgttacttcctgctgctcgtcgacgacctctcccgctacatgtgggtgatggtcctcggcagcaagggagaggctgcggatgccatcaggcgcgcgcaggccgctgcagaggcggagtgcggccgcaagctgcgcgtgctgcgcaccgacaacggcggcgaattcacggcggctgaattcgcgtcatactgcgctgatgagggcattcagcgccactacaccgcgccgtacaacccgcagcagaacggcgtcgtcgagcggctcaaccagatggttgtggggatggctcgggctctcctcaagcagagagggatgccggccatcttctggggggagacggtggtgacaaccgtctacatcctcaaccgctcgcctaaaggccctcgatggcaggacaccgtacgaggcttggcatgggcgcaagccggcggtctcccacctacgggtcttcggctgcctcgcgttcgccaaggagcttggccacatcggcaagctcgacgacaggagcaccccaggggtgttcattggctacgcggagggctcgaaggcctaccgcatcctcgacccggagacacagcgtgtgcgcacaacgcgcgatgtagtgttcgacgaagggcgagggtgggtatgggacaaggcggtggatgatggttcgactctgacgtacgacgacttcaccatcgagtacgtccacttcgagggagctgggggagtaggcagctcttcttcaccgagcgtgtctaccccagtcctcgagcctccaccgactccaacaccaacacactctcgggccacgacttcgactacgacgagctcttcgtcgacaccaccccagccggtgtccccacgcgctctagtaccaacagccactcctccgggcacgtctactccgacgccagctcgtgttgagcgcagcccggtggagttcgctacttcgctctcccacgacggggagcgcatcgacgcgtaccacgacggcgagcagctacggtaccgtacgatggaggatcttctcggcgaccagccggtgccgggactggtgcctcgcgacatggaggcgcagttgcaccttgcgtgcgacgacggtgagcctcggtcttttgtagaggtcgagaaacatgcggcatggcgtgccacgatgcagtcgaagatggacgcggttcaggagaaccgcacctgggagcttgctgacctccctcgtggtcaccgcgcgatcacccttaagtgggtgttcaagctgaagagggatgaagccggagccatcgtcaagcacaagactcgcttggtggcacgcggcttcatgcagcaggaggggatcgactacgacgatgccttctctcccgtggcacggatggagtccgtgcgactccttgcgctggctgctcaggaaggctggggtgtccatcacatggacgtcaagtcggcatttctgaacaacttgaaagaggaggtctacgtgcaccagccgccgggattcgtgctccctggcaaggagggcaaggtgctacgcctgcacaaggccctctacggcttgcggcaggcaccgagggcgtggaatgccaagttggattccacgctcaaggggatgggcttcgagtaaagcccgcacgaggcggccatctaccggcggggcaatggaggaaatgccttgctggtgggtgtctacgtcgacgacttggtgatcactggcaccaaggatgcggaggtggcggcgttcaaggaggagatgaaggccaccttccagatgagtgatctggggcctctctccttctacctggggattgaagtgcaccatgacgactccgggatcacgcttcgacagaccgcctacgccaagcgcgttgttgagctggctgggctcaccgattgcaacccagctctcactccgatggaggagagactgaagctgagccgcgacagcacgacggaggtggatgctacacagtaccggcgccttgtggggagccttcgctacctcacccacacacggccggacttggccttctccgtcggctacgtcagtcggttcacgcaacgaccgatgacggagcaccagcaggcagtgaagaggatcatccgctacgttgcggggactctcgaccacggtctctactacccgaggtgtcctggcaaggcacacttcgtcgggtacagcgacagcgaccacgcctgcgacatcgacaccagcaagagcacgagcgggattctcttcttccttggcgagtgcctcaagcagcaggtggtggccctgtctagctgcgaggccgagtacatggcggcatccgccgcttcgacccaggcgctctggcttgctcgactgcttggtgatctcctcggcagagacactggagcggtagagctcagggtggacagcaagtccgctctggccctggcaaagaaccccgttttccacgaacggagcaagcacatccgggtgaggtaccacttcatccgaagctacttggaggaagggagcatcaaggcgagctacatcaacaccaaggaccagcttgcggacttgctcaccaagcctcttgggaggataaagttcctcgagctctgctcctggatcgggatggcccaactttcccacaagacgacacacaagacttagggggagaatgatggaataagccttgtggtctttggtccttgtggtccttctcttgcttttaggttgtttttccccttttaggacagcatcctttcagttttgcttttagcatctttcagttttgcttttagcatccctaggacagcatctagcatctcctttatgctttattcagtttggatgctctctaggacagcatcgcgttcaaattttagactagtgtgggcagcaattagctagcagccatccagccacctatggctatatatatgtatccaacctccctcgggaaggcatggcttttgtgtttgtgaatgaagaaaaccagaaaattgccccatctcgagtgccatcctgttctcaataagagtaaccattgaaattctaacaagcagggggagtatttaaggcacattacaagcctaaattacagaaactgctagccaaatatgctttatccattcaatgttgagagcaatctacttacatttagcttaatggtatgagcacttgtgcatttgcacaaaataagttcaatttatctggagtgattttttgtggtctttttcaggcatctctccaagtgataccggtacttcaactccctcctgtgaaaaattgcttccgcagacagttgcatgccacaaggtcagcaagactgcagcagtggaaaaaaatgaagatttccatggtaccggaggatgttcattttctgaccaacaagaaaataaacgtacacatgaaacctcatcatcttcactaaagtcaaaaagagtaagatgttcccaacattctgaccatcaccaagacatgaatcaaaatgagatctgtggcaaacccctttctataagcaacacccccatacatgaaaattcagtgcatctgatgcccaacgaactttctaatccaagcatggtaggtcatgttaaaagcaaaatatcaggagatgcaaaggccaatatcagttccaatggaagtccttctgttatgctcatgaatattgccgatgaaacaaagaagacacaacttatagaggtaatttctgtgacaatcttcatctttgagaaaatataagcgccatgtctaatgttaagggaatatgaatcatgaggatgcactcattgcacaactaggcaaactttgatgcattgaataaaatgcattattctttcccttccttttttgttactgcaatgcaatttctcttctttaagatgaagtaagttgtgaatcatgtcgcaggtagttgagatgcttggcggagtagtcacttgtgaaggaaattcatgtactcatgtcattactggaaaagttcgaatgactatgaatttctgtattgctttgtgctctgggttagttttcatctaatttctccttcaacaaaccacagacgccttatgcttccatcttatttcaaactataagaaaaatatggtttcttgtgtttaccctcacttaattcaaaatttcatgtatgatgttcaaacatggtactcattgtagagtactccctccgtcccaaaatataagcatttttagctatgaatacctgtgtccagattcatagctaaaaatgcttatattttgggacagaggtagtaagaattttgaataactagaaaccatatactccttgcagagcctggatagtttctccaaagtggctgaaggaaagcttcaaaaaagggaaatttgtaggtgagcaaaaacttgataactgtaggtttgatgtgtttttgtgctgtcaaatatatgaaaaaacatgagcaagaaattttcatagtttctttagttcgtggaggctggagctcttattgtaattaagtaggtgtttaaacccctagtactccatccatattgaacaaatgtactgcatgaatgttcaaagttaaaaaaaagcattattacttaaagtccatggtaaaaagcaacgacttatctccttccattctcttgctcttttctgctttcctaggagaagcagaatatgtttttcaagatgatgaatttaaggtgaaatacaagtctgaactgagagatgcagttgtgagagctaaagagaggccttgctcattattttctggctacactttctgtctgacgaagaacatccagccctccgtcaatgttctctctcgcatcattaaatcttctggtggcaaggtaacttcatattgtcaagctgtttcaaaatcatgtatacccaaacttctggtgaatatatgccactttttatatttgggattgataccttaactttagaaggtgttgtatacagctacataatccctccgttacacattataagatgttttggtctcttcatccttcgactagattcactatcattcatatgaatttggacacatatgaagcacattaatggatgcattaatgaatctattcaaaacccaaaacatcttgtaatgtgaaacggaggtaatatttatttgagattcatcatgacccatgggaattatgtagaacttctatattctagtgtcagacatgaattttttgcaatgatctttcaacagcttctattaccagtgatgttcaaatgtaaaaagtcttatacttcggttacagaatagtataaaatatttacataaagacgatagttaaactaaatgcatcgctttgatgaattactggcaaactgctgcctgtgtgcttaaatggttgaatgtcaccattagttctgagttagcaaatgcagttatactagtacttcattgaggagtattattcaaatatatttactttacagctcatcaataagctggatgacataactcagcccttgaagacaatcttcttagcgtgtgaagaagatatggaacttgcattggatgctgcaaaaagaggcatcaaaacattcagcggtgagtggttcttgagctgtgtcatgacacaagagcttgaccttgaggcccctcagttcactgaatctctctgatagtaggcctgtagttttagtcaatacagacttcatcctaactaatacctcgttagttggaactgtaaattattcttttggtatctgaacggttaatgtttatgtgtaaatatgaacattatatttttttagacctctataaactatcgagctatatttatgctcggaaactttggtgcaattgttgtatgatttgaatgaatattcttaagttctaaccgggctaatctggtaaatataaatgcaagaagatttcagacacattttaacattagttttgttgcatattgtggtttgcaacagtttttcttttagcttttgtgttgctatattaattggttgccatgtttgtgagcagtaagttacataaaaaaaatactctatataagaggcatatacgtttttcttacggatcatgagcctttacatggtgttttataggcagtgagatgatgtttggtacatatccttgaaaatgtagagtagaaagatagcataggtttcaaaaatcatatggagatggcatggaaaactaatcatatactatcatgacaactgaatcatatctaatccatcagcatggatccattccattagcgtcctttccactccccatcacctcatggcttcacctctagctccactgtttctggagctagagtctaaccaaatgctccgtctgtcctagaaagaattagcctaggagaggaggggatgtgactcctcctaggttgatgtatgtggatataaggggtgtccacatcccctcctaggttgattcttgtttgtatggagggagtagttttagatctaccaaaaaacaaaaaataagtgaaagcgagctaaagtgatctgaaaagataaactagagaggtggagcagggtttaggctgctgtacaattctactccagatttcgtttctggggagtttggattctgctgaacataaccctatttaaaattgcattaaaatatgttattataaaaatgataaggttttgtactgaagtagtagtatttgggataagaaaacgaaaaagatagagcaaattttgctacaaaacttttaaaatttatgtaatttgttggcaaagatgtttcacacctgaaagacatcttagaaaattgataatttgctagtggacacttttggcttaattgaaaagagagattcatcaaatagatgagaatgccccttgggccataggcttctaacataggattggagtaaaaatttgaaaattatgcagctctaatttcgccatcacttaaagtatatcgctaacgtagatcatattccaacttcaccctagcattaggttataagcttttaaccctaagagcattcttgtattttttaagcatctctttttaattgagtcgaaagtgatatttagcacattaccaaatatttaaaagtgtctgtcaattactaaatatttaaaggtatctgtcaatcatgatacttttttcgatgtctactggtaaatcgcatgaatttcaagtgttatagtatgtagcaaaaattgcttaaaaaaatggatgacctcacccgagt

SEQ ID NO: 41774 - DNA, 4663 bp, Oryza sativa
aaaaaaaaagctgaaccctatgccccacgttaggttagcctctctacacaggcgcatgaactactctagcacagtttcagcaagttccattctggctttgaatggaatggtttgcctctgtctgtctgtgtctatgacagtatcatactatcttgtgagcacctttggaattcatgaattttacagaattttcacatgatgaaacagttcaagtcacatgaaattcctcgaaaaatcatacgtcccaaaaggacgcttgaacaaaacacaaaaacacacacacccaaaaaaaacccgaaggaactgcctcaatatccttccaaatgatactgtgtgcttctttctgttataaaaaatgaaaggaaaacgaactgttgtttcacctataacctattgatgtgctgttgctgatgatacataaagaactagtctaccaaagagtggagaacagaaccagaacgccattggtaatttggtatagaatgaatcatggatggaagacaagtatcctgttcatgagcttgtcagtcaactcccacggtcttgtagctcgttcatgagaggaatcaactccacagtacccgttccagcatcgaccactttgattctttcatcttcgacagccacattcagagcatgacagctagaatcatctgcgacaaggacggaaaattcagcagtgtcttgacctcctttcctagcttcagtagattcattgtcctgaagcatctctgccgggaggagcattgagttttggtcactctggggaacaagaaacagcagcatcagcgggagcagcctcgacaagtttctgatcaggacggcaacccagaggttactgaactctgttcgagtcacattcagcaagtgcagcatcaggccaccccaccagccagacatcagcaacccggcattttggatggacatgagcagcgcatagaaagttccttcgatgcctggaggacaaagcttggagcaaagcacgaggagcggcaaccatttgagcctcccaaccatctgggagacactgttgtcgatcaccgcaaagacgtaatccggaatgccgattcttgtgttgagccgggtcaccattatcagattgagcattcctgccaggcttgaaagaacttggccccagaatagcacgccgcggaaagggtagtccttcagtgaaatttggtatagtaaaactccgagcagcgaaccgattgaaccgaccgaatacacaaggccaataaattcctgaaataaacgatcgaatgacgcaatcgaagtgtcatcagatgattaaaattagaagaaggtcaaataactgaatttatctaaaaccacacctcattatatggatttaacagtggtatgcattctcagtattacagtccatgcaaatgatgcgatgaactgatgatatctagcaaatatctatatgcaggaatgtgcatacctcagagaatcctggtcccactattggatcagtgtaccagtagaacattcctgcttggatatccaggcttagactgagagaaacatacatatacacacacggccgccaaacttcagtgttgcccccatggactgaattgctttgtagaatttcctatgaacctgaatccatcaaagcactcaagtggcatcactgtccatgcctgaattcagcaatctcaacacacaaaaggaaaggtgttcaaattttgtcttgacattctgacctgcttgtaatcgaaatctgtaactcgcctctccttcagcaaaacaccagccaagaacaccagtgcagaagggatgcttagtaatccaagagcacccttagaacaagaaaagaaaaaaaaagcaagaatcacaatcatatcaattgacattgtgtgagaaaacaaatgatgatgcaaatcattatctaaggtcagggaatatcacacctgagaccctatggagtggacaagaagaccgctgatggagaatccaagcaatgccccaacggaggagctgaacccacacaggctctgcatgtctgcggctagcggctggtgcgtgatgctgttctgagcaaccagcgcgtccaccgtcacgtcggccaccgccgcgcccgcgctctgcgccgtcagcgccaagatcgccggcatgatgcccagcttgcggtggagagagagcgtgagcatggacgacgccccaatcactcctgaatgaatcaccgagagaagtgatcaagaaaggcgaaagccttcgaactgcgagatgggatcgaggaggcggaggctgcaatcccctcaccggcaggaggaagtacgggcggcggcggtagccggcgacggggacgacgtcggtgagcaggccctagatgggcttgacgacccagggggcgctgacgaacccctggtagaactgcgccgccgacggctgcacgcgctgcacgtccttccagtagtaccccgccgtgacgccgccgacggcgtcgccgacgccctggcaggccccgtagacggccacgacggcgagcacgaagctccagcgcagctcgcgggacagacgccggagccagccgccggggaaggaggcgccgccgccggcttctcgaagcgccgcgtcgtcgtcctcctcttggcgatccatctgggcagcgatttcttgccgggggtttcttggggatctacggcggaagcccgccggaattcgcacggctagaatgcaggtctcgcgattgctcggtgggagagattgacgaggcgcatcttggcgttggcgagctgagcaagagcaagtgtgcgttgatgggtatctgcgctcaaggttttgacttgacaccccccccacccaccttgcaactattatagtactgtatactcctactaatttaaccatggtaattttgcaccattaatctatgtactagtagtagaaaactgggcaacatgtcaacactaattttgcctttgtgccttttactattgcgcatcacctctttgcactgcgttattactgcgtagctgcttacgacctgatcaaggcccgacaggaattaataagtgaatatgaaataagttcactttcgacatttaaatgctgagtttgaattgcgtccttatccacaataccagtataatatgtcagttaatttataatatcggtgtacccgagattctaaaacagtataacaccccattttaactgacatgattagccaactatgatcataatgatcgagtaagcgtgagacccacatgagccccatatatcagcggtcaactctttttttccttcatcgccccttctctctacccatccctcttgccaatttctctccaccggtggagaaggccagaagggcggtgagcagcgggaagaaggatagcggccaatgggagaggggtgacaaccagtggactagaagaccttgagcttgccacgcggctgctcgagcaaccctcaccctcaggaacccagcatcgacctcgattgcgtaacatcatgttgccccctcggcttaccccgatggcaacacaagctacgtggccaaggtcactacggggttcttgagcatgatggcttttccagcagctgctccagttcctgtcgggagagagatggggaaaagggatgggtagatagatattaggtaaagggactcggtagagagagttggctgctaacatataagacccatgtgggtctcacgctgactcaaccagattgataatagtcaactcgtcacattagttaaaactggatgttatactatcatgtgacctcggttacaccgattttgcaaattggttgaaggacacaatctaaactcatagtcaataagagagacctaaagtgaacttattataatgaatattgactattgagttggcccagcagcccaccatgttcataagaataaggtccatgacaaatagtgctcacctacttccgcctctcccagtctcctgttcgttcctctctcccaagtctagggatgaaagtggttggaaatggtcggaaacggcatcattattttattattttttaaaaaacaagcagaaacgggcgaaaaattttcatattcatgaattcatctatttagtgtcaacttcaatgccacgccgatagaaattaaaaaaactaaattttaaaaacgataaccatcgataaaaatattattattatattagtttttcggaaacggtatcggtacggtcggaaaatttccataccgttttcacccccagccaagtcccaacaacgttccgaggtcacagcgctcgtccgggcgtccatcgctgccaatttcaggcccgttgttttggcgcccgaatccccctcccgcatttttccccttcagaaaaccccgcgcgcgcggccttctcgattcctgcccgtccgatccgccctcacagcctcaccgcctcatctccgccgtcaattggccctaaccccaccgaccacccgcggccctcgtcttcctcctcgccgcgccccctttcacaacggagccgggcgctgtccccccctccgcgctgcaccgcaaaccagccgccgcctcccgtcaagaccgtccttcgccgctgcagccgtgagggcatccctccccctccccgccgagcgagctacaccggcctctttccccccctgccccgtgctggacggtgagtggcattcttcttccccctttaaaagttttcta

SEQ ID NO: 41775 - DNA, 2615 bp, Oryza sativa
gccggattccattctagtagcaaatttctgcaatattccatcaattagagcgaatattaaaatcgctcgtcaggttggaaaaaaatggttgttgatttagttctcgttaattcccaagcatgctgtccgacattggcatgttcctggattcagatttgataatggactgatcaatctttgttgatttggtaagtggcggtgacacgcatagggaaggaacctgcgggacggaggtgaagaggcccaagagctgtgcggatggcaaggtcctcaacaagaagaggaactacgcgcagttccacctggagcttgggcagcccgattttctcctccacatgtgctcggtttgtggcatgatgtatgcccgcgggaacgacgacgatgagaaggctcacaaggcataccacaagagttacttcgagggtgtcccgttcaaggtgttgcacctgatgtatatttgtgaatctcactcttctgttcatctcgtgttataaatttctgtgaagagtttatgacaaatgtttgagttgcagggttggcgcaatgaaaccgtggtcgcgaggtctgaaggtggggatcggataattcttgtgactgatgaaaattcatgtgctcggaacagcaaggtattttgcctgaatgactaactgtattgcctagatagttgaaagaaatcactagttggggtcttggggaaatgaatattgaaaagagtgggttcctcatagttctaaactgtagaatgtgtgtctttactaactgcgaagtttctgatccaattttgcaaccactttacatttacgagaagttcagaagcagattgcagacattttatgattatgtaatgtcatgtgaatatttcaggtccaggaggtgatcaaagtggtacagaaggagctggggtttggtgaaggtcagctccttcacaagctttgtaaggtaacatcagctcttagttcaaatatgacaacatctatgcacatatattcatcctaatgggtaaaacctcatttgcgttgcataggtatatttgttcatatctagtcagaggatagtgggatgccttgttgtggaaccaatcaaaacagcacataaagtgattccaggctccacagaggaaaacggcagtgatctgcctgttgataaaattgaaccagtcaaaacaaaccatacattagcgttcgggaaaatcagttttaagagggaagtcctgaaacggcatgatcattcagacaagaacaaagaagagtaccgagatcctggtgctataatatgtgaaaaggaagatgttcctgcacattgtggatttcgagcaatttgggttgtaccgtcacgcagaagaaagcgaatagggtcacaactgatggatgctgctaggtaagttctaagtttgatgcgcattctcacctactttgcttcacttagcatctttctttttcgcagcattcctgcaatgcccgtcttgaactcttgatagcatacattgttctttttggggggaatacgcaaaaggcttgcgcatcattgcactaagagaaggatagcatgcattgttctctgtaacaacaatgtatagatccatcatagcatgcattgtcaatttggacaaattccaagcttttgaccagattataggactaataaaactatttgttaactgacatcacactgcaaatatcactgaattatttatctgtctgtccagttgttctcttctatgctctgcaagcatttccaagagtttgatattatcttatcttgctaaggcactctccattcgtcttctgcagaaaaagcttccttgaaggcgagactttgtgcatctcacagtgcgctttctcaccgcctacttcctccgggaaggcgctggcacgcagctattgcaagaccagcgcattcttagtctacaaggagcaagatgcataggagatgctgcagaagatgttacatatctgaaacttctcttcccattgtaaaaattgttttgctggggatatatgtgaaacataaacaggcatgttctgtttttagtgtaagtctaagcaccagaagcagtgcgtttttgcaggatctctatgtattgacactttggatttcctgatcagcagcattttctgaatatcatttcatattagtagcttgcaatcttccttggggaagatgagatctttatcttccttggggaagatgagatctttattagtccttgggagttattaacaagcagagttatcttctagtgttaacctctgtctctcaatactctcaaaacccaagaaaaacacaggggaaacagtacaagccgctgcaatcatatgggaacatgtcacaactttggtcaatatatacagcagaccgatgatacaatgttctgataactagtcagaatcaacaatgggcgacactgatgcttgtgcgccagaataatacatcttttaatgttttctcctcgtcaatggaccatggatggctgcatttgagtactcatcaaccactgattgtgtaagtgatggacgcaaggatcttagcgcggcctggaagtgaatatcgtcacatacaaaacgttctgacctcagactttccctcaaggccttcaagatctgcgcccgtgaaaa

SEQ ID NO: 41776 - DNA, 1808 bp, Oryza sativa
  unsure (1)..(1808): unsure at all n locations
agccaatacaataattccctacatcaaaaattgcaagatacttttttagtacaaagaaagggcatatatgagatatgacaaggagagtcacatttgaatgccatcgtcaatctaaatatgtaagaggtaccgtagccagttctaaaccatccatttccgtcaatagagttgataagagtctttctccaaccgtggcattgccactagagttcccgctgggaccagttctgaacgattacaaactccaatattaacattcactggtcagatgtggaacatgcgcagaagcaaagttttcataaattgattctactatatgaaaataacatttggggaaccatatccaacaaaatatgcttaacacttctgacacctcttcaacttcctaatcatgtacaccatggaaaagatgcaaatattattattacgtaattatttttttattagagaagggtattttttacccggcctctacatccaacagatatatacggccattaaaatagggaacttagccccgcaaacaacccaatctgaaattcgctccataggacggccattgaaatagggaacttagccccgcaaacaacccaatctgaaattcgctccatagaagatttgaactcaggaccttggggtactactcaggtcattataaccactaggctataattattacgtaattatagaagatagcctataacaattcatgcacattcttatgatgactgtacagaatcatttttaccaatatcatgcatcatgtatcatagatctcactagtatgtgccacaggacaacaagagacaagatataaatgtgcaccttttaggggcaattgcatcagcctcatcaaaaaatataatgcttggagaagcaagacgtgccatctggaatgtacgtcgcaacaaagcttcaccttcaccgacatacttggagtataactcagcaccactgtttgaaaatgtgtaagaaatttagaacaacatagaagactgtatactgaactcaaaatgatccggttagcatgttctagctatattatttggactagcgtacaggacaacgattcaagcagcagaatttgaacaaattatgccagcttggtcttaacagtacatgaaataaacatgttaagttcttttgcttcctctaataactccttttcagtacatctgagattaagtgatgtttattgaatttattacaatataagcatcacatcagaaaatattatgcaattcacaggcttctttttgcatgttggaaggatgaaatgagaaaaagagagaacaatttttacgcagcaaaccttaatgaaaagaaagaagcttgggcagcatgagcagcagcctttgcaagggtagtctttgagcaccctggtggaccatgcaatagcaccccacggataggtgatattccaagtctatcaaatgaagcagcatgcttgatgggccattcaacagcttgctgaagttttttctgaagcatagcaacaataaccattaaaggaggtttgattaaagaaatcctaaaatgaggcatattttaccttaacagctttcaaacctcctatatcatcccatgaaacagctggaatttctttaattacccctcttgtcacactatttttggccacagatttagcagactcccaatcctccatgattagcgttagcacattctcactctctgatgagcttgataatctaccataagcacgtcttgcagcttctcgacatannnnnnnnnnnnnnnnnnnnnnnnnnnnnnnnnnnnnnnnnnnnnnnnnnnnnnnnnnnnnnnnn

SEQ ID NO: 41777 - DNA, 1106 bp, Oryza sativa
ccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctgggcgttctgaattcatg

SEQ ID NO: 41778 - DNA, 2743 bp, Oryza sativa
atatgtatttctcctcttgtcaattttgatttccccgagcagatgactccgtacgtttaaacactctgcccgactagtcatagcccccaagcatcgggagttggtttaggcacttcccaaacatgcatatgagtgacatgagttcgtcattaatggaacaaagtttcacgaatcaaaatttactactcgggtacttttgcaattgtaagagcagaaaataaatttatcttatctctatgcttttgatttattccgaataatacttaggaccttgcgttactcggtccatccaacgagcccccgggtgctaggaatcggcccaaaggcaactatccatcgacaaaccaaatggaaagcataggaaaatagaactccataactcgataggaactttattgttactcggattatttcgcaagcaatcaagataaatattatgaaaaattgttaaaaaatatgatatgacatctatagtcccccgactcactagtcaacggcgaaccagttgatgtagtgaggcagaggaaaaggaaaatatcatataaagaaaattaatgatgacttagctttgtaatattccccttggtgatggcagaggtggccaatgtgggaacaaagtcgtccatcaataacagtaaagacaccagtcggcagcgacgaaggtggtcgatggtgaaagcgaagatgcccaccaaatgcagcataataggccagccgtgtaggcagagacaccagtcggcgacggcgaaggcacgccggtcggtgaagacgtggatgcccatgaacggtggtgtgaccaaccaactgtataggcaaggacaccagtcggcggcgacggaggtaggccggcggtgaagtcgtagacgcccaacaacggcggcataataggccggctgtgcaggcggaaacaccagtcagcggtggtgaaggccagccggtcggtgaaaacgtggacgcccatgaacggtggtgtgaccaaccaaccgtataggcgaggacaccagtcggcggcgacggaggcaggccggcggtgaagacgttgacgcccaacaacggcggcataataggccggccgtgcaggcggaaacaccagtcggcggcggcaaaggccagccggtcgatgaagacgtagacgtccatgaacggtggtgtgaccaaccaatcgtataggcgaggacaccagtcggcggcgacggaggcaggccggcggtgaagacgttgttgccattagcaacggcagtggtgaaggcaagccggtggagtagactcatggccaactaatcgcatagcgagacacctcgagtccatgaccaacgccaatcgcctcagtagtgccgtgtaattatatgcaaacaacaacaaaaatagcaagagattaatctgaaattagaaatcaatctaataatatagaataataagttggaagagataaaactcgatgagttgacggcgccagttgcgggcatgacgatatttgtcatatgatcaccatctggtaaattgtaggcagctgctccaatgtgtggccggtgatgaagacaacccacccagtaatagtagaaggattgctttaccggcttgttggatcagaacgatatctcagggccatggccatcgatccatggaagtacatgtaaatacgagtcaaatcagattagtaaacaaaagaagatgcatgcatacaactacatacactcctatatattaattgactcatatgtgtcgatagctgcttattgaataattggattcaagcctgtgcatgttggtagcagcctataaacgcaggactcctgattggttggcctattggccagcatgtatacttgcatatatggcggtgatcagtagatgcatgcgatcaacgcagctgttccggtgcccctgattacgtcgccgcgaggagaagcgtgctagactgttactttggcaatcaaagcagtcggccgggccaaaacattcgcaaccaaccggcaaccgcacactacgcctgttctgaggacaggggttgcagcatgccgtgtatactcccaggtggctccatatgctatcgacgatctcgtcgacagtagtactacaataataatagtacaccaggaaatcaatctgtcatagacattgttaaaaaacactagatagattgaaacgacaaacccggttgaagagttgagccatcgacgtcggtgagattgatctcgccgtttcttctgcagttgattccattgcacttttcgatgggtaattcgacgcacccctacctgccgcgccaactgtcgaaacatgaattaggcaataataaaaggggtagcgcacgagacctaaaagtggatggatgcggagacaaaggatttagacaggtttaggccctctcaatgagaggtaataccctactcctgtttggggatttgaatccgccgggtgtagtatagatctgacgatctagttgtatctcatgctccctagagggcctcctacccaccttatataggatgggggcaggattacaagatagaaaccttaatcaatacggtatcggtttcctaaatctactttacaatcttatcaaaccaggactttaggccattccataatatacgggaaaacgtaatacccaagtcatgatctgttacatatttcatagatataagttatcccctataaccagtcggataaccatgccgtgtgggtatgtggtacccataatctccacacctgggattccgtatccaacgtttgaccgtcc

SEQ ID NO: 41779 - DNA, 8005 bp, Oryza sativa
agttcttcaacccactttgcgtcgtagccaataagctatcatacacgtgagttttgatcccctggagtactattctgttagcccgttcgacttgtccattgctctgaggatgagatactgaggcaaagctgatcttgactctgagtttgatgcagtaatcttggagatcaccgctggtgaactgggaaccgttatctgtgaggatgcggtgaggcaatccatatctgcagaatattcccttgataaattttatggcgttgtcgactttgatttctcttgtcggctctgcttcaatccacttggtgaatttgtcgatcgccacaaacaggaatttgtagcccccttgtcctcgtgggaatggcccgagtatatcgagcccccagcatgagaacagacatgttaaggggatagtctggagcgctcgtgctgtcaacttggtgtgtttgctaaagaattgacaagcttcacatcgttgcactatttcacaggcgtctttgagagttattggccagaaaaaaccttgtctaaaagcttttccgaccagagtacgcgcgccggcgtgtgatccgcaaatgccttagtggatgtcgaggaggagagcttttccgtcgtcggatgatacgcacttgaggagaattccgtttggttcctttttgtatagatcgttgccgatcatacaatatatcttggcctgacgagacagtttctctgcatctgtgtcgtccggtagctcgtctgactccaagaatctgattagcggagtgcgccagtcgtttgtcgtctctgcatttgtgatgacgtttgtgacctctgcagccccctgcgggacgccggtatcagttgtggtgctttcgttgtccgtgtccttgatggatggttttgttaggacgtccaaaaactttccaggctcaagcggttcttgcctggaagcgtgttgtgcgaggtcgtctggttcgacgttgtcttttcggtagacatgtcgaacttcgatcccatcgaatctgcgttccagttttctaacctcggcgagatatttggctaactcagggctagagcatttgtagcctttgtgcacttggcgccaagcgactaatcgtgatgggagactccgaattggttgtggcgggcgggttgggagtatgctcgaccatgttgagactccgcttgtcgcactataccgccaacttggcgttctcctagatagcgattgtcccttttggtcccggcattttgagcacttggttagcataatgtgacgctaccataaactttgcgagcgcagttctcccaatgatggcattataggcggtgtcgaattctgcgacatcaaaggtgatctgctatgttcggaagttctcagcttgtctgaaggtgacgggtagcgtgattttgcccaatggtttagacgatgattccagggtaattccatggaagggctgatctgtgggcgtcagttcgcttcgaggtattcccatcgcgtctaaggtgctggcaaagagtaggttgattgagctcccgctgtcaacgaggactctcgccactttgatgttccgtatagtgggttcaaccacagttggatatctgtcaggcgtagtcgcgatcttggggtgatccaaaagacctcgatcttgtgttgagaccacttcatcttggttgtactcgtctgcgacgtgaagcagacttcgcgttccacttttttgtactccctctttgaggtgtacaacgtggaaccgccgaagatgtgggagacatgtaggtcatactctaggaaggcggagtcagagtcaccggtggcggcttcttccgccgtttcaacaacacgtactcgcttccccctttcgattgcatgttgtctcgcgagctcctttttgataacgtaacaatcctccatggtgtgattgctagtcttgtggattggacaccaagtcttgcgtgagtcgtcgttctgggggttagggcgcctaggtgattccttttgctcagtggcgaggacctctcctgaggacttgcacttcccactcttgcgatttctctttttgcttgactctggtgcatccttattggtcgatttcttctcctctcccgctttgctttttccctccttgcgcctcagagcattgtctgcatgagcgcacctatcaatgatctcgaacaactttagggcagacgtaattcggcgcgtcgtcagcttctttgtggtatatcgatctcggacgcctgatttgaatgctcgaatgacagaagcatcggtgatcttggggatcgtattcctgcactcgttaaagcgtcgaatatagtccctcaatgactcgctcgggttctaagttagagcgtgcaggtcgtcttcgatcgcgtggcgcttgtatgtcccttgaaagttggtgacgaactgttgccataagtcttcccacgaagagattgagcagggcgggaggtggacaagccatgaacgagcagagcctttcaacgcggctcgcaaataattagccaatgcgttgtcgtctgcgccagcggtgtagtgaattgtggagtagacttgcagaaattcttctgggtccgtacttctgtcatatttctccatcgctcccagtcggaacttctcaggccatcgcacgttttggagcatgggcgtgaatgccctgcatccacttcctgggacgggggggtggcccgtggttgcgacgccgttgaggaggccgatctgatgaagaagatgacaaagatgaggacgaggggctgcttggctcaggagctcggcttctcgagtgatgatcgcgtcctcaatcttgactcgggtgtggagattgggagtttcgatctcgctggttgtcaccgtcccgctcttggccttggcgatcattcccctgatctcggtggttgtcgttgttgcgtcggtcattgtggagtcgacagtctcggtcttcattgggggtgttccctcggccgtctttcctttcttgccacggaggagagcaatgacggtgttgtcgatgcgtggtgtcgccctcacgacgagaaggagagcgatgtcgatggcagtcgttgttgtcacgatccctcctgctcacggagatcgcgattttcgcggcatggcggagtaggatctcattcctgccgaggtgagtggtcaccggtgagacgtcctctggcgatattttctccatccgcgtcctcggtaggttgttcttcgtacctgcgcggttctgggccacctgctgcttcggcaaacgcggcattgaggttggtcacggtctctcgcagtcgctctacccattggccggcgtctgggtttgtcgctggatcaaaaggactttccctcaatatcgcgtctagatttcgcaactggtgagcgggcgttctctctgccgcggacgcgcttgtctcagtgttgtcgaccacgtttacatctcgtgttgactccgaagaggattcgtagccttccaagaggtgtaaaacagatggctcgttatcaccgatgtatcccacgaaccgatacgggattggggctgcatctggttccttggcaacgcacggagtttgaactcgtggttgttggacacgatgatgcggtggtttgagggtcctgaggaagattctgcagcttgtgagatcatgagatctggatctatgtttcggacagtaggtggctcctgtcgatgaagtacgctgaatcccacgttcccaataggcgtagagttcagcttgcacatggagtatcaccgaacagtcctcaagagtatgcttggatgtcttatgcacaagacaccaagatctcggtcttagggtggtcatccttgtcggctctgatcttttgtatgggggacaaaattcagccgcctgaggattcctcccgagtgttggggccatcgatgttccattctccacctgagtgggaggaattatcggcggggcgtcgtttctctgagtcgttaccgtgcctttctcattcccgatgatgattgggccagccgagattggcgtaacggtatagaccggaaagacaatggatccgacttgagtccaaaccaacgatgtcgaggtagaagctccttgattgacgttggagatggttctgttgtcgggaagtcttgaagtcatactggtagatccttgagcaccaagtccccctacctggcgcgccactgtcgacgagtgatactcgtggaccggataagttgagtattggggtacattggaacgagggtctacgtagtacaacatcaagcaaacagaagacaaggattatactggttcaggccccctaacaggtaatagccctagtccagtttatataagattgatgacgatgagaacagattacaaagagagtagatggaacagacgataccgacgagatcgtagtcgatggattcgacgagatctcccggtgacttggctccgaatactccggcttcgtaagctatggtgggtgtgttggcgatgatattcgatgtccttcacctccccctaggggtccccttttataccgtggattatcttgaaccccaagtaaggcctggaggtatgtaatctgatacgatataacagagattctatccccctccgagtaggactttggtagtttcttaactcatagggatattttccgtaatttaagataaattcctaacgacgtatacggaaacaatccatgtacgtgaaggtatgccttattggtatattccataagtcgtaggatagaaggtatgccttatccgtaaccctgacactcatgtatcgctaggaatgttgctttcgcactcattttgttggtacatttgtatatgtagcaaaaattgttgccttagcttattaatatcctacaaatgcatttatttataaaataaataaaaataatataaagtaattttcaaggcacgcataaagagatgtatgatacaacccgacaaggtactaagaaatttgaatagttagctaccttgcattagacaaataaatttattggttcgaagagttatacataaaaaaaattaaaatggaatatccattttaatatgaatacaaactaatactgaaataaactatttatcaaacacaaggcaaaaaaaaaaagagatgtgtgatattaaccttaaaaaacatgcctaacactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtgcctaacatgaatcataatccagagtttcgcacaggaaaagtccatctgatctctacacatagcttttttttcccaatatgtaacaaaaggttagggcatatagaccgttcatactgcccatccaacaaatttaaatttaaaccatcctcgagattatttaatgccatataagaagatgaacgattgacaacatcctcgatattaccatcctcatcatacgtgacatactgtatgttaggaagatgaagttggagctgcaaaatagttggatagatatcgaactgtgggaaaccaagaatcctatatagcctctggcgatgatacgtacctggcatcattgtactgtcctatctcatttatttccccaaatggatcaacaaagcaaaattactattagtggttttagatttacccaaacaaatagttaagccaagacactacaaaaacctagtattcatattagcgtactgagtatcacgcagaacaagtttcagacaatgtggatctcatcaagcagtgtgccattttggagaattcttgtgttacacaaattcaatccccactacttgttaaaattgtaatttttgtccatcgagacaaaaaagaaaaataaatatgtgaaaaattggactcttgtgtgtccgcaagatttgagtgaagaaacactggatgtccataccagcaacttgcaaagcacaggctttgttgctatagttcatgcaaatgtactcaagtgtccatagcagccctaatgattcatttcacttaatttaaaatggaaaaggtcaatcatcgttaccagaagataccgtgcatagaaaactcaactaaaccaaaaaccatcgccaattaatgtagtccattaattatccatgctaatccagttcttccataattatgcctactaacataagataccacaagtaattgctttcatctggatgacagaaaagatagattgcttttagcaataaaactataacatttttttaacacaacaaattgcaagatacaataaaccaatccaatcacttaagcccaaatgagaaaactgtatgccagttgaataccttattggtctgatcacaatataaaacattcaagaaatctaaaacgctcaagatgtgctcaatgaaatgcgtatgtgctgccaacttccccgtcgcaccagagctgctcccctacatgaaaaagatagcacaaaatagaaaaggaatcagaaaaaaggaggccacaatttccttcagcggatgtcagcttagaacgaaagaggttccacactttttggttgtttccaaccttaatttcattcttgttatgtgcatacacaaacagcactgtgttgcacactgcaatacagaaacaatagatgcaattatagtagtagatggatttcgttactgcttaaggcctcaacggacttggattcaccagggaccattctccttgcccgcacttcctgagattttcgtgccgaacagactacctcctctgacctcttcctccactccctccgcgtcccgcatgaagcatgaatcttggacaagatattgataatggtga

SEQ ID NO: 41780 - DNA, 14110 bp, Oryza sativa
  unsure (1)..(14110): unsure at all n locations
tgcgcggggcggggtggtccacaaaaggctgcaggctcagcaggggaggacggacggacgaggacacgagagcatttttgcgaggagctcttttttccagcgtcccactgccttttcaccggtccctgtcacttttatttttctttattttttgctgctgctgcttttccctggatatactacccgcttgtaccgccggggtggcgctgcggcaggcggcgctggctgacggctgaccgactggctcactgcagcagcacgtgcggggttttatttccgcccgttcctcggtctcctcacatcggcggcggagaaaggattttgaggccctggggtttacttgtactaatgtcatgtttgaaactctaattattctcaaagctagatatctttagctcaaaatttttatatttgaacgaaaagagtactattatgatttttgaacaggggagttttttagatttatagggctagatgtgttatatcatgtcttatgttttatttttttagacggagtactcccattttcgttgagatatttcagttgtagggtttcttctggaaaaaaatgtttttaaaatttatgtcggctgtgaattctaggaatattttttatatactttgggacttaatgagtcttttgaaatcccattggaataacaaaagaacgatcatttgtatttcatcttataaaccgctgttagaaatttgaaatataaggtcttgtttagttcgtgaaaagaaaatttttgaatgtcacatcggatgtttgaccggatatctgaaggggttctcagacacaaatgaaaaatttcaaactccctgaaaaccgcgaaaagaatcttttgagcctaattaatccgtcattagcacatgtgggttaccgtagcatttatggctaatcatagtctaattaggctcaaatgattcgtttcgccatttccatgcaaacaatgtagttatttttttaatttatctatatatataatactccatgcgtgtgtcaaagattcgatgtgacatttttgggaaaaagattttgggaactaaatagggcctaaatttaatttgaaaattttgattttgagttttttttttcaaatcgttgttggcaacattagattttaaattgctaaaaatatagatataaaaaaattactgacaaatacaaaatataaaatttatgcataaaactttatgctgaaaaatagattatgatgaaagatacctatattaactctaaaattaaattttagttaccgcagataaaccaaggagtagacaatgagacccgtctgcatcctcaaaattataaatttcattttcgattgctagaagtcatctatcctcatgcacaaaacagagggacaatgaagtaccataggcatgcgatattcaatctatcgtgcatggctcaattcacctatatgtttatttcttgatctttaattgtagaatttagtgtgatttatagcaatttggatttggttctttggtgaaaatcaccaagttgcagatagcctgaaaaagcaagatcgtgaatagaaaaaaaaaagaaaccggtgaaatgacaaaaagacaggcactgggtattaggtggtgtttgaatctcctaaagatgaagatgtgttggaattaatagatgggtcttaggccactcgaagattaattctttggaaaatcataaaaacccaccttatgaggtagcatgcataggaagtttagtaccacattacttattctaggagagggtgacctccttaaaagggaggatgccctcctagccacttgaagcaaatgaggtggagagaagagggggaacacacgcgcgcacgcccttgcctggcagggcgtgcacgatgtacgcgtcaaatggtccgcaaaattggttcctcacctttgcgctgatgtagcctccttttgcagttttgttttgctgcgggaaattcggatttgtttgttttggaaacattccgaaaaatccgttgcgtgaaaacggcgtggagtccggataagttacgcgcgacttatccggttcggttacgtggagtggagatcgtgcgggcaccctgatcaagtgacctttctctatataaaccgagccaccgccttcacgcaacatacgcgaaatcaatctaaggtttgcctcctactctatgccgtgccatcgctcgtagactactccatcccgctcgctggcgtacaccggcgatcgggaaagcaggtctccggaacctctgccttcgacatcctgcaccgagaaaagaaggcaataaggtttttgggaagcgcttcacgcgactgctccctgttcgtacatgacggctcgtcttcctgttcgctcgcgtgttgcgcactttcatcaacgcccgcaaccgcaagtaattcctgctgagcaaccgatgtttcggcaacctcggtatgcgcatatttgatctgttcatatttttttacttagtttatatgtgtagatgcaatgatgcattcatgctagtttacatatgcaatgtcatgatttatttatgaaataaattaaatcattatgtgcttattatttcaacaagatgaagataaagattaagcgtgaatgtgttaacggttaaaatgaggctcttattgatgtgtgtgactctgtggactgtggtggtgcgcccaggtgccttccacagaataaaaacaaaaaacaaaaacattaaccgaatacgtaggtgagcccaactaaagaaacaagatttctagtgcaatccagctgagggagtgggcaactttagccctgttaagagaatttaagattttgagaagtagtcaattagctggtaataagctagctagtgaaagtgtgaaaaagctgggtttttcttttctggtttctagtttattttctaaattctataattttggattctcagaatcggtataacaatctaaattgtttagagaagattttaatgatcaacgattttgaaataagctacagctaaacttctctaaataaagcctttgtttctgatgatccaagaaggccaatgttttatttatttttatcaagttttctaacgccgattaatcaggagtttcaagtttcactagcttatcatttgctatctaaaatccaatataaaaaataaactacgatgaaaaaaacttataatcaattgtaaagttaagttttagtagaatttaaatttttcaccaataagtctataagcaaacgatggatctgtaggttcacatgggacgacaaaagcgacttaattttctataaatgttccagttctgaacggccgacaatccctttcgtttttacttctgctgacaacccctggtttgccccctcaattccctttagtagtactaagcaagattaatacatctagtactaccattgtcactactactaacataaccctgtaacatattaatagatgtgctgctaggaaatatcacagtaacacatcatatgtgctacaagagtagtctgtaacacattggaataagaaagaaaatttttttccaggaatgcactagtaggatcacaaaatatatgttacaaaggatatgtcccaaaggcacattatatcaattatgaagatcgaaaggctaaaccattcgtgcatatgtcagagccaataaatatttactccagcatgttaaaccttgagatataataacaataagttttaaaacgtggtgcgcacttgacattcatgtaaaacaaaacaaaataaatgcatacatgtgaaaatacaaatttctaactaagaataacaaatagtttaagaaataacctatagttcccatgatagaatacaaaaatgtgctcatattgggaaaaaaaaagaatcttctgaaactatctgtagattaaaacttgtgccacatatctgcacagaacaaatacacaggctacaaataaagcttgtggcattctcctcattttgtttgctgcaaggatctcttcacaacttatataagcttgcatctggagagttgtacagcacaggcgttgacagtgaacctagttatgatcaatggattagtgaatcagaagcaagtttgggtagccccacgacaagcactattaaaaattcaggataccagaatcagtataatgtaaaaatagttaggatgcactatattcatcaatatatttatctatgaaagcaagaactaaaccttgttcactttcgctgttatatattaagcatggtcaattgatgcgtttgaggcatatcaccattttataagaatgtaatttacagcttggactaattcttcggtaggtcttgttttcagttttagcaaaatgcaaattgggacttaatgctagtgttatctatctatctaaactgctactcttaaggaaaataagaagctttcacaaaatagaaaatacatatgtatttctttgacagttgaggtacaaattggtagaaaccatcaaatgctttgtaggaagagcatttcaatcatgtaagaaaaataccgattaattgaagcatgtgggtagttgatagcaccaagggccaatttagtgccagtattacataaggcagtttcgagacatcttgtgctctgctgaaagcaccttggtccacatttgttatagtcatgagaaaaacatgcatctggtacaagcagttagaaccaaactatgcacaagtataacagttccccaactctccaaaggtctgcaagccaaattatgcttgatctccatggtcctgcaggccaaaaatattccagcttaccaacaaacataaacccaagaatcacccatgatcagggttctcaagcagaatatatttcaaagagcatgctcgcttgtatatgcaaaactagtgtttattttattagagcatattacaaattaatctaacatatggtaaatgcctttttggtcagtactagttcaataaaaaactgagattatatttatcactcactagaagtcgatgaccatgctccatacaaaaccgatttagtttacctagtatttttttaactaaatcttaacgtaccatgttgtcaatctagacatgtgaatatggtcaacagtacagagtgacttccatacaaaaagaatattgcagagtgaccatcggaaatgtagaacttccatctgtatgatatatgagccaacatagatcatgatcatactctatagtatataaaaaaagaaatggaagggaatgaccagttaaccaactgatactctagtgttgctgtggataagtaaaggaagcacagatattatctgatcatacaatttagagcagactttgtttttttagatgtaaaatgttatattttttagcaaacattttaactaatataagcctttgttaggcaagcaatgggcaatcaaatgctgaaacacagcatgaacgtatatatgaattcaaaagataaaaaaaaattacctacacacgttttaagggctgtagtagcacatagctgtgttacaagaacctagttctgctgtagtatgtctatgacagaaatgtatccatggtcttacgtggacgatgtagtgaaacatactgaggttacaaattaaccatccgactaagatatggatggttcaagttatctgctacaatctggaggtgactagggacccgatcgaaaacttcaaaaaatcgggcgcacgacgtcagcgcccaatttacgtgtaaaactactttaaactaatttttctcttaaattacttatccaaatcatgatcagattgcaattaaatcttcaaaacaagaccacacgtggatatattccgacgaaaaaaaatttagcttattattgtattatttttaaattgttgcacgatgttccaccaggtatatcggaattgtttcagtaagtaaatcgaaaatgtttcactcgtttaaatcggatgttgtttcaccttatataaaaacaatattttagcaaatagcgaaagaatgtttcagttcactgcaacattagatctatacatagtgaaacattgtaagtatactaggtgaaacatttttcggtggaacaaaaaataaaccgaattcccttaatagggggtttctaaaatatgtgggtttttttgttgcaatggaatgtttcgttcactgcaacattagatctatacatagtgaaacattgtgagtacactaggtgaaacatttttggtggaccaaaaaataaaccaaattcccttaatagattgtttccaaaatatatgggttttttgttgcaatagagttgtttgtgtgtggacacgtggtgggccagggggagtgcagacatgcacacgcgcggggggctgggggagtgcccgatttttcctcccccacccggtcgcccgaggataatcatatccctacaatcttgatgttacagttacaattttatttttttcacacggtagaattacgggcttgttcactttgctaccattttcaacctttccaagttttacattgttaaattttggtaaggttgtcaaattgtgacaagatttcatatgtacttattaaaatttagcaacaaactaagtgtagccacttttttagtaactttgccaaaaaaatgtaaggttaggnatagtagcnnagtgacaagccctgcattacatacctttgatacatttatatatgtgtgtgcatttaaacaatgtgccagactcattttcacgtagctacctctgcagtactaatgtactagatcgatactgaatccgtctatgatatgtgagataggacttactatcattactaatataggggtgtttagatttaagggtgtaaagttctggcgtatcacatcgggtattatatagggtatcacatgaggtgttcgggcactaataaaaaaactaattacagaatccgtaagtaaactgcgagacgaatttaagcctaattaatccgttattagtaaatatttactgtagcaccacattgtcaaatcatggaggcttaaaagattcgtctcgcaattagtcgcaatctgtataattagttatttttaaacctatatttaatacttgatgtaggtgttaaatgttcgatgtgatctggtgtaaagttttgggatgagatctaaccagggccataatataggtaatgatagtaaacaaaatataggtaacatcattactaggacatgccacagtttgaggtgacaaactaacataaatgaaaaatattgtatggcatcattacagtatcctctcccagatcaccagctggcgagctaacaaaaaccagtcaaaatattcatattttcctctatctttgttctcaatcatcttttgacgattcgatcgttcgttccgtcatgcggctttcttgtttgctgtcaacagccttctagtttggtcaagacaatcatcagaatcaaatatagttccaactatatatgttgattatatagatttatatactaaaatcaaatttgccacagatccccttgaactttttttctaaatgtatgaaaaaaaaaaggcgcacaatactgtagttcgaatcttgtcctgttacttaaaattgatcccatcttctaccaaaatttccaactagtgctatgcaattatacaagcgagtacttgtttaatcctttgcacacgatatggcaccaccgatcacctttaatttctattggtgttcttcatgccacatggtggctctccttttaatgaagtatataaaactagacaactttattatgatcagtacaaatttagttattgggttatcttacttttctactctctcgcttctaaaatatatcggtctaagctttgtttttactgtagtttcgaaactaatccccacgcatgaaaaatagagtggtagattaacacatgattaattaagtattagctaaaaaacttaaaaattggattaatgtgacttttaaagtgactttcctatagattcttttttttttttgcaaaatacgtatcatttagcagtttgggaaatatacgtgctgaaaacgagggagtgaaggttgggaaccttgataaataaatttggctctaatattgaattaaatataacctaatactacaagtctggacactatatacatgtgctatggctaggtcatcatagaatacacgcaccacttataaccacagcagaggagctaagtgagaggagatgaggagagaaggacaaggagaggaagaaaatgaacggagctttgtttgtttatgataatggaagataaaggatggattgagagttttgagaaaattttcatgagacgataaaaaatttaaatttgtaatataatatactagcacatcattagagacatgtctggaattctaaaaactcctctcccgcgtcgctccttacggggtgacacgggcggtgctccatcccaccggctgccatccttctcccttcccctccctcgctgccgccggagcaagcctccaggaaccacacggccgcaaggacagcaacgacggggcctcttcttcttcctcgagcaagtgacagtgggcagccgatgcatggcgagctgcgggggcaccacaccggggcagcttaatgtgagagccggtgtccaccacggtggtagtgggagttgcgacaagatgcgacgatgacggatggacagcggttggatctggagtttcctcacctagatctagcgctgcaacatgtatctaggacctgttatccctcccatggtgatgatggtggttggggtggtgaggagatggccatggactcgacccagcagtggccgcaggcgagcaagcacttggtcaaaggagggttttggtccaggcctcaggtcgggagaggtagcacggaccgactaacgatgcgggcaagcaaacatgaggtgatgctacgagttagttgctctgctagggaagaaaggtcggcggaggccggcttaacctaggaagcctgagcgggtggtagccaagaagttgtggtgaggtggccgttgggaagttggggtgggcgccacttcgaggaagcttcttgcattgggtctgagatggacttgagggtgtttgctcagtgcagatgtggtgcagttggtgtaggccgcccctagagacagttagatgggccggatgatggcgaggcactaacacaagcagcatcggtggtgttgtggttttgatgcagtgccgttggagctcatggcctacggtgttacttgtaggctaatcgatcgcttggtggctcgatcagttggacatggcggtcatcagtacggttggcggcatggatgacagcgagctagtcctcttttggccagctaggctgcctccctcttcttggtgctccttcccctctaatggctagtttgctttcaaacttcgatcgtgggaagcactgagggatgtaaggggactaccgttagactgagaggatttccatgtggtggaggacaggtggtctatgacactgatattgctttcacgaggcttgtggcagcgagggatcccgtgtgggttttctctcccatatgagagaggtggcgatgcaagcagttccgattgagcaaccatgcattaatgtgttgggggcgaaagcggagccgcttggccgatgtggcaagcttgacaacgataactctcaactattttcgttctggctgtgtggcaagggttttttaggtggagtggtgctgatggcttctgtagagcaattgagttgtcgtggaggcggagctactgcgccgggtggcaagctgagcaacgataacccgcaatacctttgttctggcaacactagaggtgttcgacaaatgtgagagctttgggtgaaagccatgcttggtatatgaccattgccggcaatgtcgacgtttgtggacgtcgtttcctccttggaggcatccctagtctagttctcgatgggtgttggcaacgtctttgacattgttttcttccttggaggctttgcttagaaggtcctacttaataattagtgtgctaggtggttttgagacagttatttgtcaaaggaagtcagagcttcttgtcttgtgatgagcttggtaacgataatttgtgtcgggtctcagtagtggtgttgccacaggctcttttttttcctgctttccatgtgtgtttttgccgactatttagtttcatatccggttttcttcataaactgggtcgattccttattcttcttaatataaactaggaacacaatgcccccgttctcaaaaaaaaaaatagagacatgtctaagtgaattgcctttcctagaaagtaaaagaaaactatctatctattatgtactaaaagttcattaaactccctataaaagctctcaagctgtcacgtagctccctcaaaacgctctcatattgccacatggcactctaataaaatagagaaatctaatcatcgattttcatttaaatcggtggaaccattattttacattgttagatctatcttcaaaaccaaaacctcccaccggccccacctccgtgcagtacgcacatactactccatctgtccattctctttttttttccctttgttcctttcttttctttttccaacacaattaaaattgaacttatctttatcgaaaagaatacccccacaaaagacatcaaacgcgtgtgtggcactcttaaattagagaaacatccaaacattggtttccactaaaatcgatgaacacaatattttacgtcgttattagatttgtattaattaaaagtccacgaaactttctacaaacactcgtaagtcgtcacgtggcatcctagaaatgttcctaagttgccacatgccactctaacaaataaccgttgattttcattatatttgatggacccattatttacaaccactagatttatcttaaagaaaaagttaacaacccaaacctaaccccacccagccctgtagatcgtacgtacgtacttatatctcatatacaaccacctattatatatgaaaataataataatatacctcttattattattattattattattattattattattattattattattattattattattattattattattattattattattattattagtactactactactattactattattactattattactattactattattattattattattattattattattattattataatatacctcagatacattagatttatctttagtaacaaacttaagatcaatctggcggtacgagtccacccacgcacgtacatgtttccatccatacgcatgataagagtctgtgtgattttttcctcgctcgccacccatttttttccaaggtaattaagttaatttcatcgcactttcaaagactgcatgcacttgcaaatatagacatagataatatacctcatacatattgatcttggtatgtttttataaataaataaagaatcttcaatagctgtaaattttaaattatatattcaatttatgatctgtttgaaccattgtattttttaattaaatcaatagtttaatatctataccaactatatttaattgcttataaaattattatattttggacccacatccataccaaaaaaaaatcctaaaagttatcattaaaaatcaaaatatccaccttatttttttaataaaatcaaaataacctataaaccattaaccttaactttaattatagcatcaatggacctattgactcataaccaacttaattatatctctcaacgtttatgtggatgctatttacttaatcccaatgccttgataaaagatatgatctttttttaaggataaatgaacgatcttatgctgtgttcggcgctgaaggttgggaaaccttaatcccttggaagttggacattaacttatagcccaaaatacctatatcacgttgctcaaatccaactaatacaccaagaaaagaagaaggagagatggtgtctacagagctgtccttatggatattttactaataaaaattgattttagatacttattatccttattaaattatctaatcactagaacaaaggaacataatgtccatggagtgaacaaattggagggctggctggtgcatcccggtgtgcatgcatgggtatataatattttttctcagatgaaaaaaggggcatgagatagttacatgtattatgcatatacatgcagggcacttttttttcttctaagtatggtgatgcgagcatgttgccggaggcacgaattaacatgtccaccgtccgtggtgaggaaagacgaataatttggttagtttgactctgcacaatatgttagatcatctacatatccaatggttagaaataatggtctaaaattgagggtcatatattttgtttaataaattaattatcaatttttcaatataaatcagtagagccattaattatatattgttgtgtatgtaatgtcttttataacttaagttttctctcttttcctatgaaactcataatttcctatgaagaattatccatagctatgaccaatcgatgtttgccatcaaataataaattaattatcattttttataaaaaatgggtagagccattaattatatatggttgtatatgtaatgtcttttataacttatgttttctctctttccctatggaacctcaagagtcatatgtcttaggtaccattttttataccgtaagttatcaaccctaatctctaataggtaattttataattcgtcatgcaattctaatgaagaaaattcatgaaaaaaaacacaattttgaaacgttgcagatattatttcgctgctataccacctttataggtttttcaaatctaccttcctagtttgtataaaaggccatctctagaagcactcatttagggacaattttagatgggcactgacgcactgaagtagagacaagcatcataactaacctactctgttattcttatattcttgttcttattcttatgatatattggtaactttaaactctctctatcctataggacatgattctctacagcaatggatcataatttggtactgtgaacttgaaattatttagtatcacattttaacctcaaaacaatgcaatatattatgctgagtttcaggatatattatgatggtgaaaatccattttggccaagtgcatttctcaaacatacagatagatctctttgatgatcaaaacgaaccaaactcgatatgcaactattttgtatgaaatcgttgaaagagcatgtcactggaaacgactacagttgtggaattgtggtcaccaagttgatgcatgtttatttgggagggtgttttgagtagctacaactaccctaaaataacaatctgaatcctctctttagattgtgaaacccgatagttctaggatccagtaatgagctaatagctagaggctagggaacctagagcttcaacatattaccactagttggatgcttgtttatagcggcttcttgtaatctccagctccctaacatagcctagcaaagtcaatgataaacgtaaaaaggccatgattgtttgagaaatgaaaagtcaaagtgtttgtccagatgaaaaaaaatcctggccgccagaatttttcgagtaatattaaggctgagttctttccccaactttcccaactcacatccctcgtgctccacgcacacactttttaaactgataaagggtatttttttgcaaaaaaaaaatctaaaaagttgctttaaaaaataatattaatccccttttcaagttttttacctaatacttaattaatcatgcattaaacagatgctttgttttatgtgttcccaacccatgctaacgaacgcagcctatgaggagaacataatgtatgcagcatgtccaaacatgataacaatgtaaacaatagaaaggtagggaaaacatgtgaaatgcctttaatgcgtcatattttatatgaaatttgcatcagtttacaatacttcagtttctaaaagaaaatgaaaatccaataggtggaatgcatatttcttttctttgttacaaagacaacataactaaaagcaacataaatgaaagaaaaaaagactatttaaaacacaaggaacagatgacaaccattttataaaaaaaacatttagacttttgcaaaactagtat

SEQ ID NO: 41781 - DNA, 1571 bp, Oryza sativa
aagaacagcgcaaacatgtagacttcgaaaggtacaccatggaacaacaatactctctaaaatattaatataccttcttcgagcaatagaggaatactacgaaaatgctctctatcggtcgaccggggagaggtgggaaaatcagtcgctccccctccccccacgcgcgcaccatgctggacccacctacttgtccctccccttgttccataaaagatgtttcacctagtgtacttataatgtttcactatgtatagatcaaatgttgcagtgaactgaaacattctttcgctatttgctgaaatattgtttttatataaggtgaaacaacacccgattaaacaagtgaaacatttttaatctacttagtgaaacaattccgatatacctggtggaacatcgtgcaacattttaaaaaaattcaatagtaagctaaaaaaattttcgtcggaatatattcatgtgtggtcttgttttaaagatttagttgcaacgaattttaatggtgcaatcggattatgatttggataagtaatttaagagaaaaatcagtttaaaatagttttgcatgtaaatcgggcgctgatgtcgtgctgccatcagcgctcgatttttctctaaaccgatcgggcgtccgacccatggactcatccggaatactttgatataataacgtgattttgagggattttcgtaggtattgaactaactcttacaaaattcctgatttctttccctataaaatgagccaaattctccaaatgcgataagtatttttttaattggaatcctatatgcgttacttccctccaaggagcacaaactccaccagcagccagcctgaccagattttctccagctaggagtagaaaagaatgaaagatacagctacaatagactagtactactaccaccagtatacatcccccattctcgttggtagtaaaacacatgtggtcattaaaagaagctagggagaaacagcaggtgaggtgagccataagaaaaaaaaaactaataaaaaaagatggcgtcgtgtgacacccaaaatccacacacacaaaaccctttcacacaaataaaaataaaataaaacaaaataatagaaaaaaagaataaactatagatagataagtatagaggaggagtaaataaatacttttctccactacctcccttccctttggcctttcgggacctcaacagagacgcacctcggtctctctcctcctccacccaaagctcccacctttcccttcctcctccctcctgcgctcgcctcctcgcccaattccgtccccaattcggcgctctcccgcggcgcgatccgtcgaatctgcccggattcggtgtcgattccacgcggccgccgggggagcccccctcccgccgatttgtttcggagcttttcttcttcttcggattcttccttccccaatcctttggttcttgttctttggtctctccttcgaaattcgatccctcgccggcagcttatccggcgcggcgcggcgcggcggcgatccatctcccgcggtttcgatttgggtttatttgggcggtggggagaa

SEQ ID NO: 41782 - DNA, 7987 bp, Oryza sativa
aatgacagaaccaccgcctccgcaatcgacaccaccaacaccaccggcagcagcagcagcggcatcggcagcagcagctcctcaattctcagccaagaactgcgaaggtattctcatagaggtttccaagaagaggaaactagccgaagccaccgccaccgatgctaatgccgtggtcgtggcggcggtagccgagccattatctccggtgctgtttgttaaccggtgcaacgtgtgccgcaagagggtcggtttgaccggattccggtgccgctgcggggagctcttctgtcctcgccaccggcattccgagacccatgagtgctccttcgattataaaaccgcgggcagggaggagattgcccgcgcgaatcctgtgatcagggctgccaagatcattaagatctgaggtataaacacttctgtggtggagtcatattaagatctgaggtataaacccatgatcatacatcattatttgtaattttttgttatgattccctgcttgcttagttcctataagatgtaaaatgccatacactcaaggtagcattttgtttggcagataagaattgtcattttaacagttatacatcgtgatgtgatgcttgtttccaatgtatagtatttctaaatgatatatttctttaagttgcaaattgatttacttatttgcattccaaactgtgagattatttgactcagctggattaacttctgagattattttcttgttgctggttcctgtctcatcatttgcacaatgctgcatttcatttttcctagttcctaggttgttcttggcatttgcacatccttgtttcatgtatatatattttttccatttctccatagtttctgtagatgttatacattaattgacctcaactatttccattcattgaaaccttgtaggttgtatgatctatgaactatatggaagactaatcctggagatgctgcaagtgaatcatgctgtaactacatgagctattcaagagcatgatatctgcatgtttgtgaagtaattcccatacagccgaggccatagtaggatagcagtctacatcaagcgaaaaatctatgggtcggctgatgtgggagaaagcttcactcttgttcatcgtccgccttcgatgcacaccatagctccttctcaagctaccacgcacacggatgatagcaagtgtactgtccagtcataattttattggatccaacaatttattgtagtatattgtaatctttcttttttaagtcttgttcggtttcgttcaacacaattgtgtgttactgaaaacatgtgtgatgtttggaatttcagttcaaggtggagataatcacctcctaccctgttgctattgcgatctgtctggctgaccgataattagtctgtcatgccacaaattacatgatgttcctatcaacgattgagaaacctctagtttgctcatgctgcaatttataaatgccaaccttatggtcatttttttaaaaaaagaaaatttataggaaatgaacacttcacctatgtaaggttcatatgtgtggcaatttggttatgcagccctctaaagttatggccgttaaagaaacagtttgctcttctatgctttcagtcttcaagtatgaagaaataaaatgagaaaaatcataataatatgcttgtttatcacctgatacatcaaatcttcggtacccagttacatggcagagaatttccccaatacaacattttgcactcaaatactctgactaactggagcttcctttagaagcatcaaagaaaagataaaagaatacatcgcaaaattacattacagcaaattgcatgaatatgctgacctaccacacatgtttattccaatactatgattctataatcctatttcctagtcattcccgagataattctcagctcagctcctcgttgctgagggcatgatatgggccatttcctaaaagacaaacataattatccgcgttaacaaaatctctccttgttggatttttttctgtttcctctatattctgtagtccatagttactttcatgtttgagcatgtggctcgttaggtctaatagtgggagaagtttttttggaattgtgacgggttcaaggacccgaaaaaaacataagtttgtttctgatttaaccaaagaacatcaacttgattttattgttttatctgagacggttaagaaggaattttctacatctgctctgaataatctttgtgttagtaaagattttttgtggcactgtaaatctcctagaggcagatctggtggtcttcttttaggaattaatcttctaaattttgacattggtttgattgatgagggggatttttatatcaaatttcatttacgaaataaggctgataattttaaatgggctttagttttggtgtatgggcctgcacagaatgagcttaaagatcaattccttgaagaattagttaacatgtgcagtcatgagactataccaattcttattggtggtgattttaatattcttcgtagtcctaatgataagagtaataacaattatgatgatagatggccctttttgtttaatgctgttattgatgggttgtgccttagggagatacagttgtctggtaggaactttacttgggcaaataatctagcaaacccaacctatgagaaattggatagagtgttagtatcaacggaatgggagcaaaagtatcctttatcttctgttgttgctctaaacagagatttatcagatcacgttcctttgcttctaaatacaaaatcttcctcttttagtgacgctcaacattgttttcagtttgaacttggttggctgttacgtgatggttttgtggatatggtaaaggaggtttggtctgggttgatgaaggcaatactcctatggagcgttggcaggcaaaaattcgccgcttaagacaacatcttaggggctgggctaaacacactagtggtttatgcaaaaaagagaaaaagcagatcttaaataagttggatgcgctagataaaaaggctgagactgttgttttgtctcaagaggaggttgatcttagatggtttttaaggaataggttatctgcgatcttaagggaagaagaaattaaatggtatcagcgggctaagactaaggatattatggacggtgactctaatacaaagtattttcatttaatggcaaatggaaaacacaggaaaactagaatttatcaattacaggatggtgatcaattaataagaggtgatgccaatttaaagtcgcatattaccacttattataaaggtctttttggccctcctaatgaatctgatcttcagtttgatgataattatattgctggcattcctcaagtttcacatttggagaatgaagctttaactaaggaattttctgaaaatgagattaaggaggctattttccaaatggaacataacaaaactccaggtccagatggatttcctgctgagttttaccaagtgttctggaatgtaattaaatttgactttttacaactttttaaggattttcattctgggagtttgcctttatattcacttaactttggtactattattcttttgcctaagtgtgctgaggccatgaagattcaacagtatagacctatatgcctacttaatgtcagctttaagatttttaccaaagttgctacaaatagattaatggattttgctcaaaaggtaattagtcctactcaaacagcgttcattcctgggaggaatattatggaaggagtggttattttacatgagactttgcatgaattacatcgcaaagataaaagtggtgtaatttttaagatcgattttgagaaagcttatgacaaagttaaatggtcttttctacaacaaactttgagaatgaaaggcttttctcctagatggtgtgagtggatagcatcttttgttcaaggtgggcatgttggtataaaagttaatgatcaaattggtaattgttttcaaactttcaaaggtcttaggaaaggggaccctttatctcctattctttttaatatagtagctgacatgctcactttattgattaagagggctaaagaggctggtcttttgaatggggtaattccgcatcttgttgatgatggtttgtccattttgcaatacgcagacgatacaatcatctttttggagcacgacttacaacaggcaaagaatttgaaactgattttatcggtctttgaaaagctatctggcctaaaaataaattttcacaagagtgaattattttgttttggtcaggctaaggagtgttatgagcaatattcggacatttttggttgtaagttaggtgctttcccttttaaataccttggaattccgatgcattttagaaagctttctaataaagattggaaacttattgaagagagaatagagaaaaagcttagtagttggaaaggcaagcatttatcggttgggggtagattggtgttgattaattcagttctttcaagtttagccatgtttatgatatcttttttgaggtgccgaaaggggttcttcataaaattgatttttatagatcgcgattcttttggcaaggagatgatcataagaaaaaatacaggctcactaggtgggatgttgtctgtcaacccaaggaccaggggggtcttgggattcataatctggaggtacaaaataaatgtcttttaagtaaatggttgtttaagttaattaatgaggaagggatttggcatgacttattgaagaggaaatatctttataataagtctataacccaagttgacaagaaacaaggtgattcccatttttggtctggtcttatgaatgtcaaaagtaccttcttaaatatgggttcttggattgtcaataatggggaacaaattagattttgggaggacaagtggctaggtaactgggcttttaaggacaagtatccatctttgtacgcaattgttcgtaggaaaacatcttctattgctactgtaatgggttctgttccacttaatgtttctttcagaagagctttagttggtcagaatcttgattgttggcatgagttatgttcctctatagtacatattcaattgaatgattcgtctgatacttttagatggaatttccatcagaatgggttgttctcggtgaggtctatgtacctagctttaattaataatggttatattgacaggaataagtgcatttggaagcttaagatgccacttaagattaaaatttttatgtggtacttgcttaaaggggttgtgttaactaaggataacttggcaaggcgtaattggaatggtagcttgaggtgttcgttttgtttgaagaatgagtctattcaacatctctttttcgattgtcatttggcgaagtttctgtggagagcagttcagttttcttttggatttaatcttccagttagcgtatctcatatttttgatgggtggcttttgggagttgataagaaaatgagtaaactgatacttgttggagcttctgccatttattgggcaatatggctgagtaggaacaatatagtttttgacaaatcaccatcattttcctatatgcaggtcattttcagagcaacccattggcttcggttttgggcacaactataaaggtgtgaagatgatgaagagtttctgaaagttgcatgtcggaagctggagactacggttatgcaactttttgccaattatgggtggagatttacaaatagacttgaataattgtaatctcctttgttagactggattctttattgttgcttgcggtgtgttctattcaattagatctacactatgttcgtcaaacgcttctatgtaataattggctgtagctcttttaagtaaaggccgggatatttatttattccattatctaaaaaaagatgatgctgcaccctggcattttggatgaacagcagcctcctcctcatcaggtagctttccctcaacatcagtggcctcagcaacttgcccacttctgccatcgtcgctgttcgaatcgctgcatcgacatgtcagcattagtgaacagaaagaacagctgtgatggtctaatttagaagatggatttttttagatagtggaatttattcctgcctttatttttcagtcgctcattataaagtttgcaggacgaataaccgctaattacaaaattacagcttgattaaaaacatgtaattaatgttccaatgattaacgtcaaacttcagaatggtgtcttgcaactaataaagctagagtattgagttttttcatggagaaggataacagaaagtaaaacaggtgagtaccctgagtaaataaccagcccaattgcaactacaccgaatgccacatagtacatccagtcgacctggaaagcgaaagtgcattcaattgctggttacatgtaagacaataaactgcagtatgctttatgcagaattgcagattgagggcccgatgatcagaccttttcatggtaggcaaacacacggatgagaatagcccacatgtctgaggctagcaatgaaaggtttagcattgttgaaccactgatctgcacaagttaatatagatatgagaaacttaaagagcaaaaaccatgtgcttaatgtggcagtgccatttcgtagtacaacaatatcccttttgtcggttttcttttttttttccatttttaaggagatggacaaggaacagtaggtaaacttgggatgtaagaactgagaaatcatgactaaggaaattagtagatacacacttgcacaaaggaaacattgtttgctaatataccttcagtaaaattggaactagagagtaaaacatgaacattgcgactgcaaacccaataaatggtaccacctgacaagtggtaagaaagtaatattagatgtgtttggtgtaaaaaaaacggataccaatgtcacaatgaggggatttttagaaggaaaataaaagaggaggacagaggaggacttacagcaccaacactccattgtatagattttttctcgttgtgttcaaatatgcttctgaataagcaaataaagaaaaaaaacagcttatgaactgtttgaatgaataagaacatgttgcaggaggtaaaaaggccacaatacgattttaacaaaatagcaaaaaactcttatgtaaacaagagaagtctactaaactgcctaaagcactttggtccgtctgttaatccccttaagtactggtattcaccctgaaaggtatgaaagttgtttgaaataaccacttggaatggttttgtagtgattttgctgtgtacaagatgacacggcaagcacaatagggcaaaattacccaacccaacccaacccaaccactccttttctctctccaatcagcaggcccaagaatcactttataagcactaatgtgcttcttttccaaccgtcccaataattaaaatgttatttaaccgaatacatcggcatgtcacagtgtccatgtaagccaaccatttataaaaccactatttgcacttatttgaactggttttcatattttagagggtagaatacctagtttcatacttgaggggttgcaggacaaccataacattttagggggttaactttgattttttccttaaacattctagagtaaatttcacattgggctaggttttttttacccaagttttacattggaccaggtcccactcaagtttttcacttaacaccacatgtttttacatttgattgcactttggactaggattggcgatttggggtgctttgctggctttggcccattcatgcaagcaagcaatactttgattctcttctccaacaccggaggtcttgcccagtcggagttgccgcaagcaaaaatggagtttctgcaagattcagggtcctgccgtcgggtgcaaagcttgggaggtgttcttcgtgcatcatgaccaagagcgagtgcgtgcagggagaaaagaacagctc

SEQ ID NO: 41783 - DNA, 2543 bp, Oryza sativa
cctctatcgtcaccgccccttctcctcctcgccggagaagctcgcctcggatccctcctcctcctcgtcatcgttgtcggtgctcggcccccgcacaccgccgctcgccgccagccgcgccggccaccgctcgccgccgccgcctccgcgccgaggccactgccctcagccgctgcccccgcccttcccgaccatgagagagagaggaagagtgagaagagtgaggagagtgagagagagaagagagagaagagcgtatgacatgtaggccccacaattttttatatatatagaatgctgactggactgccacatgtacgtcacgtagaccaaaaccaccgcagattgggtcgaggggagtaattcgtccggtttgtatagttcgggatgaaaaatgtccggttttgtggttcagggggtaattcatacgaccgcgatagttcgaggggtaattcgtactttttactaagtgaaaactttaagttagatatggtccaatgtgaaacttaggtaagaaaaagtagtccaatgtggaatttactcaaaattctattataataagagaaacaaaaatggttaaacacggttaaaacaaaggagcattttacatctgacaagcattctagatggatttttttagatagtggaatttattcctgacaatgtggtgcctttatttgttcctcgtagcggtcggacaagccatcggaggaagccgaagaggaccgggacgggaacgggaaccgccggctgtggctgcagcgacgttgttgttgtccccctggtcggacgccgcggcggcggcggcggcggggagaagccgcagcggcggcattgcttggtggccgcggagtggtccccgtcgcccctcggcatgttgacgccggcgctagccatcaccatcaccaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggttccccgcttgttgatctgcctcatcttcttcctatttgatcgaaagccaatttgcttatctgtgaatttatttcgctagccttttctgatgccatctttggctcttggatttgaaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatttctcgcggcggtttcttaatctgatcgtgggcaaccgcacccctggtgtcaaatcgctatggtgcttcgacctgatgcgccagcagctgttctatccggcaacacctccaccgccacacaaggttgaggaattctggcaaaagtttagaccgccgggcacaatgatggacagcatggggcttcccttctcctgcttcaccttccgagcttcagctctcaacgtcaacggccaatcgaggatggactgtttcccgcttgctggcggcgaggtgatttgcatggatcagtctggccgcgcgttcctcgtcgacgctgatgcgtgccaggtaggaaccatgcccagtcttcacaagcccaagtcgatgcccttggccgtcttcgtccccaatgccaaggctgacaatgactatgaccatgatggctatggcagcagcctctttgtcatggagaggattcccaaaccggagttgggcttcaacagcgatcagtttgaggccttcatataccgcaagcctacaatatccaactacacaaaggcctggcactgccatcaactcccacccccgccttttgtccgtgaacccaagcactggcacagctgcagcaacccagagatcagctcctacgctgtgcttggcggtggctcacacatttgcttatctgtcaatggcatcggcacctactgcctggagacagcaagccacacatggagccaagttggcaagtggacactgccgttccatggcaggattgattatgtgcctgagttcaacctctggtttggcctctctgctgaggcccgtcgcttggctgcggctgacctctctgccatggactcctagccacagctagtgggcccttggaaggaactcaacctgccagaggaatggagggaatgcaaggatcctcaacttgttaaccttggctcaggcaggttctgcatcgctaggttcttccgcagcaacagtgactttggggatgaacaaattaccgtgtttacaggtgtggaggtagtgccacacgtcggcgatgcca

SEQ ID NO: 41784 - DNA, 2726 bp, Oryza sativa
cagataattaatctgtcatgccacaaattacatgatgttcctgtcaacgattgagaaacccctaagttgctgatatgctgcaatttataaatgccaaccttatggtcaatttttttaaaaaagaaaatttataggaaatgaacacttcccctatgtaaggttcgtatgtgtggcaatttggttatgcagccctctaaagttatggctgttaaagaaacagtttgctcatctatgctttcagtcttcaagtatgaaaaaataaaatgagaaaaatcataataatatgcttgtttatcacctgatacatcaaatcttcggtacccagttacatggcagagaatttccccaatacaacattttgcactcaaatactttctggctaactggaacttcctttagaagcaccaaagagaagacaagaatacattgcaaaattacattacagcaaattgcatgaatatgctgacctaccacacatgtttattccaatactatgattctataatcctaatttctagtcattcccgagataactctcagctcagctcctcgttgctgagggcatgataggggccatttccttcaacacaaacataattatccgcgttaacaaaatctctccttgttcgattttcttttttgtttccactatgttctgtagtccatagttactttcatgtttgagcatgtggctcgttaggtctaatagtgggaggagttttaccatcatcgaattttcggatgccagatgatgctgcaccctggcattttggatgaacagcagcctcctcctcatcaggtagctttccctcaacatcagtggcctcagcaacttgcccccttctgccatcgtcgctgttggaatcgctgcatcaacatgtcagcattagtgaacagaaagaacagctgtgatagtgtaatttggaagatggatttttttacatagtggaatttattcctgccttatttttcagtcgctcattataaagtttgcaggacgaataaccgctaattacaaaattacagcttgattaaaaacatataattaatgttccaatgattaacgtcaaacttcagaatgccttgtgtcttgcaactaataaagctagagtattgagttttttcatggagaaggacaacagaaagtaaaacaggtgagtaccctgagtaaataaccagcccaattgcaactgcaccgaatgccacatagtacatccagtcgacctggaaagcgaaagcgcattcaattgctggttacatgtaagacaataaactgcagtatgcttgatgcagaattgcagattgagggcccgatgatcagaccttttcatggtaggcaaacaaacggatgagaatagcccacatgtctgaggttagcaatgaaaggtttagcattgttgaaccactgatctgcacaagttaatatagatatgagaaacttaaagagcaaaaaccatgtgcttaatgtggcagtgccatttcgtagtacaacaatatcccttttgtcgggttttccttttttccatttttaaggagatgggcaaggaacagtaagtgaacttgggatgtaagaactgagaagtcatgaataaggaaattagtaggtacacacttgcacaaaggaaacattgtttgctgatataccttcagtaaaattggaactagagagtaaaacatgaacattgcgactgcaaacccaataaacggtaccacctgagaagtggcaagaaagtaatattaggtgtgtttggtgtcacaaaaacagataaagccaatgtcacaatgaggggatttttagaaggaaaataaaagagggaggacttacagcaccaacactccattgtatagattttatctcattgcgttcaaatatgcttctgcataagcaaataaagaaaaaaaaagctcacaaactttttgaatgaataaaaacacgttgcgggaggtaaaaaggctacagtacaattttaacaaactagcaacaaactcttctggaaacaagagaattctaaagaactgcctaaagcacattggttcgcctacttaatccccttaagtatgggtattcacccctcaaaggttttaaaactggttgaaataaccacttggaatggttttgtagtgattttactgtgtacaagatgacgtggcaggcacaatagggcatattactcaagccaacccaaccgctctttttctctctccaatcagcaggcccaagaatcacttataagcactaatgtgcttcttttccaaacgtcccaagaattaaaaaatatttagctgaatacatcaccatgtcacagtgtccacgtaagccaaccacttataaaaccactaccggcagttatttgaactggttttcatatttttgagggtagaatacttagtttcatacttgaggggttaagcaggacaaccacaacattttagggggttaactttgatatttgcttaaaaattctatgataataagcttatgaaacaaaaaatgtttaaacatggttaaaacaaaggatcattttacatctgacaagcactgatgatagctccaaatagtcccagcatccccatcaactcaactcgatcaccgactttcacaaggaactcctgaaatgcaaaagataaatatattgagggatttggtctcttagtgaagctagttttacaccttacaccacaaagcttgcacctattaagcccgaaggatgagaaacatatggaaa

SEQ ID NO: 41785 - DNA, 2211 bp, Oryza sativa
ttaagcccgaaggatgagaaacatatggaaacaggtgatacgtgagagtcattttcaccatttctttggattagtcttttttgacaataaagaagtgaaatatgaatagcttttggcacagactattaacaaagtttttttaatatgtattaaaaataatatctcaaaataatgtgtttcctgtgcagttgagatcaatgctttacctcactaacgttactgatggcataaagagtagcaccagcaattacaagtatatcacctttaactgggcttgtaccccctgcatagaacaacatgaccatgaacatttcagttgtacttcatttaggatttaactggtcataaagatgacttccaaaattccacgcaaaacttaaattattctccacatattcgtcaagcatgactggagtactgtatttttttaaaaaaaaatccattaatctagcaacatattaaactgtggaatagtctttactccttacttcagaaaacagactagttatttttgctaatgtgaactcaaggttcattttgttaccataattataaatggtctgcaatacaaaaggttttattgcacttttttgtggtaagtgaagaagaaatgaaacaacaaagacatatataaatactaatcaccgaactattacctgccctatcacctgcatggacatcagaaaatacaactagcacaagtcctgagacacaaatcgccacaccactatattttctgaatctgtagttggtcttcaaaaacatccatgtaaggaatatcacagcaggaatagcccagcaatcaagaagcataacgcttgtcagagatgtgtactggtaagccttgacaactagaaaagaatagagggagttagtataacattgtaacaccatctgtctattcagtagacaggaaggactgtcttgttatttcagcatagatgaccaggaacttttggtcaacacgctgctgaattatccaacaaataaccaacaaagtattgcacatacctagataatttgcctctacatcgaccaaggctagtactaagtagtagtaccatttcatctgcaagagttagttcatgcataaatcagttccacagtagaatacaaattgaaatactacagcatcagtaggaaattatataaagttatggatattacgttccacaaaatatatgtaattgcttatttaaaattttgagaacagtttatgtacaaatagatgtatttttcaaaaggaagcaaactgttgttacaagtgaatagagcagtaacactaaggcactaggcacgtgtgcttttgaagttataaacgctaatttaactaaataacaataaccccctccgttttaaaatgtttttaaatgcatgatgctgttggcttttgaacattacgtttaaccaattttcttattcaaaactttagtaccttatcttatcttatccttcttatatagtgaaagcagcaagctttcttgcacgaggatgtgccacatcatcagaaatattttagccgtcggataaagagttcggataaataatggtcattggattgaaagagtgcatgtattaaaaaaaatcacaaatgggctaaacatatggaaatttacggaggtttttggtatctattgccctagctaagtatagatactttgtaaacaaattaacttatatcaaaaccttattaagagctaaggtaaattaatagaccatatataaaagttcttaaacaggatcaaaagtcgcgctttggctagtaaatatgaaaaaaaatataagtagtatcttcaatgacaaaacaagtcacaacaaaataaataatatttacatagtttattttttccaataagacgagtgatcaaacataaaatccaaaatccaacagcatcatatattttaaaacagaggtactgctgaaccaaaataagtagtatctaaaatgacaaaacaagtcacaacaaaataaatgatatttacatagtttattttttccaataagacgaatggtcaaacatcatatccaaatgccaacagcatcatatattttaaaacagaggtactgctgaaccaaatgaacttgaattcttgatgcccaaacatagatatgcctctggttcactatatacggcactcacgatgggtagctttttggtaaggccattgaccaagtttcactcaaacattttgccaacccaacatttcttt

SEQ ID NO: 41786 - DNA, 5887 bp, Oryza sativa
aggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaagcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgcattcctccataaaaccaatatatgattcatatattgatcataattcctcgttactagtaattcgctagtacagttgaatgcaaaatatattgctgtccactgctataaggaagtaagctaagtattgaaaggaatacgaattaaaagtaaagagagaaaaacgataggaaattcaaacatagatccggcgagttttctctgaggtataagagattcggcaatctccactaatactcgttggagcactctacacaaagagtacactgtctctgatagtcacgaagtccattggcgctctcatcatggtggttcttctccgctctgaaaggtgaaccccgaaacctccacaaccacaccggctctcccacaatcttcttgacagatcaccgggttgccttcgagactggctaggcatgccaagatgccaatagttaacaggaagagagccactcctcctgttaagaacaggattcttgttggtgcacactaagccactcttttttgacgtgaaacagtaggaaaatataatttacagggagggtggcaagcaccagaaaaaagcatactctcaactcaaactagcactaaattagtgaagaaaattatcacaattagctcaatgatgctcttagactctcccatcaattgctcagctcaatagggttccaaaggacaccggggagtcaagccaagggatgtataaagccccaatcaagctccctagcggtttgcagccatcgtaaagaagcagccaaaactgcaaatcgtcaaacagtatggcaccgacccgaactattctgcccttcatacttttctgattgtaactgggcaagtagttgttgggccataaagcataggacaatccaacatctcctagattgcccaggacccctttgtccacacggtgtcggacaatccgcaatgttcaaaaaccaatgaccagtaacaatcgaatgaacatgccagattaaccgacgtcgtgtcgaactgtccgctagttgccaaattaactaggcatcagacaattcgagagctgccggacagtctagccagttcatttccactatctagtcaacatggtcagacaatgaactggctgaggatgtttcttttgttgcgtacatatgattgtaaggatgttcagtgcagggttgtccctagtaatttggggcctcgtgcctaatataaaataaggccttacctttagaaaatactattatataatagattagaattatatattatttataatacattaggtgggtatgccctctcacagctcatgagtcatgaggagaaagagcggatgatgggtcccaatcatatgattctcacaactagcataccccctcatctactctaaacgaacctttggctgcctattgcattcttaaagtaagaaacaacaataacaaacccttccctgaatcgagtggacctagtagccagagtcttagatggtacaaagaagcccatgatgaggaggaggtagtccaatccctgtattgaaacctatgttattagtttttttttaaaaaaaaggaagaaacatatgctattaactattagatgtactcacctattttacctttgtattaatatatttgccgtatagttgacgcatttcaatgtaaaccagcgattcaaatattgatttttttgaaagatccaaatatacaaacgttactaccaatctgtcgttgaagataagtcaaaaacaaattcccatccacctatttaagaaggtggacaagtggatggttggtaggcccaccaacgtgccccctcacacctcctgagtcacaaggataaagagcgaacgatggagcctactcatacacttctcacaccttgcacacacaacacaacccatctgttttagccggacctttggccgctgcactattaaaatgtagaagtagtgcaacccctattaaaacccatgttattaaatactatgtctattcaaccacattaatgttgtatttatatttttctctatagtcgttgtattctaaagtaaacgagtgattcataaattgaatataatttttcaatagatccaaatataaagtctaacaataatttgtcactacatatgaatccaaaacaaaattttcatccacccatttaaggtggaaaagcggatggctggttgccccaccaacatggccttcacacctcatgagtcaatgaggaagagtggatggtggatcccagtcatatgactccgacaactaacatacccactcatgtagtttagataaacctttggctgcctagcaatatcaaaataaagaaacaatgttaacaaatacattccctgaatagagtggacctagtagccaaatacttattaggtggtataaggaagtccatggtaagaaagaggtagaccaattcctctagtcaaacctatgttattcactattaggtatattcatgtatcttatctttgtgttaatttttttataattgatgaaagtaaaccaacgattcactaacagattttttttgaaagatccaaatatataaaggatactagtaatttgttgctaaagattagtccaaaattaatcacctatttaagaagttgaaaaagtggacggttggtaggcccaccgacacacccctcgaacctcatgaattatggttgtgtttagttcacaccaaaattggaagtttgattgaaattgggacgatgtgacagaaaaattggaagtttatgtgtgtaggaaagttttgatgtgatggaaaagttggaagtttgaagaaaaattttgcaactaaatacggcctatgattaggaagagtgaacggtggggcccactcatatgcttctcataccctgcacacccgcccatatgttttagccggactttttggctgttctgctattaaaagaaagagtaaatcttccacgacgtgtcataagcaggatggcatgtactaatcatatgcctattataactagcatacacacttatctagtctagaaaaacctttggctgcctattacattctaaattaagaaataagtaacaatagtaaacaacttcccttgaagacctagcgtattaataaggaggtagtccaacccctctcgttgaaacctatgttatttaacaattagatatactcacctactttacctttgtattaatatctttactgtataattgatgcaatcatcacatattgtatatatatatttttcaaaaggtcccaatatataaagacaacaatccgtcactaaagataagtcccaaaagaaatttctatctacctaactaaaaggggtaattgcacattgactctcttttgaaagctaactatcaatttgaccctcttttatcaactttaattatttaacccttttcttaaaaattgaagatatggtatgaccctattctattaagggcatctaacgatgttaactgaagcacaaaatgtcccttctgcccttactcatttgaccctattacatgtgggacccacgcgtcagttctctcttgtcctctcctccacagctccacacgcagggagaaggccgcgagcagcgagagggcgagccagcgccgaccagcagctgtggagcaccgcctccactcctcgtcaccgccgagccgtcgttgcccctcccttgccggatccagccatcacagctccatcgctgggttcgccaccttcctttcttagtgcatgccggtggcgcctcctcttccctccgcgcgctgaccgccgctgctacctccctccttccgtgcgcctgccgctgccgccgcggcctcctccctccttcagcacgcctatcaccgccaccgccaggcccggctcccctccctcccttcgccgcgcgccggcctctgcctccctcctcgctgcacgcgccgccgcctcacccgacggtgcgcgcagctccactgcatgctgccgccaccaccgcaggggaactgtcgccgccgtcgcaaaagctcggcgcagccgctcccttcctccg

SEQ ID NO: 41787 - DNA, 3197 bp, Oryza sativa
agtccaacccctctcgttgaaacctatgttatttaacaattagatatactcatctactttatctttgtattaatatctttgctgtataattgatgcaatatcttcacatattatatatatatattttttcaaatggtcccgatatataaaaacaataattcttcactaaagataagtcaaaaataaatttctatctacctactttaaataagtagatagttggtaggcccactgacgcacaccccctcacacctcatgagtcatgacgaggaagagcaaacggtgggacccactcatatacctctcgcaccccgcacacccacccatccgctttagctggacctttggccgctctaccgtcaaaccaagcaagctgtcaaaggaaatagtaggaaataacagcagcaacaacagctcacacagacacacacctcctccccctttgacaattgacaccccctcctcttccttccacgcgcgttagcgggccgcgcggcgccgcgcattgcttcacctccgctccgcgcggctgaaaccgaaaaaaacccaatttggatcgaagcggggagagaggacttgaggagacgcgtcgtggagggaagtttttgaaaaaaattttccccaacccgctgggcgcgatgccgtcatgatcccccccctcgcctcgctgcccaaaaatttttcaatctctctcgcccacattaatcaccttcctcacgaggccaacgagcagaaatcccatttcatcatcattcataccaatcctctcggtttcttccgcgtccccggattcagtttcctcctcctctccccccctctcgatccctcctcctcttcccctcgttccagcgcgctcgccgtcgcccgccgccgtccgccgaccatggaagcagctggagtggaggtgaacggaggaggaggaggcgacgtcgtggtggtggtgccgcagcagcatgaggtggcggcgaagcaggcggcggcggcggcggcggcgaaggggaagtccgtcgaatccaagggggtccgcgtcgtcggcggccggatctatgatccggagaacggcaagacctgccaccaggtaacccctcctcctcctcccacctacctgcctgcctaccatctgttcgacaccgtgtctagccggtgtcctatgaggagtcgtgcgtccctgttcttcctccccggtggttgggtcgggttggatctgaggaattcttgctcgcccccccttgtttttgcggggaattcttgctcacccttgggtttagcggttgctctgtttcttgctccctcgcagtgccgtcagaagacgatggacttcgccgcgtcatgccacaagatcaagaagaacaacaagcagtgcacgatccagtactgccgcaagtgtctctttaacaggtgaggggggaatttcttctcgtcttctttcttagcttcaggaggcagagcaaggctggctgaccatgtgatttctgagtgattcgtggcgcaggtacggccaggaagccgagaaggtggccaatgacggcacctggacttgccccaagtgcaaggatatctgcaattgcagcttctgcatgtgagctgaccaaacctgatgctctaccggtcatgctgattatctgtggctcgcgttttgttgtcagaagtgatggatggactttgatttgtttggcaggaagaagaaggggctgccgcccaccggaatacttgcccatgctgctaaggcttcaggttgtgcttcggtccatcatttactgaaaaaggggaaagaagcggtggctgccgcgcagaggagcacccagaaagtgagatctacacctgtgaaggtgtgtggtgttcaggattggcacgatcctttgtcacattacaattcgctgttgcatggtacgattgttcactatgtttgatatgttttgctgatcctttttttatgaacaagcagaagagcccaaagagggccatacagccagatgctgctgctgatgaacctttggctgaaggggatgagaatgtatgcattgatttcaatgctgctccagtgaagaagcagaagagaagcaggaaggtgggtaatggtgtggctctgacgaaggatgaaagccctgatgctcccaaggaacaagttgttctgcccaagggcactccagtcactagtgttgccggtgcagagtgggagcctgaagatgttggtcttgcacttcagttcttcgaattctgccgcacatttgctgaggtagttacgaaagaaagatcaaggatatttaatagtatgattgcacatgccttgtcagagtaatatcttactagcatttgcaagagaataatagatcgagttttttttttctatttacatgtctgatgcatgttatgttttggtatgaagtatgacaatgtaaaaaatgcttttactggtaagcaccgaagtgttgatattagagcttcctacaagtttggaatcatatctatgtgtttatgtaggtaaggcatgcaatgccatgatgggatacaaatcataaagggaataggtattcggattagaatttggagagggagatggtggggtgaccgggtgacagcaaatgggcaaaaggaaatatatgactacctgttgagttcattgtacgcattaaatggatgcgatttctctgcgtgcaacatgctaacacctagatacaggctatctgttaattgccctttaatgtgtacaatattcgagttcctatttgtaattatgaggtttcttttttattgcatggcacttcttgtccatatgatatacatgttaacattgataaactggtcgaaaccttccaattatatttcttggtttgtaatttaagccatgtagtagctttcatataacccaaattaaatgttattatgttctgtcgaatttttttatttgtgataggctgcgtgttcaactgaactaccaaagctatgttttaaagttttttttttaaggaaactaccaaagttatgtttcatcctatacaatatctcttgcaaaaggtatgtataaagctccattgttttacacatagtttgagcaaagttcaaacttctgagcaaaacaactatctattccatctgttccaaaatataagcatttctgactatttacctgaacggaaatgcttatattttggaacgagggagtaagtgatagcgaagcttattcttttctgtgcgag

SEQ ID NO: 41788 - DNA, 2259 bp, Oryza sativa
agttatcttaatcttttatgtttatttctaacaagtgtcatggaacaattagtgtaaaatttttgcaactaccgtgagtcctgttccattacaattgttgcatcatacttcctccgtttcataatgtaagactttctagcattgtctacattcatatagatgttaatgaatctagacatatatgtgtgtttagattcattaacatctatatgaatgtggacaaacctagaaagtcttacattatgaaacggagggagtaacttcttagtgttttttagagttttccttttgaattcgggcttaggatcgctttgcgttataatctgaagtatttagtcattgccgcaagtgatcgctgcgatgcaatgcgagcagagttgagcgaacagtctgtcatgtaagagtacctgtatctgagcacaaactaaccatgggcgcgtcatgcttatatctaggatgtactcaataatttacaaccccaagtgtatcgttttacggtctgatctcgtgcatatatcgtgcatatgctctctttttgcttctatgtaaactccttgtttcaataataataatacaaggataacgcagtaattaatttattgagattgctgtgggcgttggttttgaactattcttttttctgctattttgttttacatatataaagcatgcatttattttctggtgtacttaacaatttgagaaaatagtcacagtttgctgctagcattacaggctttttaattgaatcagatattttaaaacaatatcttgtttccttagttaatatactaatctgctctacatgctcacatggtacattgagattatattttgtattgcaaatggaataacatactgatttttccccacagattttccaagtacgcaagggtcaaccagaaagaatccttcgggacatagctggaggtcgtggacttcgagtggtgtcctcagtcatcgctgacttccacataactttgttatccatcatccaagaaggccgaggaatcaagtaagtagatcccaaaccgagccttttttttttctaaatgcagttgataaaattataattatgttgttttcttctcaggcctatcacatattcaagagataatgatgcatggattgttgatactggaaaatgcataagcgagtcaatctttgtcccagagggacttccccttgactccctaagtcagggggtatcgggatataaaaatctgagcccttcttgtaagctcagtgttctgaactttttgtgtgatgaaagtctttctactgagtaagtattgcctacacatttgttaatacttcccttcgctattgtgatgttgttatttctgattttttaaattactcttaacattgttcaggaagttgaggagctgcatattatctgaaacaaaaacccctccagagaaaaagctcattctgcaaaagagaaggttttgatcttggcttgcctttcccaccttgtcacatggttctagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaaataagctgatcattgttattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgttggaaagcgttattcaacatccttccactaatttcagttctgcattataaaattggagacgattaacatctgtctgtatcagaggttgatgctgatgatttaatggggaacaaagacaagtggtttatgcttaatgaagatgaaaagaaaatagttgaaaactatttatccacaaggtaaggatttctccatatcaatttatttggatttatttttatctattataaatcaggaatgcatgctgattggtatgctggataagtcaccaaaatattttggtagaaacactatttgatattttatctgcaaaca

SEQ ID NO: 41789 - DNA, 9207 bp, Oryza sativa
  unsure (1)..(9207): unsure at all n locations
aaaggggtccactgtcatacaccgaagaatgtcggtggccaatggcggtgtgcctggttcggctgatccaaggttggcgcccccagccccctccttgcgcgtggcgcccccttattggttggngatgncggttgtgggngcnccnacatccacaaccgccatttcaagcgtcatatgaaggctataaaaggaggagttcaactcacttccgaaacacacatctcaagtggagtacaactcactttcatattttaggcatctctttagtgtgtggaattaggtaaagagtgaggtaaagctccggaaggagtgccccaaatatcggagttcttcttccactggagtttcggagaagtgatggagttatcggccttcttctctcgtttgtatcttaacggatgcttcttaagtaagtatttgagatctccttatggtatttaatttagttgcttgaatgacatatattcccatcgttgcgggttcgtcgcttagttgaattattaagtgctctagtactaggattctagataaagaaggaagttcctgcgtggggctagagtagtaatcaataacttaggtgtggtgtttaggttagcggttacctttttttgttgtgtgctccatagaaagtgaggtaggcggaaggtggtgatagccttgtccatcctttgtatccctccatgttcaggtacatcatagagccgtaggctggattcagcttggcagaccagcggagggctagtgccagaagcaatcgatagggttttacctttaactcaagtctagtaaattaatccataggaatcctctttagccttagcctaccattagttgttgtccttggatagaattatgttcctagatatatgcacatgttttctgtgattcgatacccttggaatactctgaggtgaagtgctacagcggtattcgtgcgcttgcggatttatctgtgaccgtatcaaataccaacagcgagctcaaagagatcgtgatgcaccaacaacttcatcaacatcatcctatgtaatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggaatgcatgctgattggtatgctggataaaaaagctcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttgtaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgttttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtacccttttaattcagcacaccccttttcatttctttagtttattattaccattttgagtttagttttgtatgggtcctgcatctagactacgctaggagttcccatatcattttgtttatgtgacactgcctacatcaatcttcttacttttacatgttatcaatcggatagttgtatttttgttgatttaattttgagtagataatttggaatgcgatacatgctatgatctatgatttggtattttgctactttttacggaatttgtagcctgctagatgttcttacaaagatatgagaatccatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgttatactgaaatgttgcactatagcaagagtttgctatagtcagtcaacccccgttaccgtggtgtggttaaagttaaactgttgtgtgtaacatgtgactgtcgataatgactatccatccattcagttcagtgctttagatgcctttgatttttccccccttcagggctttactgggttatctgtgttagctcacttgcagcacgggtgactttcacaaacaagtgacaatggcaattccttgccttgtcacaattggagaaattgacatgattttccagatggtccggatattattatgctccaattattcttgattggtttagtgatttgccctttccagattgcggactaggggttaggattacatgagtactcataggaaaaagtaaggggcaaaacctacgtgaagtctagcgtcagcttggtatagtttggttctgataatttgttgttggtcactatggtctctacagatagtattctactgtagaaaagtaccattggtttatgtatttgattagtagaaaattccactgccatatttgaggtagtagtagtatggatagatatagcctattggacgaggaaagatagaaagtctagacttaataaattttggtccaaaactttcttctgtattaggtaaggcatcttccatcattttggttttgtgtttttttttatgaagcacacaaactatgtttgttttaactctctaggattccatgaacatgtggtccaaagattctatcatacttttgtcaagtcaaaaaaagttgctagttttgtagcggcctgcaccacacctccacagtgtggccaaagaagaaaaatctatggacaaactcctattatcttcacccataggatgtactaaatcaccccctaagaatgcctttagagtctagggggtcactagtaaacacctacatactggtggatcgaaatgggcatcacttctagtttggaaccagtggtgagaaagaaatagtgatgttttacggtaataaaattgaaggaaaaaaaatagcacctaggccagctccagttcatactctgagttaccttctagttccttgcacgacaccttgtgcgcacggtggccccttgaggtgcttgcgggtcccgtcttcattggaccctatttgtcgttgtcaaccccatatcttacaagaactgactagatctagtagcctcaagtttggagcaaccaaatctgacactacaatgcctctcgctttgccactcatccttgtcacccaagaccatggttgttttgttgcttgttcctaggccaatcgccatcatcaccatcacctgcgctcagagcacccagatctggcaattagatctagcagccgtaatattgcaacaatcaaatcaatcaacccggagctctggctagatagatttgattgttcaagggcaagtgtgggtggagagaaagagagggggcggagggtaggggagggagatcaagggcgagtgtggatggagagaaagagagggggcggcgggcagggaagagaggggatgtgaatcagtaagggttgagggagactaggtatttaacgatagtgtaggaaagtggctcaatttggccttactcggctgttactatcacttcttgtttctatcttgaacatgtggtgataaattttgttattagtggatcaaaatgaattaatacttatagaaggttaggctatgtgtttgctcacaagtgggtcatagatcaatctattgttatgccaaccataacattctaaggtatggtgacaaaagtgctagcagactgagcttttaagaaccaaagtagacggacacacatccttttgttatactacgagcacctttaatttgtaggaaaatataggaattttggaggattataatcctattggaaaatttccaattcctctctcatccaattatatctctttcatccaatttctacgtttttccagcggtctaatcaaacagtcattcttatattttttctacgttttacaatcctctgtttgtttgcacttgtattcctattagaattctgtgttttttctattctttcgttttttccattcctatgattcaaaaatgcccgacatatgcataaggtgtcattgatagatggatcccacttgctctaggaccatatgtcagtaacacatactgcatatgcagtacaagcaaaggatctcatttaaggccttgtttagttcgcgaaaagaaaatttttgtgtcacatcggacgtttgaccggatgtcggaaggagttttcggacacgaatgaaaaaactaatttcataactcgcctggaaaccacgagatgaatttattaagcctaattaatccatcattagtacatgtgggttactgtagcacttatggctaatcatggactaattaggctcaaaagattcgtctcacgatttccatgcaaactgtgcaagtaaatttttttgtttatctatatttaatacttcatgcatgcgtccaaagattcgatataacgtttttgagaaaaaaaatttggaaactaaacaaggcctaaattagatctggtagtagcagaccctagtgcaaaagtgcacccaataacatgtatcagtagtactcacggttatgtgctaaaaggtagaatttcactgattgtgtattttgccacatgttacaaatttccgttttttcttgttatttttcttgcaaatgcaggtgcatactgtcaatattgtaatttattaaagaatttttcataacttctaatgtggggtttctgggcatgggaccaccgatagtaatgtttacctagtacgtactcccttcgtcccaaaatataaaggattttgaatggatgaatatttcctagtattacgaatctggataggctaggaaatatccaatccgtccaaaatcccttatattttgggacggagggagtatattatgggccatataattgacaataaggatacattacttttgagctaggcaggtgaagagggagatgagaccaagaagagagagaatattattttaaacaacatgtgttgtaggcctacggatttgtgcatggaattaacgaatatgcaatactacacaaatggcttttgttaaaaccacctcatcacaaggtctggatcatcctgcctattgagtgttgaactggtaattatagtttttttaataaaaaagttagataatttttcatataaagtcagataaaaataaactttatatccataagtattgttgtagaacttaagaatatttacaatctatagttgacaacctttatatttaagatcattcatatgtctgtatacgtgttagaaggtctagagactattttgttgaggccaaaatttgactttactacacggctttgtatggtgattggagacaaactttatatcatggtttttaaggtggtaaggtgaccccggactaccttacaggtaaggcttaaggcgagatgacgtcttaggcacatcaaagctgcattttaagagcagtacgacacacatatataccttgttcttggcaactcttaagcccatgtagcatccaatacctacatggcagcatccacccccttagaagcatcaccattttttgtgttatgaagataataatagatgcataattgtaaacaatagttaataaattgcttccatttacttgagtagcataccttgttgatgacctgaaagcagcaaggcacattattgatgagcaagatgataatataaagccataaattcaaagacaacaaagtaagcatttgagcacgagtaaattgcatattggaccactatattttacaactctatcagcttggactattggtagatctacatttccctattggactgggtaaatttacaaaggtttcagtttggggctgttcttgtacctgtagctccctctctcctctctttgtgtactctctctctctctcgctctctctctctctctcttcctttgtgggcaagaaaagaaccactgggtgggctcaagactgtagcatggagctgccggccgagctcaacttaagtgcaatgccggagctgttggggctaaggccgagagctgagctggctgctgactgggctcaaggctgagcatgacactgagccaccaatgactctcgaggccgagcatggtgtaagccctgacagggctcgaggtcatggtcaagtgcgtagtctgcttcgagcggatgccaacagtggacgtgctactagtggagaggggtggaggggctaccataggttgttgcttcgctaaagcatggctactacagggaaatcatcatcatcatgggtggtgttatccaatttgccacaacaacttgcgtgatggctctcaccgtggtcagcggcgctcggcctcttgcctccacttgccaacgcatggcatgaagtacgtctctgacatgtcacagtccacacaacaaacaaaccaaattatacaatcggtatgcactgacggactaaccatccatttattcgcctcggccacattgatctccacattgttgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagataaagtggtctaaagtgaaaaagtttgtttgtccttagtccaatttgcaacaatggtaaaaaagagcggctcaaggtgcaatttactctaaacataataaactatcaagcaggctaacctagcaggcaagtaaacataataacaaagcaaaatagtgggagctatcatatacctaatggcgtataaagataatagtggtccataactccacactccacactccacactctaaacaaatatactataagtccaactccttgtctcttagtattcatcatcaaactcatcgaaattgccattggcatccaaattctcttagccatcttcaatacctgcgtgagcttcatcacaattgctcacatttgcatcattaggtggatcttcctccttatcttcttcttggtcagattgcatatcttcctcatcttcttcaaacattgttgtattccttgggtgcctttgaaaggttattggaacaacaaggttgtgaactctccttagaacatgcgattgttgtcggtagataagtgcaaactttcaccgtcaactcctgcataaaagaatacaaaatataatatcaaacttagtggtaggggtttattactaaccatttccactagtctttgtaaatattggtatgcaggtgatttttgaaagaaaatgcactcgccatgagactaaatgtacctccgaccaaccatacgcaagcacaaggatcggagagcccacatgtcagtcaaaactaactgaatttgagctaatccaccgtcaactgccaaaggggtccactgtcatacaccggagaatgtcggtggccaatggcggtgtgcctggttcggctgatccaaggttggcgcccccagccacctccttgcacgtggcgaccccctattggttggtgatggcggt

SEQ ID NO: 41790 - DNA, 3526 bp, Oryza sativa
acagcgagctcaaagagatcgtgatgcaccaacaacttcatcaacatcatcctatgtaatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggatcttctctttggcatgcgtcattagtcttgaaacctctagcatagcgggcttctcatcgccatcaacaactcttagcacaataagtaatggggttgaagctctgatacaatcttcaatagaggaccaaaatttcttagagagaacaatgccagtcacttatattattgcctttgtttttgctaatttgatcccagtccattgttcactcacaaataggcttctcaattcatctctttggctataattgctcttcaaagtaagataagttgtggcaaatcgagtgacagctggtcttaaaagattctttccacttgtcttctccctcattgcactaagaagcctcccatgtctataaatgaaagtggtgacacgcttagcacgggcaatggggtttttaaattccttcagtttccctatgtccttcaacataagatccaaacaatgtgcagcacaaggagtcctatacaatgtgagaattctctccattagaagcttatctgttgcatgtattagcaccattatcagtgacaacttgaacaaccttctcctttccaatgatctcaattctcttctctagcaaattagctaacatagttgcattatgtgtttgtaacattctgaaaattcctaataataaaaatcactaaaatttcgaactttttaaaaacttttgcatcatgctgggtgttatggttgtcattgcttgccaaatataaattgtaacaatggagaatcaaattaatggcgtacacctgaacaataaatatatacattagtgcgcaagaaagcaagccaaataaaatattaatttctattataaatcatagatcaaatattaaatattcgaaccatgttgatagctcgatgtcatgtttaactaatgggattgtaagattaaatctaatgtatttggatccaatctcacatgaagtattataaatccacatgaaatgatgattactactataatgatcctattaacaaatgagaatttcatgggaatatatatacattaatatttgaacacttgataaagtcactcatataaaataatggtcatataattaaattaagctttataaaattatgtgagtttttaattaaacaattagattaatattgtgccgagtctcaatttactatttatagaataaatagattgaacccatccgtgcaaaatatattgctatacaactaaactcgaccaatctgctaatgtattaatcatgacaagtcgttatattaaattcaatattaccccaaagtcttcaaaaatatataagttcaccttagggtcaataacccaaattaatctaaaaagaattcatttgtgcgataaataaataaatatgggtggtaataatttggataaattttcatgaggatttagtacttaaatttagttaacatttaactaagtaaaattagagtttgtaggattaaaattgtataggagataggctaaaatagggtttaattagggatagcactattcattgcacatgaggtgtttgatggagttcctagccaccttagccctcttcctccccactgccgcgcctagccctgcccctgccctgccgcgccgcgcctagccctgccgcgccgctgccttgcgccccgcgtcgccgtcgccgtcgccgctgtcgtgccgcgccaccgtcgccatcgcgtcccatcgccgcgcgccgtcgccgtcgcatcccatcgccacgcgccgtcccatcgccacctcgcgcccgcgccgctgccgcgccacgtcgccgtcgcgtcgcctgtcaccatcgcgccgagccccgcgccgcgccgcccgcccgtcgcgtcgccgctctgagctgcgcgccgccgctgccgcgccgtcgccgtcgccatcccgctgccgcgccgcgcatgccgccgtcgcctcgagccccgtctcgccgtcgcgtcgcccgtcccgttgccgcgcgcccgtcccctcgccgcttcgagccccgtgccgccgatgccgcgccgcgtcgccactcccgctgccgcgccgcgtgccgtcccgtcgcgtcgccgctgccgcgccgcgtgccgtcgccgtcgcgtctcgtcactgctgtcacgccgcgcgccatcgccgtcgcgcctcgagccccacgcgccgcccgtcgcgtcgccgttagggtcatccaacccctcccccgcgctctataaaaccccggccccctccccttctccacccacacccattcccctccgtttccccttcctcctccacacgccgtcgcctttgtgccgccgcgccgccgccttcgttccgccgcgccgttgccttgaagccgccgcactgcgccgagtgccgcgctgagcgtcgccgccttgcgccgccgccgccgccgtcggtaagccgccccccctcgcgtccggtcgccgtcgccgcccaggtaggccgtgagccgagagagagagggaggaagaaagaagccagggggagaaaggaaaaagaaaggaaaaagaaaggaaaagaaaagaaagaaaagagagagagaaggaaaaagaaaggaaaagaaaagaaagaaaagagagagaaggaaaaagagagaaaaaggaaagaaaaggaaccctgggtcccacctgtcggtcactagggttatggattagatttcggattaaaaataaatcatttatgaacagtagctttttacaatttctcgggttaattcaaatttgaatctttacactagcataacttattcattttagctccgatttgagtgaatcttgaacctaaattcatctaaattcataagctttccaatggtatatagttcactatttaataaaatatatttataattattaaataattaataccacgatgatgcataatagtcaacttaaaaatgtgctaataaataaaattgatattgtactataaagtagatgtcaaataattgtccttaacatgctttctcactgtaaaacctatgtaaactaattagcagcattgtttcaaattaattaaagcataggcaaatactagtgtcaattattaatatatgtcaatatataattatactcatgacgtccgaattgtataaataatgtttagcttcatactttgtgactaaaagttg

SEQ ID NO: 41791 - DNA, 11243 bp, Oryza sativa
catcatcgtctttgccctttcaggtaatggattttgtgtagatcataggttggattgtgtggatcatggcagcaaattagtctagagaatgaattaattgcagaagtctagggctagaactggtccttgtgttatgattggttccaaattaaattatatgtttcattaaaaaataagatggattattttatcaaaatactctaaattttgttagatttttcgctatcatgtttgtaggagtagatctaattcgatcagtattgacaaattcaggtttttcaattttagtcagaaatcatatgccagattatggtagaagggattcaagatgtaaaagtgtgattgtgattagggtgagtcataattcagatgaaaaatgtgatccaagttacaagctaaagtgataatacattaagtccatttttcctatttcatctaaaactcggcatgtattgctcatttctagatgtaatagttttttccctcaatcaaccgaggacatagaatcaactaactacaacttctcattacccttacacaacaagtacatacggtgtatgtttctatatggtaaatgactaaaactgattgattgtaaaatattataagtgttcaaatttaacatttagtgagaaaacaaaatggcattacttttaacatatgggcccaaaggattaatgctcaaacatgtgagtgtttatatctcaattgtgaataccctatagtcctattctagttccatttaaattattttccttttacagatcaaggaagtgcaaaaaagttatgtagctgaagccattgggcccattgcttgctcaaaagatggggtgtatttggttggtggtgctagttctggacatacttatatttgggaggtaaataaaaaaagcttcctctttctacaaaagaattaaactattcatacgtcgttctattctagctagattatgatcaacaagagactcttgatgcattgttcgatgtttgaattgggtatctttatattaaaggaaggtatggcttgtgtttatgtttgttttttaaatcattctacgaattatcctgtcatcactaatgcataattatatccaacaataccaagttcttttattttgatttatgaaagacatggggatttcctatttaaacatgtatgaatctaccgaacttcaactggtttgtccagcaatacaaaatgaagtttgaactaataaaagatcacatcaaaacttatgccccgccaattctttcatttataacctagtattcgttatgctccatctttatcgaaaggatgccactctgatcataaattggtttgctccatttgttaatgttagtttggatgatctaaataaggaggtccatgtaactgacaaacggaagaaagtttatgaccatggaagttaattatacttctagtcactatgttaacttccctaaaaataacattacgagttcatttagcgataaattggtagtgctgttccagcaaggatatataatgatttgtatttatatttgagaagcagttcagttgaatatcccttttgtatgtatgatttcgcttgaacaaaatcttaatgcctctcattctacttcacttgacatactaacattttttaacctactgcattgtttgatattctacttggatggttagtgtatgagtgtattttttaatccaaattcataaataaagattgcatcttctatgggaaatattcttgcaaatagtacaaatatctaaaaagagtaataatttaaattttgcatcacacacttagtgacaaatttctgtttaatatgaactctttttcacttgaaaatattgttcatttcagatagcaagtggagcattattgaaaagatggtgcggacataaaaatgctataagttgtttagccttctctcaagatagttcgtttctcatctctggatctatagaagggatggtttatacttggtcaatggtcaggtactctctacaagctagaagtcggtgaagcattttttttaggaaaaaaatacaaattactccctgaaatatcgtggtcgactgaattaccccctgaactcgaaaaccagatatcgctcaccttgaacttttaataccggacaaaacaccccctccccccgagcactgttgcaagcggtttaggattcaaatagcacacgtggcagtccagacatcagttttttttaaaaaaaaattgctagggcccactcgttggaatccccgcccacatctctcttctccatccccttctgaagtgggtggtggctagggagagggcgtgacgcggcgctcttctccctcctcttctgtagcgcgtggcatggggggagatgggcgacacaacatggcgacgcgaccggcagcggcaagtaggcggaagcgaaggcggcgcgtgccggcagcggcaagtaggcggaggcgagggcggtgcggaggacgcagtggcggtcagagtactgctaaaatctctcctttctctttcttccctctggtgcggcggtgagattgggtagggcgcgtcgcgacggggctagaggggtagagccgccaacgagggcgtcgggaaggagaggtgattggagcggaggcggcgatgacagagcggtggagcacgcggtggaggaggagcaaccgggcgctgggacgacggggatgggctgcaaactcgtcgccatagcctgccgtctccaatgtcctcgtcggcgcccaccgcccgcctcgccctccccaccgcacgtgtcgcgccttccccgatgaggactttgtcagggttatggatatcacatacccaatagtaatcgactaagctcggcagggcccaccacataccatgttttatatggaatcatacctcgtatatagaaggagttccggataaggaaggacaaaaagagttctatatgtaaactacaaggactactcggatcgtatctatgtttatctccctagttctacttggacaagggggcatctatgggtataaatacaagcccccctaggaggagaggagacagaagccaaacgccacaaaaccacaagaccaacatatacacacgctaacacacgccgccagatctcgacatcagagattagccagacataccccatccggtgcctacggaggccggtaagagggatctagcatcatctctgatctcaacgggttcatattcgaggaggaagactgccctgttgtcgactacgagttggttatctagccgccaagttgacgacaactagataggttatcccaaatattgtacttgtgtgattcagatgaataagagcaacactggcttcggtcaacaggatgtagggctattacctatcagatgaggggcccgaacctgtataaaaatccatgtctccatctcttttacctcaatctcgcatatacctggtaccaacgatccccataccatccaaataccctagtcgcgatcttaaacatcgacagactcatcgctcgccgcctgcctgagttgagagagagagagagaggcctcaccgccgtctccagggaagggagcagcaacagcgctggcgcttttgcctcagcgccggccaatgacgtcgacggcgatggcgacgatgaaccactcgtctactcttctccctactgctcacccgcgaccctgagctgcctcacccgtgaccccgagttgccttagcctcgccaccgaccgcgctgccctcgcctctatggtcgtcagcctttgcagccgccccgccgcgtcacccctctcccccgccatggctgccttctcgcgtaagtccggcgcgagccactactcccctaaccacaggaggacgaggcctggtgagcctgatgggccggccaccgccggcacgccacatcctcggcctctgcctcgaggagactcgcaaccgctggcgcgccgctagtcctcgatcacgctaccttcgtttccgcggtcgccggcctttgcagccaaccaactgcgtcgggccagccaccgtcggcgcatgcgctgctcgttctcagcggcgagtgagcgacatcagagagagatagagaggtgagaggggatagagaggagagagactatgatatgtgagccccaccattttttaaaggcaaattttgctacaggacactgcttatgtgtggttttaaccctaggacactgcccaaactcacttttgggggaaaacactctataaacatagtaatttgccagtggacaccgccccaattaaaataataatatctggtagaagaggagagaaaagtcacatgaaatatcaaaaatacccttcggcccacatgtcagcactcatatctctcttcttttaatctctccctatcttcctccttccagcgtcactctgataggcgagccggcgtgcagaggaccggcataggcgcgacgaccttgcgggtggcacggcgaggcgaggcggcgagcgccagtggggtgcggcggctgtgcgggcggcgcggtgaggtgtagtggtgcggcagcggcggtggctcgcggtgacaccttgcggggtgctccggcggcgaggtgcagtggcgcggcggccatgcggaccgtgaacgtctccgcaccgtagcgctcgcctggaccacgaacttctccgcgcgctagcaggggcacttgcgcgcctccacgacaacgtccgccgccgtgctcgcacggcacaccgtctgcacggtcgccgcgccactacacctcgccgccggacgcaccttgcatggtgtcgccacgagccgctgccactgccgcaccgcccgcacagccgccgcaccccgctggcgctcgccacctcgcctcgccgtgccacccgcaaggccgtcgcacccgtgccggtcctccgcacgccggcttgcctctcagagtgacgctggaaggaggaagatagggagaaattaaaagaagagagatatgagtgctgacatgtgggccgaagggtatttttgacattgacatttcatgtgatttctctctcctcttcaactggatattattattttaatcggcgcggtgtccactagcaaattaccatgtttatggagtgtttttccccaaatgtgagtttgagcagtgtcctagggctaaaaccacacataagtagtattctgtagcaaaatttgccttttttaaataaaaagttgctgactggactgccacgttggactgaaaccactctgatattgagtaggggggtgttttgtccggtattgaaagtttagggtgagcgatatctggttttcgagttcggggggggggggtaattcggtcgaccgtgatagttcagggggtaatttgtacttttttccttttttttaaggcccaacttttcctgttgggtttactagtattacacgcaggcttgccattcaagcataggaacaaagcaccactacattattcagcactaccagaaccaactagcaagaataggtagctaaagaactacttatgacaaagagaaaaatgtcccaaatagcttgcaaactatataagcgcaacagtctcatcaggcttgtagactatttgagacaatccttggattgcaattagagttgtttatttttttattggaaatagcgagggaggccctcacggcatctttttcttttattcaagcatgaaatttgctcccttggaaagtcgaatgaaggacctagaggtgctacttgagcactgtaaccactaggctacaacccctttagcaagttgtctcatattcagttgatccagcaaggtgtcaatgtcttcttgctcttcccactccattagtcactatcactacacaaactattttttacagtttgatttggaaaggagtcttacaggcaagtattaaaacatatagatcatttttaatgaatcgcattaaatgtcaatgcaatcacattagtccaataggatgatttcacctataagctacctctgatagaaccaacttgtttgtggactcattcaagcataagataaaacccatcatatataagccgtaaagggatgttgggtaaatatatttttatcaatgtttcccaaccaccatgagacaaatgaccacatttcctagaactgagccgttgtctcactatctccaccattgaaatcatctatgcaacaattttccagaattcaatgatatgtatgtaggtagttgaaaataagctatttttacaattcatcatgtcaacaattgtcctctgttcttctcactccactccagagacaaagtctcactcttctaactatatattatcataccaaacatctcataaaagcagtacaataaatatttgagaaatgctccacttcagaaaaagaacagtgttaccagtatattattgttggtatgtaaggctatttgatatcagatgaggcaccaaaccctccaatgggaataatcaactaagcatttaagttaacacatgctttcaataacctatttttcgctctgcatatgaactttgcagtttatttcaagcagaggaacctcgacccattgaaggtacagagatatatcccaacttttataatgtaaagaaaaatgagcacaaggcgtcaataactggcattttaacaatgctaaggggtcaatgtcccattctaataacgagctcactcgatggcaattgcaaggtttaatgcacctcagatgaaatatgttgtttccttttgcagtgatcaatattgcaactttatcagcatcctatatgaaacttgaaatctagttcctgtactaaatgtcatgtacactttcataatttagcaatgaattatgactactgatactccatacattcaaaatatattattcagtaaaatggttctatatgcttagttctttttaaacaatataacttacatatatgtttgttgtctatacaatttactattctgatgtttgcttcaatattataactagatctcatatcaacacaaaactcgatgtggtcaatttcttgtgcttgtgttattcattgcttaaaatatattcaataatagtaccaagaccaaaatgcaacagaacacttactcgtaagatttagcacactttttgaatgtagatttgagcatgatttccattggcgctgatgacaactttgagaatatgttatttttctaggttacggatctattgtctgggttactacttcacaccatttcactctccagttcagttactacaatcgcagttgatcctttggaacaatttctactttgtggggctggtgatacttgtatatatgtcactgtgttgaatggaattgggacaaaaaaatccagtttaacatgttttgaggataattgtcaaattctttcaggacacaagtaagttatagttgaattaagagcattgattggtaaattttgcaaatgttactcaagacatatcaataattgacaataagatgcaatgtactattttaaatttagaacaaatattattatcaagaatataaaacaattatagggatttccaaaatgagaacacatttctttatcacaattaaaacttcaaggaaacggtgaacataacctctaaactttgggtaaaattccgtgtagcaccctaaacataacccccagactttggaataccattcatattatttcctaaagtgattttggatagtggctttgtgcatttggaagcttaaatgagcctgttacacatcatcagtcattggtcatcaatatataagatatagttatgccatactagtattatatcgacattcatttgtaagttcaagaaaaaagtgggtaagaatgaaagatttaggtggagatattagcatatatgtccaatgtcatgcagtcatcgaacgtatatgcaaattacataaaaaccagtttgcaaaatgcactagtatttggtttatgtatgatattatatagttcggagggttgggtatttggtttaatagattagggtgccaaatggactttcaatcaaagtttcttttgggcggggtgtatttagacttttctaaacttatgtaatatgtatctatacgttagtttctattgtatccaatcttgagtattagtttctttctatgttagattatgattgttccgaagtattttttaacaaagttctataaagtcttgatatctaatctatacctaacattgataaaatatttgattttaagtgttgtgaatccataaaataattagcacaacataaaactaattggctgattccaacttgtcaacagcgctccaattactgcattagcattttgttctaaaggagtaaggttggtttctgcatcaaaggattgcactatccttgtttgggacacaagagcatggcaagttattaataaaatagaaaacaaaataggtaagtctacatgaagtccattttagttcacttttgttctttctgaaagggtcacttttgttctttctgaaagggtcacttttgttctttccgaaaggttcttattttaacattttttttgccttgtcatttcgtcactaggtgggcatataacaaatttgctagtctttccaaagcgagcgatctcaactgttcatcaagaaagaaatttccgtcccatcaagttccctaaattagagaagatatgcaaaccaacaaatgaaacaatggcatttttggtgccatctcaattctccaaagatgtcaattctagcatagtatctttcaatagttccaaccttctggctgagcaactcttggatttagaggtaagacttatatgtattattattatttctgaaaagaaaattatatattattatattaaaaattatgtaaagaaaactaattggaacactttctactatttactaggaaaagagaacccttgaagcagtagagatgattattggagtgaacattcaagaccgggtgaagaaccaaaccatggcaaaggaattgactaatatgaatatgctactgcagggacaagtatttgatgtgatggatgttggtgcagatgaggattaagtcattgatttgttgtttcatccagtatgtgcaatgaacataataaaatgattgaacatatatcacagtagaaagtgacataatccaagtatcagaaagtgcaatcttgaaaatcatatttatctgaaatgagaatgcctattttatttggtattgttgtcctgttaatttatctttgagataattcgttgtatgctgcctattattttattattctattacttatatacaacttctaagtttagctcgatatcatgtatgccaatatgtttggctcttcattccatgcatacctttttgttcctatatcattggttgttctagaatgaccatatcacccctcatttttttctccaatacgtaggagatctgtttatcatcatattaacaagaaaaaaagatgggctataaccctgagtacagaaccaaacacgcacataatgagttctaggaaccatacatgttgcaaaccaaaccacaacacaagaccacaaccacaaaccaaaccatgatgtgagactaaccacccggctcttgagtagtcaataatgatagcccctgaggccggcaaaaaccacagttgtgcttcctccttggcaagcaaaagagcatcggccaatttaggagcagtcccataaaaaacacaatggtttcgatgcatccaaagcgtccaagaaccaagaatgactatagaattcaggccatattgcaccctcaatgattatgctccaccacttattttgatcgtcattcaagggggaccaaagaatttaggacaaacctctacaggagggagtaccaaaactgtttcatgaagacacaatttgtgagaaagtgatcaatagtttcatcatcttggtcgcaatgagcgcaaaggtctggatgtggcagaccttgtcaggcaagacaatctggtgtctagcagtgattatgcacgacaagtcacatgaaaaaagtgacactttccagatgcccatgttttccaaatacgttcccatggcctgaaaatttagtggcaccttggaaggaggaatcataagcatccttagctgaatattgtcttaaattcatagtgcaaaaaactggactggtgagtgacctggatgaccccttggtgcacctgtccgacggtctgaccggtggactgccggttgaaccgtggttcaatagcaaatatatacggtgtgtatttgctctaaaatacaagggaacaagggtaggatggctagagccaagcgctctcaatgcacaaacccagtttcgagtccctataccacaagccttcctatgatttttgtaaaaaaaaacagccgcgtgggcctgaaggcaatggactgggccttaatttggcccatttatctccttttacccggttgtaccaaagtggtttagtgcccggtatagtctaaacctagtccgttcagttgttttttatccgggtcgaatgcatgtccggtctttaagctcaaccgaaccatggagatctaaacccggtcggttcagtcgtttctattcgggttgaatgcatgtccggtctttaggctcaaccgaaaattggagacctttggttctagttttttcctgttgaaccaccagcccggtccgtttttttccactatgcctaaagttgagaatctccatctatgaatatccttcatgccgagctataaaacaatcttagaaagcatatctcatagattgagaaaatccgctaggactccaccagaaatagcaccttgaatgtcctggatccaaccatgatctatcattattgcccctcactagaaacccaaagaaagaagacaccctacctagatcaaaaccacacctagtaactattttctaattttgaaaaaaagaatcaagaggatgaaattgccaaaaatacataaattttgtaattttggtattttctcactggattttaaatttaaaatcattttcttgtcccattaaccgctttggcattgacccaatgaattacaaacagatttgaagggaagcaccgaagcaatagtaatttgtaaaatgatttattatcaacaataaaaataaaagtgcccaaccaaaatagctagaagttaattttcttgactaaaaaaggggtcaaaacaggccttttcatacttattagatagatcaggcatctaagggaaaaaaaccagaactcagaggtatatagagaattgagcaaaactcgcaggtctagaagggattagtaaaaaactgtgatgaactacttgca

SEQ ID NO: 41792 - DNA, 821 bp, Oryza sativa
gaattatcaactccaatgccacataataatatatcatcaattagttattgaaaacgcatgagaattgtgcttcatttcatgaagaagaaaagaaatatttacaagagagagaaccaaagtatccctcaagcgacaccaaaaaagaaaagggcgtcacaacatgacacaccactaaaacaacctctaaggccccgttcgttctctccgattagagggacatttccggtgcacatgaaatgagaaaactcattagcacataattaattaagtattaattattataaaattaaaaaatggatttattcgatttttttaaataacttttacgtagaaactttttgccaaaaacacaacatttaacagtttgaaaaacgtgctaacggaaaacgaggaagtcaaagtttgaagttgagaaaaagaactaggcctaagaggaattagccatcaagaggtagcgacctacaaaaagctcgtggagctttggccccagcaatactccaaagggtactttcctgcttgaacaaccaccaaaatattaggtgtaccccattaaaaacacggtcgttatgacccttccaaatttcccaagccactaggataaacaaggaattcaagcccttcttttccttcttagggactttttgaatggccttaaaccactagttagagaaacgagttgaagaggactgaggtgctgcagctgccattccaatcttctcaaggatcaaaaaccaaagttgtcgggagaaaacacatttgacgaagagatgttaaatggtttcttcttcctgatcacaaagtgtgcatgcctcccggtgttg

SEQ ID NO: 41793 - DNA, 1927 bp, Oryza sativa
aattcaaacatcagtacacaatcccgctaatcacgtaaacaaaaaaaaacacttcacatcaagccaaaagagaatactatagctcaattcaacgcttttatgccaacgcttttatgaccgtatacgcaccaaaaattactgtggagcagcagcatacacagcagacatgtgatgatgtgatcacactcgcactgtttttggtcttgggaataaatttaaaatatactgcctccatcctatattacttgtcactttaagtttttatttataacatattacttgtcactttaattttttatttataatatttgatcattcgtcttattaaaaaaattaaaattattatttattttgttcgtgactttctttatcaacaaaagtacacttcaaaagtactttaagtgtgatttatcttttttatatttacactattttttcaaataaaacaaatagtcaacgttagtatatctataagaatgacagaacaaaacgacagcttgataacaacttcagaaatggttagcgtaggagtctaggagagggaacaacagtacaatactgtttattcttctcaattttgctttgccacctacattttcaccacataccaactgtagtagtatgcacaggtaaaccgagtacagttttactctggacataaatacatgcaagttacaatatcttagcaatgtaatcggtactagtaactggtgattggcagcaacagaatacaagcttagcatcattggaggctaggggaggggggttaaattgaatagtcctacatgagctgtggtagcaaaggcacacattctgttccactggaagtgttgctcttccagctccacagagggggcaaacaactcagtaagagtcatgagctgggctgtctgaatgcatgtccatggatgaatcgttcgaagccgtcgagttttgatcgcggttaacgccgtttgcgaagtaccccgcatcgccaccctgctccaggtggaatggttgcaggctccggcgaacggggctagatagtgcatttgaaaagaccgctgagttcttggactgcaccaatcctgtatttcctagcgcaaataagtttggtgatggctgctggctcattgtgttgggaataggcactgtagcttgagtgctttggcttgcatgctgtgatcttggagaggctgatgcattgtcacctccatactggatctcgtgctacaaacacagatgattattaggcacatgtagttgtgctaggtctaggatggtgcttaaggagaagatacggcataagtacaaactatattttgaaaagttgtagctggagcctggaggcatgaattggcaaagaaaacaatcaaagcataggattcatcttattcatttccttatttgccatcaaatataaaccttatcccttacaggataaaaaaatgatgttcccttatttgcaactagttcattttgtcttcccatttgccccttctgtcatcttgctgttaaactaaacaagaaaagataatttgcccttcctcattcttcctaattcctcgtttctccttctcttccttatccatggtaaatttaaaaaaaatgccagcaacagaacagtaaactcatccaacccagcggcttcgttcttcctgaacacatgacagagcactcaccctctaccaaaggtaggcatccttaccagcaatggctagtgaatatgggttgtgtgcctaatgcctgcatccattccaatgaggcagattcatgggcatctagcatggtcatccttggtggcatgtaagagatgtgccgccacattggtggtatccaccaaatccaggaagtactttcgcaaatttcacaaacttataagaaaatgaagtcatgctatgcaacaaaaaaaataacaatctgcacaatccttgatgaagtacttgca

SEQ ID NO: 41794 - DNA, 1749 bp, Oryza sativa
aacaatgaaacagaaagctttgcaaagaactaaatgtgtacaccctgcaacgaccatctgtcttcaaagtacaaaattcaagaatccattgaagtaactgttctatatgctaactctgtttgtaaggcatatgtcaaatgagcaggaacttctttgatcctagttgacattgcattgggctactagaaaacataaacctctctaaatgccaacacaaagcattactctgtgatgtacaaacaatgccaatatccaatgcattggctagtgtattgtttgatgagagtctagtaatattgtcatctgatgagtaaagcagacaatgctcaatggtagttagctagagtgtttccctgtcctgtgaaaacaaagaccaggaacacagctgagccacatcttgagttctgatcaaaccatagcttcaggatgtttccaagcattaataccaagatatgccgtccaaagcttttgcaagaacatgcaaaagtcttgcacatcacattaagtctttaagaggaaacgaaaacagacagttttgatgcttgacgaagtcaaacagcaccagaataggccaggactggatccacagagccacagcaaaaccaaaatcagcaaacataactaagtatcaacatcctcgtaaaccgcaactgcataagctaacaatgccatccaagtctgaaagaagcatcccacaccaactggcgatactttacatttaacagtacacaagttgaagcaaagctgaaaaggatgcatccatagtactagtgcagaagtaacctgttccacaagctaagcctcctctcatctgctttccattcccctccccctctgagagcaacctaatcctgagtcttgtaaagcacaagggtgggatgtctacaaccatttcaacccagaggtggaaaaagccatattggcacagaacctattggagaaaaagatcaccgacaattgaagcaaatgagtttggctgcatcgccgttaaaaggcaactgatgatataacaactacgagaatcgcactactagtgcgagagcacttgtgaagctatcaattgtattggcgcatcgcatcacgaagaatataatattcggtgaggtcaagggacgcactacgaactaaaattgcatacagaattagttggtctttacccactattcgaaatttatatgtgcatggtaggtaccagattcaggcagaaaacatacaggaatcaaaatttcacctaaatttcagaaagcataatcaaaatttcaccaaaatttcagaaaatttccacatcactagaggggtcaatcgaacacacaaatttcttagggaatctgaatttcactaacaagaaggcgcatcggaacaaaaatccctcatcaaatcgagccgaaaaacaagcctttccccacaacacaaacaccacagaaaggccaaattcaccggggaaaccgaatcctcccgctgcaaaaccgagaaatccccaaacatccccagaacaacacgcccacaccacatcacatcacatcagaccgaacccccaaacacccacaacccatcacaggaagaagggaagacgggagggtcggggagggccgtaccatggcgtggcgctcgccggcctggaaggagagcttctggccgcccatggcgagcgtgtagagctgggacagcgagttggccgcgccccggaacgccccgtacagcgccctgtccgtctcctccagccgcgccgcctccgccttccgcttcttc

SEQ ID NO: 41795 - DNA, 2202 bp, Oryza sativa
aattttggatttttatggaattgtaagaagtacttgtgaaatagaaaagagatctatctaactaagctttcttactctggttgtagcgtgtatgagtgtcttctcacttcgcgacttgatcaatcgtttgagttatacactctccctagcccccaccttgtcatcggagaattcttcttggaagataaggctcttggacctttgacctgcctcggttgaacaagcactgatcctagcccccagccgtgaagttggaaagttaatttccgatttacacagcttggttaatacgcacggcgagaactcttacacgaccagatcttacatggtctttcgtctctacaggatccgacaaggccttatctgctctgggcgtccccagccgaagttcccttaggttcctcagaggccttgtcaagacggcgtaaagggacatgaggataggtttcaacgctaggtgtcatctgggtaagggatcatcgggaatgaacactttgattgtagtatgtacctgaaaataggctttactgaagctgtaagatgtcttacaagtatggatactattgacttatacatagaatttacgtaattgatcaatgttccaggaattagccaactcacgaccatcgccgtttgcaattttgaatgcgcctggccgcagaacttgtgtgatcgtgtacggtccttcctatttgggtgagagcttgttccgccctgcttgactttgaacccgtcggaggacgtagtcgccgatcgaaagtgtgcgtgctcagatgcgtttctcgtggtagcggcgaagggcctgttggtagctggctgctcgaacggcgactcgttcgcgatgttcctcgagtagattcacatcgtcgtttcgctgctcctcctgattctcattggagtacttctgtgctcgtgcgctttgatatcgtagctcggtggggagcatggcctctgagccgtacacgttgttggtgtggtacgcacggcccatagtactgatggaagttcttcgacccacttcttgtcatgtgacatgagcctgtcgtagacgcgggtcttgattccctgaagtactatgttgtttgccctcttgacttgtccgttgctctgagggtaagaaaccgaggcgagagcagatcttgactcccagcctgatgcagtaatcctggaaatcggcattgatgaactgggaactgttgtccgttataatatggtggggcaatccagctctgtattatatccctttgatgaatttgattgcgttgtcggccttgatttcccctgtaggtgtcgcttcaatccacttagtgaatttgtcaatcgccacgaataggaacctgtagccgctctgtcgaatcatgtcgacttcacaccgctgaaccatgtcgcaggcgtctttgagggcggttggctagaagaacccctgtcgaaaagcttttccaactaatgtccgaccggcggtatgtgacctacagatcccttcgtgtatgtcgaggaggagatgtctgccgttgtccgacgagacacattttaggagtaccccgtttggtgcgttcttgtacagatcgttacctattatacagtagacttttgctttacgggatattttctcggcttctgcatcgtcctcgggcaactcttcgctgtgtatgaatttgatgagtggggtgcgccagtcgtctgtggtctcgatatcggcaacggcgcgctctatctatgtagcccccgagctgttgttgagggagatcgggctatcttcgtcgcttgcgtctttcactaatggccttgtcaggacgtccagaaaggtgccaggttcgagtggctctcgtctggatgcacgccgtgctagatcatctggttcgatgttgtccttgcggtatacatgtcggacctcgatcccatcgaaccttttttccagcttcttgacttctgcgagatacttggataactcggggctagagcacttgtaatctttatgcaccttgttcacgactagttcagaatcccctttcatgatcagttgcctgactccgagtgcagctgcagctcttatcccggcgagtagtccttcgtactcggctgtgttattagtcgccctgaagttgaggtgaattgcatgcttgaattgatctcccaaaggtgatgtcaagatgaatgctgcccctactccttggctgttgtgtgcaccgtcgaacgccattg

SEQ ID NO: 41796 - DNA, 12670 bp, Oryza sativa
cgtgttcgacgtaatgcccaccccgacgcctcgagctcgctcgatgcagtgaatcgaatccgttttgctcgatctctccgagtcaatggctatgatgtagcttgctgtctattggtatctgccttttgcttacaggctggatcatagctctgctcttaacagtggagagttgaattgatgatggatcatcgctggtgaattagggagatccctaaatccgattaattttcgtgttttaagaacatttcggtcaagcaaacggccatcatatttcttgctgaattttctgaccaaagtgaaactacagttagtttaattggtgcttgatcagttgctaaaagaagtgaatactcttttttttttttgtaaaagaagtgaatactgaacacaagaatattcatcttttcttctgttacctcaagcaatttgctcagtactagtacccttctgacctgaaactttgctcatcattttgtgaatcatcaggcaatggtaccgcgactccgcggagctgcgagaggagtggagaaaggagtacatggaggcctggaaccagtttggtctctacgtcaagcagcagccgcagcagccatgcccgacctgctcaagctcgatcagaaccctgcgaggcctgtgttcctgagaactgctgctccctccattccctgtcctgccattttcacaaaggcaaaacatttgtagatggcaccaacttctgtattgcacatgagcattggtggtggcagacttgtgtgttttgggtagtgtcagtgctgcctctgcaacagattcatcagtatgtgtgtacatggtgaataaaactgatgttagttacatggtggattgctcttctgtataattgtattgttgattggtgtgtaatgcagtaatgcaatgtgcctcttgatatatgcaaaaaattcatgtgaacaaaaccaaacagcaaattcatgtgaatctgccattattgagccaccaaaaaccaagtacatgcacacaccattattatgaacattgcctctaggccctgttcacataaacccctccagctttgcacaacacaaagcctgataggcacacatcaagctcaatctgatggattttctacaaccatacaacacagcataatatcaccaaattcctggaacttgcaatctgttataagtgatataccaaccagtactataatatatgtctgacaaatggtttagcgcaactcatgaaagtcttaacaaccatctactcatctagtaggtaacaagtataagatccacaacttaaagagagatttgcatgcgtgtagacctaaaatatactccacttaaccattgctgtaacatttaatctcacacgatatgtttctaggatagtgatgaagaactccatgctgcttgcaaaaccgaagccatcattcagtcattgcgttcggcattggcctggaggaggccatctcttatctgcgccgcgacatccttgactgctccggggccatgggggatgaacactgaggtggacttggaggaggccccaatctccttcatggtgtcaaagtactgggtaacaagaaccatgtccatgatatcctttgcagtggttccagggacattctccgagaaggcgagcacgctgtctctcagcccatccactatggcctgacgctgcctcgcgataccgacaccagccaggtacttggactctgcctctccttcagctttcttgatctgtagtatcttctcggcttcggctttctcattggctgccaccctcaatcttgcagctgctcaacaataccataaatcaagatgttagatggaaataattctgagtacatgttacagaatcaatcaaaacaatcaatgtgtaaatgattatgtgattgatggaaggaactattgccaactcagtattcccaaaaagctattgccaactcaatctttggcgagaagatcgaaagcaagcaacaattatgcagggaaagggcaatggttacttgcctgcgttgatctcattcattgctctcttgacatggacatcaggctcaatatcaatgatcagagtttgcacaatctcatacccatatgcagacattgcctacagcaatcataaatccagtcagtccaaaaacaaatgttttcttgtctctaggatagcaaatagtagacaaaccttttcaagctcatcttcaacagcctttgcaatatcattcttctgctcaaatgcatcatccaagttcagctttggaacagtagctctaatgactaaaagataaacgatgtcgcccaatgagaaacgtagaattcctttcgttcactaattaaaaacttagcaggtatatatgatgctcaaaactgaaactgttaacttcaactagcctagcaaagaacacacgaagacaaaactatatatgaaaagagatggggacttcgacatgtgaaatagaattttcagacagatggaagtgcagaacatttaccatcaaagacatacgactggatttgttccctggtgttgcttagtttgtagaaggcatcagatgccttgtcagcaagagcacggtattgcacagatgcaacaacagtgacaaagacattgtcctaaattcacaaagatccatacattagagctaggaaaaaatatacctagtgagttatctcaaaaatgttaatgaaatatttctgttcttcactcatactgagttagtgagttatctgggtttcactttataacagaaatatgttcttcactcattgttcactttccagcaaagcatgaaaaaaagaaaaaatagaacgagattggagtaaacctttgtctttgtttcgcagcggacatccagctgcttcacacgcagtgagaggtaaccagcaatttgctgtcctatgcaccaaggtaagaagtggcacccaggctctagaacctcactaaacttgccgaaattttctttgatggctacagttgactgatcaatctgtactaaacccaaacactgacccatgtcttacctgcaaaggaaaacgacttaaacttgaaagatggttcagatactgcagaaagtataattttatttatttatcatctcacaagtgaagcttgcaatgcaaaatcagtgaaggtatcactgaaaagcgaggctacaaattttaggatatgcttcacaataatttgtacagattgaagttaacagtcccaactcccaagtaacagttagaaaagtgtgaatcatgcccaatcagaatgacattacatgatgacaaatataaagtagttcgtaatgcagctcaatgctttgaaaattagtaaatctgagacaccacaaaacagctcaatcatatcaactcgtggcacaatatcaaattcatcccccaaagaactcatcccatctaattatttcaaataagcgcatgcttgagacagtaaaaaaagtggatcatatgcaatcaaaataataatacatcatggaaacttaaaatatatatatacatatgaaacaccacaacacctcgaaaaataagtcacaaaaaaacattcagcggtatccgttagaaaaactcgaatcactaaaaccaactgatcagatcagtaagcaccgcaagacaaacgagtgttggcatggcgcactaaaagaacactgggatcaaaggaaacgatcgccaccaagatgcaaatttcttggccacctaaaggcaaactaaactagcacacccaaactacataaacaaacagatccatcacacaaacccgcaaaaacgactctcgaaccaaagctttttagtagggtttaaacacgctgaatataccccacaaaaaagaagaaaatatttcttccactttaatttttcacaagcataaccatctcacaaaatccccccaaagaaccccaggcccgtgcccgcattaccaaaatccatctaatactcggagaggagatgaaaaccttcaagaaatcctcgaaaaccttcttaccttcgatcgaggcagaggagaatccgacgaagaattcaaattcgccgaagtaaacactgagaggagatgattcgtgagcggttgcagctttgatttgctttggggttttgagagctccatcgtgtgggggtctatatatacacacagacgcggccgagaagtagaggcggtgctctttaatttaattaattaccgcgatggacggcccagatcttctctcgatgacgatcggacggcggtgattcgcctgtccgtcgaatatggtagtcgcggatacttcttggtgacgggaaaggactgtaattaggaaatagttttatttttggtcgatgttttaagaaagtttctagtagggttttattttggtccatatttacaatgtcctgatcgatatatttattaccttttcttttagaaaatgagataaaatttgggactacctatatttatagttatagcatcatatttttcaccaaaaaatagttgacatgtatttacattgtaagttcctaaattacatatgtaattttaatgtaagtcttaaaattacattacatatgtaaataccaaaattacgtattaattacatatgtaagtgatgtgtaagtggggtgtaattttttagataatggaagctttattaagactcagtcaaatataccaagatgatacatttcaactgagctcacccccggcctctgcataaaatgcacacaaccaataaaaggacgaaactaaacccccatcacgaaacatagatgttagtgactatcaatccgtagaatagatcgccacttatgctcttgggtaaaaacatcccgtgccacctggtccaaacgtcgagataccaccgcaatagtatcctgcaatcccggtttgtggaggatagcccaggtacgcagccaccgggtaactagagtaataacctgtaaaggagaagacactaacttgttataaaaaaataaccccgtttctgcttagccaaatggaccaacaaagagctgctgcacccatcaaaagcagatttctcatttctttaggaacacatgaaagccaacgcccaaacatatgagtaacatttcaaggaggttgaaagttagaggccatatgaataacggaccataccaaacgagatagatgacattggaagaacaaatgttgaatggtttcatccttatgacgaaagcaacattttttactgcctttccaattttgtttagctaggttatccttggttagaattactccccgacgtaagtaccaaagaaaaacttttacttttagcggtactttaatcttccaaatacgtctattaatatttgggacgtccgtatgaacaagagctatataatgtgaattgaccgagaagaccccagtgggatgtaattactgtgcaaatttgtataaatatataattagaataacaaatttgactgctacaaagacaggaggtggagaaacggatgttcattgtgcacacgatgtccagcgcagcgcatccaagccattaaaatccaactgtactcagccacgtaatgtagcgacactttttcagcaaatccataaaattttggtcgagaattatggtggtaacattgacaggttttaaatttttggagtatattttccacgaacccaccgggaagtaccgtgtaaactttcaatacgagaagagaaacaacatagactaaaaatatcgtcgattttctaaaaatgagttatgagatatttctaaatgtgcaagcatctctctgtcacatttcctttttatgtttggaaagatgtacaatatatatgaaaacaggaatggtttccaatggtccatatgcaatgcacatatataggaagattatatccctaaatgatgacctgcgtgaattaggaaggacacattattggtataatataatagcactggcacacataattggatcgttcctcgcaagctactatcttcgagtaatacttgaaattgcaagtggcatcctgcatcattacaaggcctaattgaatcagcctttaggttagacgttcgatcgagaggcagtgatacacaaaccaaaccctctgtttggaacaagggaataaaatcgaattttcgccaccaaaattcttccatcacaaacatgactaaatttggagtgctgatttctgagaaaacatatggtaacattctaataaatagattattcgtggacacgaggatttgaaattacaagcaatatactaaagagaacttttcaaagatatatctttagaagcgtggagcaagtaatgcacggcaataatctggtgaatacgcagaaaagaacacaacctcacattcacagcgtgttcatgagccaagaaaatttatgaccatgcaggaaattcaggttttgcaccttccatgaaacagtgtaggaatgatggcattgccttctttaagcgaaatgcaggtaaaaccgcggggtgtgtatcactatccgtttctaggcaaaacgcagagaatcacgttgcctctgctgcaggtctgcaaccaagacttggcttgctgcaagaaaacagtatggctctctgcaaatatgcatccacaagagaacaagagagcacagctgggaaaatgcctatagatcaacaagagggcattttttggagaacaataatgcactcacaacagaaccacattggcatatctaccaaccatttttgcattttagggtatgtgcagtttcgcataaacagtctggtaggatgcacctatgcctcctaaatgatgtaagggcaatcattaggaggatcattgtgtaattaaattaaccaaagctagcttactttggaggaaaaatatatagaaaagggtctatcagcatccagttaaaacctcagtgcaaacatccacaagggaaatctggtacctacagctccttttcacctatatccattttcacatgtcaatctacaggaaagatcaattcagattgcacaacaatgttcagccaagccactcagccccccaaccaagttccaccaactagaccaggattctctagttatttcacgttcggcttgggtgagtagcggaacggggaagcacgggggccatcggacaggctcctcatcggttgctgcccgttccgagcaaatgaaccctgcaccttaagggcatggctcctaccattcatgctgcttgagtgcgccattctctcagcttgcattgtctgatagaagtacgaggagctagccatgtccttgaggttgagcagtggcttgagaacctctaccacttggctcatcagtggccgggctttcgggtcccggttgagacaagcacgtgctaactgtgctgccttctgggcacctttgaccgagaagttaccctccaaacgagggtcaattagcttgtagaagcgctgcctttctcctaggagggggcgtgcccactcaacaaggttgtgctcaccatttgggcggttcttgtccattgacctgcgccctgacatcatctcaagtagcaccacaccaaaactatagcatcactctttgatgtcaaatggcctgaaaagtgaaaaaatacaagaaaattataccaagagtcataatgaaaatcgcataaaataccaaaggcaacaaatctgtgtttgaacttcatttgcacaaataatcattgaaaaacccagtgcccagcattagcctaatattcaaaaagattgttgatgatatgcaggcaataatacattttcctggaaatcaaatgaatgacaaacatctaccatatggacaacatcacttaactctacagttgcactcttagacatatttgttttgcccctgcaaatgtgttttcacaacagtgctgggatttctaatcaaacaagacgcacttgtgcaactactattaattgtaatgacaagtaattaaatattatggtatttcccttctacattattttcccaagatcaagtgtaaaggcttaatatagttcataaatagagctgacattaattacattaatcatagccaaagaaactaattgatacactgtatacatattattaattctaggaagaactaactaaaatattttgtatattacattcacaatattttgtacattaaccactaatctactatatcatgacaattcttcttataatcatttccattccatagatttaagtgtcgccgataagagagaccgaaagaccatagggtgcataagctgatcgttgatgcaagaactgtaatagtaaatcgccatagctgacttgtttttggcatacataggagagataaaacaaagtggaagtggaactatcttcagaccagttatgttttgtctgagtgatgaccagggtttcccaaaccgccggggccagggttaccgcaccccggcagtaagcacggttaccacgcagtaaccgcgataaccgtgaaaaaccatacaaaaccgtgcaaaatttatcaaaactttaaattattttttaaatttatttgaatttaaggaggttactgcggtatttatattaccgtacccccgcggttaccggcggtaacgtcaaccctggtgatgactgatgaagcacttacctgtcataacatactccggagctgcataaccatatgttcccattactcgagtagacacgtgagttttgtcacctacagggccatctttggcaagcccaaaatctgagagttttgcattgtaatcctgcaagagtagcataatatacaaaattacaagatgtgaatcgtgtggtgtgcaatacgtaatccaattcaaggacttaaaacttacagcatctagcagtatattagatgttttaaaatcacggtaaataactggtctttctgcttcttcatgaaggaaagcaagaccctttgctgctccaagagcaaccttcattctgatggaccaagggagaggaagagaccctataggtgaatcataaatcatataagattcaatatttctatctatttaatattttttccagcagcaagatgcaatgaccaaacacttcagaagagctactcaaatatgaatgataagttcattcattaaagcacaggcattgtatacaaattgaagtttcaatgtcttgagaaactggtcagacacgtacttctgaatagatggttatctaaacttccacgaggcatgaattcataaaccagcaatctttggtcatcttcaacacaatatccaatcagcctcaccaaattgggatggtgaaggttacctaggaaatcaacctctgcctgaaacgaagcagaacaaatgtcagtcattgggggttctaatgggaatggtaccaaacatgaacggaacaaaagcaatttgaacaataagaataacaaagcacataccacccattctttgtgcccttgaagcccatcatgattgagtgttttgacagcaactgtaagacctgtaccaggtttcataggtgcagttccattctcttcaatccaccctttaaaaacacatccaaaacccccctctccaaggatactctcaggcctgaagttccgggtggcacattttagatcattgaatgctaacttgcgcaactgtgaggcaacttttatttcctctccagcttagatgctgatgaactgctctcagcattactagtagttgttgagcctgagctaatgatacaaatggatggttcaagctaccattttcggttgacttttctgctgttccatgaaatggataacagttttaatatggcatactaatgagaaacgaaagaccatctcctcagcaataaataaaccccacaacactaattcagataaacacaagtaatgaaattggcaaactgtacagtaacttctgggatacagctgaaggacacagtgaagtgtaaagtttagttttggtctttttgggtatggatcccaagaaaatacgactttctcatgttccattcattcatgtccatcaatgaatgcttaaagcagccaagcagccttgatgagtgatgactcatgatttcaaacaccacatctgctgtcaaaacaccatcaaagtcaggtggctgatcctaacatatcaacaaccattcctgactggagaaaccaatggtgctcatttatgtgtgccgttctaattaatttgctacgagattaagtgtggcatgcaaggagcacgaacaaccacatgccacactaaaaatagaatagaaaccccaaaagaacactcatgccactggtcccatacagtcgctcatccaatatctatcttccaatttaaacggtaataggtagtaatgagaactacagctcagcttgaaatatgatgctggatgatatgtatgatttgccgactgtttaccgataattacgtgtcctacacgcttgtcgtaataattactagtcaatttgtacattcaatgcccaaaacagggacgcgcgcaaagtgttaaggattctaagaacaaaaacaaagctgcaatcagctctctacaaaactatatgcctatgcataggtactcgacatttacattctaacctactataacctcagcgctaatcaaggccatgtggttacatcacatctaaatatccagacatatttatggccaaaatccatttacataacagattccaaattccaattatagtcgttgcaggttagctcatctttagaaaggacgaaagggacgttaccgccgtgcgtgctggcgctgctggtggaggtgtccaccttggaccgcggcggcggtgggcagctccccatcggccacagccggatgcagcacccggtggccaccgtggcgtcctccccgccaccgccgccgccgctgcccttccgtggcagccgccgcctgctgctcccgctgccgctgccgctcggctcccgctgcggctccggctgcggcggcaccacccccacctctccctctcctcctccccggagctctcccacccgtcgaactgccccagctccggcggcgccacccccatccccacctcgcactacacacactttcccaaaaacctcacaaagaggagagatcccctccaccaccaccaccacctcctcctccaaatcgcgcaaaaccacctcactccgggcgcctcggacgcatcagatcggccacaaaaccgccgccctcacgcatcaacgaaagcaccaaaaatcaccaccgccgccgccaccgcagaacaaaatcccaccagtatttccgccgacgaacacgcccacaaatcaaaccaaaccaaatcaaatcacccccacctacaccaccaaatctccctcaaccccaccaccaccaccaccaccccccatcctcacccaacccaagctcaccaccacgcccggcttaccgcagcagctgaaccaggtagacagcaggacagcccacctgcctcgctcgccggcggcggcggcggcggcggaggaggaggaggcggcggcgagaggtggagggggaataagcggagagaataatggatttgcgtcaaaagaaggaaggaaggaggagacaaggaagcggaggaaaagcacaaatgttcctcgcttcgcttcacactctctctctctcttctcttcgcttttttccttttttttttttttttgtgctgcttctcttcttcttctcggctttaggggaagggagcacgtggtctacgtggaccgcttttgcagcgtgcggcggcactgtcggctggggcccgcggcgaggggtggggcccaccgagccgatgtggcgctgacgtggacgtcggcgtaccctgcacttctccctccgtttcgtcattttaaatcgaactttttttaaggtttaattaagtttataaacaaatttaacaacattgagaatgttaaattaggtttattaaaggtaatgttgaatatattttgataatatatttattttgtgttaaaattttgttacagtttttttataaagttagtcaaaataaaaataatttgattaaaaagtaaatcgtaatagcttagtaatataaaacaaagagagtactgtgtaatcttgttgtttttgcagggaatgattggggataggggggaatgaagggctgtccctttgtgagatttttttcttgtcccagttcgtcggtgaagagattagagatgtgaagggttacagtgctactctcgtcgtttcttagtttgattttgttggcgtccaaaaggtgtcacaaactcataatttgttaacctagcgtttgcttgattggttatacacttttattacttctcgaattcgcatatggtggactctaccttttttttttagaacatcgtaaactctactggcatagttatctctaacttattgttgcccacattttatatgacatgttggcatgtttcgattagtgctaatttataccatacgattttttttaaggtaaatgtgataaatatatggatgcatttagtttgttaccaaatattagtaatatctagagaattttggcaacaacacatttagccttatcaaaactttacattgttatcactttactaaaattttggttttgccaaatttttgaaagttcattttggcactaatctaaacatgcatgtctcatccctttgacaaagtgaggtggagcagggggaagcattagcggtgtgatggtggagtcgtgatgcatgtctccgcccactacgattcaagtctagtgtcatgaatattacgcgcatataggtgggttttaatagggaattagtgagttcaa

SEQ ID NO: 41797 - DNA, 1948 bp, Oryza sativa
atggcctcgccgtcctccgccgcagttggtgacgatgacgcggctctcctccccgccgtcctccgccactcccgtcgcaagcgccgcggccgctcccgccgtcctcaagccccggcggccgacgccgccccgtgcccctctgggagagaagatagacagagaagagagagaagacagacaagagagctgacatgtgggcccaagggcatttttgacatttcacatgatttctctcctcttcaaccggaaattattattctaatcgacgcggtgtccattggcaaattaccacgtttatggagtattttcccccaaaagtgagttcgagcggtgttccacggctaaaactacgaagtcgaagtgtcctttagcaaaatttgccaaaaatataaggcacattttgtttaacaaggtaatccgtattatccaagaatttctttactaatatattatttatgtgacactttttttactaatatattatttatgtgatttcaaaaataaaatctaatatttttaatacgaatgcaatcacattaatttcgtatacaaattatacctaattaactaattgttgatcgcccaaatgaaacataacatgtctaatatatttcgagggagggttatagctgctcttttccctcaccttccctcctccatattagcagaaacctatataagagatatgctaattcttgggtagtagcagcggtgaggagctagctcccagacaggtcggacggctttctgggttcggctgctagcgtcttccttatagatagctgttgatgttaaaaaaatcgatcgatcaccaaaaatattagtattcgctcgggtttcacgacatcactagctccatcactggttagtagatttgaaaatctgtgacaaagcaaaacttcaagtacacgttactattaggtaagttggttgcatcgtgtgcttcttgtttttgcatctccgatccatgacgtccattttgctgacgtgactgtcaattattccgaccaaatatcaaaacgttcgtgttgacaaaacggccacatctaacatgcactctcacatgcaccggcaaaacggcgctcgtttgactctcgtggagtcgtggttaatttaatcaaattttcttctttcttctgcgtattccaaatggccattagataaattaagcaaagatcggcatggatttttttttgcagataaaccgatcagcatcggaagatccaagtatgcttcaactgcattgcattagtcagatcacacgtgctcttttggtgtaaatagtacatggtctcacatgtatcttgcattgcattattgccagttcagctcaagacataaacaacggttttagagaaactccaggtcaaatggctgccgactaatctcccaacccagctggtcaacgttgggttccgtctccacatgctattagaaaaataatttaaaaatagcatccaatgtgtcactgacatcagtgacatgtgggtcagtgagttaaggcctcacttagcaacacgcattggatgcttatattttgtaattcccgcatatctgcaatgatatattgagtcatttgtacatttaaaataaacaaaaatgttacatatggttacttttttttctgatgtatgagaataatatgtttctgtacaaccacaaaagaatcatatatgctaaagtcaagacataaaagaatattagtcggcctataaatctcacaatattatcaatgcacaaactaactattatcactggatgcctttgctcccttggcaacctttatgaagacatcctccaaggtggtatcaaccaggccccaggcatgcacggtgaaccgtttcttcgcatcctcaactgcgcgaaatacctcggctattttcacctcttgctttggcagctcgaactttaaagaatcatatatgctaaagtcaagacataaaagaat

SEQ ID NO: 41798 - DNA, 7325 bp, Oryza sativa
tgatcaacactatttgatactcttgtaaattttaaaatcaataagtgacgcgttaggaatctaagaattggacgcgaaagtagaaagggaaaaggataagtactagtaagaacgatcgcacggtttcgcttggcctccttcacaacattccacaagttatttcttgatgcggggtctagcccagtgcttggttcatccatgaaaacgacctacagaatgtgttgtcaggttgcataacacattaacaaaagaacaaaaggacatcctatggaagggttaaaaaaatatacagaaaagtactttggggtctccaatcaatgatattgccacactgagccttcttttcatgcctccgctgtactttcccacttgcttatcaccaacaccaccatggaacagatttacgctcttcagagcatcctcaacagcctaacagtggaaaaatcccagacatggttcaaatacaagatgtacatatgctgagatagctgagcagtatagtttatgaaatacgtgacaaaacaacttcatatggtcaacaatgaaatgtggatattaaatttaaaaataagtgaggcagagtagaggtaccttcaccaacacagcacctttaagattcttcagcctgccataaaagaacagatgttcttttccagtcaatggttcccaaagtaagctgcatttcagattaaaacgtattactataaaaaaaataatctggtctgggaaagattctttttggtcagataagtgctagttgtagcaaatactcatgctgtgggcacacccccatgtttgtatatatgtgatccatatccatattgatatccattccatgaacataggaagtaccagatgtaggtttaacaagcccaatcatctggtaaaataacaaaacaaggttaataaaggtgagctgccacaactaagcaattttcacaaaaaatggtaccacgtgccattttagtactataccatactaatgaaggatgttttcccagctccatttgggccaagcattccaaagcactgcccttttggtacggcaagagataatcctcgaaccgccagcttatcagggtttccatcccttccaggatagatcttcttgaggttgtgacatataatagcttgatttgcattgcggcctaccaaaagttgctcaactacttctctctggatagaatttgtataatgaataaatttagaacatatgtactccattaaatctggactggcaaagtatagcaggtaacctacttcttgagcaacatctggcttctccatatcgacaattactttagaaccctgttgcacaaagctaggcttctgcaatgacggtgtgtgcttcttctgtaaacacctgaagaagaataagggccttttcctgacaccaccacctactggagagacttgatccaaatagaatgctaacataaggagaaatgcccattctactgtcatgatgataaatataccacacattccattgattgggtctctcaaatttccccatgtcatgccagaggctcccatagcacttccagagaaagcatattggccaagttcatatagtcctcgatagagggaaaatcctgggacaatctccattactaacaaccaaccatctgagtagaaaacaaaaatgcttgttacccatattatgtaaattaagttgaaaaatacaacagatataataacttactgggaaaggtcctgtcctcaacaaagaaacgaaaaagaaatgcccctagcaagccagagccaaatacataaatgtatccaatcactgcaggaggaaatatgtaatttgtgacttccagtaagaaacattttggacttataacttacaaggttgaatcactaaccagtggctgtcttgacagatgaaaagaaagatgccacaaaaaatgcaagtgcaatctgcaaatttatataaatgaagaagaaagcaaactgtatgctgtagtcattgagtctgaagaaatttagacctacaaaaaaaatctattgaaatatctagatttatttgtcagaacagcaccttcgtgaaaatagattggaagaaaattaccaattaaggagccaaaaatcacaaaaaatgtcatatagataaccgatagagcaaagaaataagcataagaaattagccagtaaggcccatccttcagaccatgcatcttcatcataatttttagcttttgttccttctcatacaccagatatgtcaacataacctggaaaagagagtcaatttgcaagctgtacaaatcctgaccataacacactcaacactccctttttcttttgcatctgaacttgttaaatcacatcatactcactgggaaaagtagttcaactatccatgtgaagaatagcacactgagaagagaagagagatcaagcctaaaccttgttccaactttgggcatctcttttacatattcaagcagcatatccaccccacttcctctgataaattttaggtatgcattggatatctgcaggaaacaaagcataaattgctgaattgtcagatggttctgtaatacaccgaaattactcaggacgaagttatgaaaaggaaaacatactgcattcaccaatcgtggaactcgtaatgctgcgataaatgaatatgcagtgttatcattataagtagagttgtaccaaacatttatattgaggtcatatcctgtcgtgttcaagaagtcataacctgcagagaacaattaaactatacagcacacatcattgcaaataaccaccaccatttatacgaaaaactacatttgttatgttttgaagcaattatttggagatggggccatggaattatctgtactatgtgtggcattcaaaagcagtctgttggaaggtattcaaattcaaaatgtgaaaaaaaaccactgttacacaaactcattctggttgcaaattgaccacaaaatggtcacattgagatagaaagataacctgcaacaaactcatttgtttctcctcctctttgtacgtaacccttaaacagttcatagttgataactgatgcactttcacgccacaacatctgaacttcaatacactgtatatctggttcattcaacaggacatcagaatacaatctaggcagccctacgaaagagtctaaatgaacgatgaacatattgtatttattgttgtcaaacagactgcataaatagttaggaaaagctacactacacaacgtactagacatgtacaagtctcaccacacaactactatattccattatctaaaaaaactagttgtcttgtttctgtttgattgtattgaaagtagaaaccatgcaaaatgaataacagaacaggaaaatattttttagtcccttcaaatgtaaatgaatttgtacaggaaaagttttgaattgcatatttgcatccctagcctgacttactagcaaagtaacttaagtttttcaacacaagtcacaaattcaacattgcaaagaaggaagctttaacttaccgatatgtaagggtacgccccctgcattgtatggaatggtcccaaacatgaagggcatgcaacgaggctggagaagatgcaaagttttaccagaggaaaaagcgggctctagcaattgggtataccatggctgtgtgtctgaaccctatgacaaatcagtccaaccaataactccataagctatttttcaagaaaaaagcgtgatctacaagatgtatactcatgcagccatcgaaggaactcacaacaactatcctggagaggatatcaagatagtctgtcacttgagagggagaaaagggaggaggcatcaggtagtctgtcacattaggcaacggataaagggcaggaaacacccgacctgaaacacctgtcaattggaagtactcaagaactatgaacacattcacctaattttttgaaatatgaaaagttcaagtattcattttagcaatcgatcagcaatatggaaaatatgacacatacgctcagctaatgtttggttctctccagtgacgaggagagtgacagggcaagacccgtcgccacggcacaatgggttaggcaaatcgtcgaacggctgcgatgcggtcccgacagcccggaaccctggccaggggacctgaatcagggccggccaccgtggtgggctgggcacctcgcagctccatacctgctccagcgtcgagtgctggatgccgcactccttccgcaggcaggtcccatccaggtcactctcggtgcattcgcagccgcactggtacttgggcttgtcgagctccccgttgatcacgttctgaagcacgacgagcagcacgcagatgaggatcgggaagacggtgatgccgacgttcgtcttcaggttccgcctctgcacccgcagccaaagagacaagaatcagatgccaccaccaaaaaccatcaaccatatgcctcccaccctcccaagaacacagatgaaatcgatggctgcccatcatccatccaaaagccccaaaccagagcagcatgattaaaccataagaaccgggcaggcatatccacaaacacgtcgcgggcagcaaggcagacacagagaagggatcaatcggtgcggctttcctggaagcagaggttcttgcggaggagggcggaggcctgggtggagaagctggcggggctcctccccctcctcctcgcggaatcgtcatcatccatgggagaggcggaggcggaggcagatggggagtagccgctacgcttcggcggcggtgaggagaagaagaggcgttcggagttgggattttgagttaaaccgattgattgggtttggtttacttgtcgcggtttatatatgccgtcgatttctcggctcggctcggctcccgccaaatccgctttctccgtcggtgcttagggactagggactgtctatgctatcgattaaattgcacgtacggtccctatactcgtatactactgtcctgtttggagaactaactaagttattttgaaagctactattttttatacaagaaaaaaacctttaataaaatatccctaagttgttctggatccaaggattattttgagagctatttgacctttgatgcactttcctatgatttagatttatgaactactccctccgtttcgaaatgtttgacaccgttgtctttttagcacatgtttgactgttcgtcttattcaaaaacttttgtgaaatatgtaaaattatatgcctacataaaaatatatttaataatgaaacaaatgataggaaaagaattaataattacttaaattttttgaataagacgaacggtcaaacatgtttaaaaaagtcaacggcgtcaaatatttcgaaacggagggagtattaaaatatatttttgggtttctgaatttatcatggtgagtgctatatatgtctaaatagggttcactccgcttcgtgcagtgacgcaacatgtcatgtcgatacgtatcatccagggtttgcgaaaccagcggtaatcgctctgccaaggtcaaaatcgtggtaacaccgctaaattcaaataaatttaaaaataatttaaaattttgataaattttatatgttttcttgtgatttgccaaggtaaccgcgtgcttatcactagggtgcgctaagcttgctcccgttgataagggaaaacccgcgcagtcacatataaaaagaactaaaaatatattttcttctctctgttttttaattttatttttctatgtaactgacacgtgggttccactaatatatagatgccaccatggcatgccacgacatgttaaaaaactaaatatgtgttttgagagcttaaggaaatagatgacatatctacacaagcctatagacacccgtgcacttccctctgaaatttatatgtagtacgcttagtgtgtaattatattgtaatttctataagataaaactatagtactaactttcaaaacccagtaataacgcattatttccgtcaagtgaaggtcgtggggccaaacccattcatcccgatggcgtgcgctgtaattttttcatttccctcctgcattaatcttgaagcaaatataacgattcaaaattatgtaaaagtcgcatacaagttaaatagcaattgtgtataaattacaatgtaaaattattaggagaaatttatcgacaagcaaaattgtgttgcttattgacatgaagtactgaccatagcggtagtatattgcattattgttgttaccctcgtactccctccgtctcaaatcaaatgcgagattgatttatttttttgacggagggattatttaggtcatagcagtagtagatctacaggatgggccgggtaagggttggagttgggccaatcaaaagcacaactttcatgggccgagcatatttgtccggttctggcccattaaggatatcgggccgatgatttgtgccagcccgattaattcgggtgaagttgatgctattggaccttttttgggcctgtttttctctctctctctctggtttaacttgcaagaagccattgagacggtgtagggcaaactgaattttatgacggctgggatgtgacttgtgagaattatcgtgattcaaaagggtacggatgattaaaaatcaaacggagttttatgggaattaagttgatatacataaaaatacgttcttttatcatttgaataaagatgattaaaattctcatagtaaaatgggaaaaaatatttgcttcaaaccagtgcagatggtatattgattagtgaaactaccatagtactctgcatttttcttgacagataatgtcattaaattttgatataatattcgaccattcatcttattaaaaaatgtataaacgttattattagagaaacttttaaacttgacttatcgttttgcgtgcgcacccgcacacatatatttttttttaaaacaacatgcccaaagttaacggtgtcatctattataaagaaatatataggttcaccctatccgtgtcacgaaaatttcttgcgcttcaaaggggtcagtagcatactcatgatgggctcgtcctaatgttcttcttctgagtttgaaagatttgtggaggaaaagtggagggttcaacttgctataggaattgataccagctattcactcattcgaaatggacgattggggtataggacaaatagaggaaatatatctttgctacagatttcaaaggaaaaacttagacatccactacaacgtactaccaattcttttttccttccctaagttcaagacaaatcaattaatgctcaaaacatcctgtgactataattttttcaaaaaaaa

SEQ ID NO: 41799 - DNA, 725 bp, Oryza sativa
ctctttctcgatccagcgtaattacagagtattaggatatcagtgatcctcgactagttaggccgccaacagataggggtgaaaatagggcgggtattttccgtccacccacccggccacattatttcgggacaaattcgggtcaaaaattcgggtacctaggactttttacggatattgggtccgaatacgggtcttttgtggatacgagatcgggttcgggaacataatatctgacggatacggattatccggcaaaaaatccgggtattacccggataaatattcggatattacccgtattacgtttctgtgaggcaaaaaaatctcagaatgaattcaaaggtctgatagcttgtaatgctgtataatgcctctaatttggtagtgcctaattattaagcttgtttttatgcacctgttacttaaaaatatatcccctcgtacaaaattttcttatagttgctcaatagctgtaggtttaattgtttaaactacagctttgttagggtactgacagttgtggcttgtaggatacctggcctgtgtgctcgctgttcaagtaccggaactctggtgcttactgaaccggtttcaacattcagcgatggtgatcagcctttatctacgccaagaacagagacgtgcccaaattgttcgggtgcaggaaaggtaaattagccttctgcacaatgatgtattgtattattcatgaactactgtac

SEQ ID NO: 41800 - DNA, 1093 bp, Oryza sativa
catcacgcctttgctcgccgcgtcttcccttcttctctctgtctcggccttaactaaacccgaatcttttctcttaatcccgcgcgcagtgcacgaatctcaaagcggccccggctccttccccttcaccggcggcgatggcgccggctccggctccggcgggctcggcgaccagttccgcgggcaggcgaggctgccgcggttcgcggcgccgcggcggtacgagctccgcctccggcccgacctcgacgcatgcgtcttcaccggcgacgcgtccgtggtcgtcgacgtctccgcgcccacccgcttcctcgtcctcaacgccgccgacctcgccgtcgaccgcgcctccatccgcttccaggtagtagatatatagacctctctgcaccttctcctcctcctcctcctcctcgccgcgccgcagtctcactcgccgtggttggggttggttgcaggggttggcgccgacggaggtgtcgctgttcgaggacgacgagatcctggtgctggagttcgacggggagctgccgctcggcgagggcgtgctcgccatggacttcaacggcacgctcaacgatcagatgaggggattttaccgaaggtaatttttaatgcatttaaatcaccaatggcagtggcaagttcacagcctgaaagctggcactttcgtttgttgaaatttctgctttattccgtgaacctctgttgaaatgctcggaatcgtcagtgcaaaatcgtggagttgtaggcaaaggagataactgataaatatatagtctgatggtctgcctactttgcacttatattgattgtgattcacaaatcagttgcaagaatacttttctatagatgctgagggctttttatgcaagcatgtggttggaaagtagttatgaatctgtgctttgggtctatttcgacaagttgtgtgtatcatctacattttcatatgagaaaatgccattcgttgcagtaaatatgagtataaaggggagacaaaaaacatggcggtgacacagtttgaggctgtggatgctcgacggtgcttcccctgctgggatgagcctgcattcaaggttgatgaactact

SEQ ID NO: 41801 - DNA, 7059 bp, Oryza sativa
  unsure (1)..(7059): unsure at all n locations
ctgcaagtacctcatcaaatccaaactttggatccaactaaacacagccttggtaacttcaacaatactgtccctagaataaaataaaatgatatgacactagaacagagaatagcttagtactaactacccggctcttaggataaatcgtattgactatacatgtttttcttacttttccaacaagtgctgacctaatcccaacagcaaactcactttcaggctttcagctattcccaaataaattttctgaataaagtcatagacatgacaagataacgttcacagatcaccacaaataaactttcatttcaaccaaaaagaatgcataaatcccatttgtatatgttaccatgaaagagaacataatgatagtactggtaacagatactatgattttgtatgaactgacatgcctcttctcttcagtgggcaatgtcagtcaggctgcaatggtcaacacagagaatcaatgatttgtggtcaatcacaaacaaagagaataatccaagaaccaaatcctaaatcctgcagctaaaactgaacttactagttattacaggtgtaattaagtttccaaagggccttgctgggacaatcatctcatcacagatcatctgtaaatcagaacatcctccttggttgaatagagctgcattagacatgttttcctttcccacaaaaatgttctgtcaagcaagcactatgaacagaaacaaactagtctgtcaggaaggatcaggatcatgcagcaaaagaccaaaagtagttattccggtgaaacagttgcttcggctattcagaacatttgcataagatgaacattagcgatgtaagatacaatgtgtctctcaacttacaaaaacgatatacgagaggttttatgacagtaataatgcccaattttaactattatagcgagttgactgtagtcaacccagccgagtcaacgtagaactcacgcaggatccacactttggcagccaacctttcttcttcctcttttcccctcctccatctctctaggccgggaggcaggcggcatgcctaatttagatgggtctaatttgggccgctaccattggtagagtccaaaaatataggtgggccggatttagtagtcgcgaagtaaattttagcgggcctacatggactaggcttggctagctatctgtctgatagattagatattttgctaggtgggtgctgacgtgttcacctttctctcaaccacacgatatctcatagtcttttactccgaaagttggaggttacacgtgtgctacaaaaaagtttcgagtcacctgtatgccatgacacaaattttcgtttacctatgtgtcattccatccaccttctgttagagaatgagctctgatatatgagacccacatatgaaaatgaccaaattacccttgaagcattttcatctctactactcctctcccgtgcaatgccctagcctagccgccgcctctcctcgccggcacgccaccgactctctagccgccgccgccgccggtcgtcgccggcacgccgccggtctcaaccgccgccgatttctctttcaaatgttccaaatagagcaagggcaaaatagatctttcaaacctccgttagtctccgttagtgttattccatccaaagtggcgcacaggtaaacgaaagtttatgtaatggcatacagatgactcgaaacttttttgtggcacacgcgtaaccttcaattttattaatggcgtaggggtaaaagactcacgatctcaaattcccaatcgaacggcggacacgaaaccaacgatccattttaccctccccgtcgccgccgccgccgccgccggaattccgccggcgttcacgcgtggaagcttcggacctgctcctccgcccccatccgatctccctggagcgaccgccacctccaaagtccagaagctcagcttcaccgcccgaggtcnatnnccgtngnncagngttncagnnnnagtgcccccccccccccccccccccgcctccgcttcgtcggcggcgaggggcgacgagctaccggatgcattaccagaatcagcagccaatcgagctcgccgtcgcccgcccacatccacaccagaatctgcagccagccatgtatcagaggtagtattatcttacctgcaatcctgcattatatttttgtatggttttcccgcacgatttgatctttggtactccctccgtttcacagtgtaagtcattctagcattttccacattcatattgatgttaaaagatctatccatctagatttattaacatcaatataaatataggaaatgttagaatgacttacatcgtgaaacggaggaagtatatgtgtagtaacaatcagtctgtatgctcataaaatggtgtgtttatatatatttatttattttaagaatcaaatgtataagcgattcgaaagaagctaacaaactatgaggttcaatatatacttgcacaactgcactaactgaataattaacaatttattgtacatatagcctttgtactcttcgcaacttttatcttcgtcgccttcttggatttatgcttcagcggctgcgtatgtaggaggtgtttgattgatcggaaacataattggtatgcaagcacttgaacaagacaatcctttgaagttcatggcaggaaaaaaaaaagcaaatcttcttcacaacaaaacaaaaactccctgcaaaaaattgtgcacaagacgtcaggaccttcagtggaaaggatatacttttgaaaatcgtcatacttgtagtaactagtaagtataaaaaaaatgcttgttctgaataccaaaaatatcagaaattttatgttctttgagatgatttttttcctgaactaaccgttcagatgctgcattgattaataaccttaaaacttctgcgtccgtgtttcaaaaaatatgaaaattttcaactgaataaaccatgggatataaacaagtgtttgtttgagaagtagattactgtcaaatggataagaaagaactagaaaagtaatctatgaatatgtgatgacttactagttacaattcaaatcactgttcccatattttcagcctcttgcaagcaaatatgttgttcttgatactgcagtaactttgcaaactgaaaataattggaaatgggatgcattagcatttaaaaaaaaagaaatatagcagtaatccatcatgagttagaccaataatacctgagatgctttgaggtcaagctcatcccattcaaaggatggatttgtaccttcaacaattccggcaccagcataaactaaagtgctatgaccctagaacaaacaacagcttggtaactaattggcccttaggatatggtaacaacatggacatatttgacaaaaaaacatcacatcccaattatatgatcaatcgtactgactacatttttttcttacttttcctagtagtgctgatctaatcccaacagcgaactcactttcagctcctccaaaccaaccaacaggtccagcatacattccacggtcaaaaatttctgatggacataacaatagaacattcactgatcaccataaataaaccttactttcatcaaaaaatcttttatcgtcaattttatttgtaattatgaaaataacaatatagttgcaatagattatagaggcacataccataatcttgtatgaattggcgtgcctcttcagtgggcagaccacaaacggctgggctcggatgaagagtatttaggatgtcaaactgcaatggccaggccaacacaaagaatcagatcgggtgtggtcatttttttgacaatatggtaaattaaaatccaaaattcttcttgcaagtaaacccccaaaaattctgaaaattccaatataaaagactgaagaaagccctgaatcatagactacctcatcgtcttcattcctcattcttgcagctaactgagctgacaggtgttgtactcttggaagtttccgaagggccttgctgggatggacaaccacatcatcgcagatcatctgtaaaatataataaattccttggttgaataaaactgcactggccatgttttcccccaataatattcttgcaactaggaacaaaacaaactatgtcagtatcatactaaaaaaaatcagtcagtgtaaaactcaacttgcctccagcttcttctttatgctgtcccgtactatagtaaattcattatcctctttgctactgcaagaaagttttatattaggacctccttttattttcttcacggacggtgttgatatcgccttaaatcatctggagataggttcattatatgtttatgaatcgaagaagggaaaggtaccttagtagcaaatcttgaccaatttgaaagtcatcagcccttgttttcccccttgctcgtgtaccagctaaagcctcgctggaaatgtttaagtatttccgatgaaataattgctctggctattcagaatatttgcataaaatgaacattagttagaacttaggtcattgttatttaacatgagaaggccaaaataagaaaaaacatccaagttcatgtaaatatagtaagagatattctaataaatcatttggagtaaaatcgatacaagagatcacacagaagatgtgatgaaggaatttgtttttcagaatagaattgacatacactatttccaacaaatgcaggagcatcaggtggctgtatacagaactgataagcattttggccctcaacctgtatattcagtgtcagaaagatctaattgttttaacagcaatacaagagatgcaatatacctttaaacatgccaacagttcaacagggtcaatgcaagtatcagtaatatatctgctacaccttgccagtacgacctgcagaaaatatcgatgcaagcttatttcaaaataatgatcacaacatgacttgtctagatttttttttcttttggggaataaacttgtctagattttttctttagcaaacagtaaatgaaatgaataatttacctttactaattctctttgcttccctttaatcatctggagagctttagtaacggcaagatcccaggatgcctttgtggggacatgattaagatttagtatggttgtttgcagggtggaattgttcactttaattggactggatgatatctgcagaaagcacaacaaggttactatcttccacagttccacatgactgacagaattggaagaaagagaaatgcataccttctgcaaagttgattggagctccttcacagcattttgccatgtccaagaaagtgaatcatcccatgcaatcgtcgttgcgagaaccgagctctcttcaagctcattgtactcaacctacaccaagtatcagaaacacttcaaaggagtcagtatcacattccatctattccaatccataactggggtgatcctggtaattaagtaaggacttacttgaggaacaatgaagtaaaatgatccaaattcctcccattcaactgaatgatcgctcgtggcatcgaagcggatagcaccataagcacgaatcagtgggcaatcccttggaagaaatctttatggacataaatcaagtcattgggtcagcaccagcatgaacctcattggaataaaaaaaaataaaagcaatcatgaagcaacaatcaagaaattcaaagataataaaggatcatgtgaatagttcaccatcaccaacaacacagtaggagaccatgtgaagtgttcactgacacagtatgggccaagaccagcatgaagctcattgaaataaataaataaataaatttataaaaacaatcaaggaattcaaagataattcaagatcatataaagaattcactaacacagtgcaagatcatgtggtttttttttctcttgaacacacgcaaaagttttgtgcttcatgataaaggagcaccagagaaaagtgtcttaaaccaatacacaaagcacttccaagtgagcatttatcccttctatttatttttcaggaagaaatcgccgtaaatttcttattaatccaactgaaatttatcaaaaaaattactagcaactagctgttcatttacttcttaaatttgctacgcatggttagtttctactattgtaatctctctatttttttaaaaaaagttaataacatcatatactaccccatcctaaaatataagtatttttattttttgaatagtgtaaatcaaacatttttaactttgactcttaatagcaaaagaataaaaagaaatatgttcaaaatcaataaacggagtatggtgagaaacgtccagggtctacagctaactctatagagtggtgagttagacaacctaagtttgaagcttcaccccttctaataatttgatattaggtcatttcctaatattcatgtctttttagtaggaacatatcctatgcatacaaactttttgtgcacactccgtgcacaataactagcaaatgtcacgaaaaattctataaaaaattgtacacatacttcaaacagtattacatctatatgtaaaattttatcttcaaatttattatattttagccgtaataaaaaatataaaattctgacagatttttacccttaaaactgtcagatttttcatcttttgttactgctaaaatttaatgaatttgaatacgaaactttgcatatatgtgtaatactaataggagtaaatgtctaattttttgtagaacttttcgtgaaatttgctagttagtgagcacgagaagcttatgtgcgtaggatatgtttttagtatagtcaaagttcaaaatcaacatttatcatcatgtattaaaaaatgtagtagtagatggcaccatcgattacctcttgatggcgcgccagtcgcggagggagaacggctcggtcccgcggaagaacacggcggacccgacgccggcgacgctcaccggccgctgccgctgctcccctccgacgccgcctgctccgttgccgttgccgttgccggcggagcgatggcgagggccgggcactcgggcaagggagcggcggcacgcgc

SEQ ID NO: 41802 - DNA, 5714 bp, Oryza sativa
tacagtacttcatcaagtctaatgtagcaagagttaatggtgagagaggtaaaaagataaagaaattatttctcatgcaagaaattatctctacacaagaattaagaatgaaaagatactatctatataagaataaataggtggataaaaagagaaaagagaggtgattggatgggaatttaatttgaaggcacccaacccaggtcatccccaaccctttattatcagtaatatgtttcctcctttggaagaagaaagtagtgttgaataatttaagaaagtagtgttgaataattttgttatcttttgtctcgtctctattatataggagtatatctgaagtccgcatggtacacgaaatcaatcaatcaaacttatctgaaaccattttttttcttttccgacagattttaaacaaatttgcatgcctacgtcacttttatgttccaaaggatattataaacaattcacgcgactattcttttacttttccgacagattttaaacaaattcacatgcctgcgtcgcttttattttcaaaaggatattataaacaattcacgtgcctacgtggtgtagccacagaatgattttttacgtctaagagtacgtgtaattgtacaggtatttagacagggactgaatatgttaatagtactcatttgctcagcatttaaaaccactttactagacaccttgacaagcatataaacagttagtttaattggagcaccataaccacaagcacagtgtggacaatgacagtgtgaaaatagtaacaaaaaattgtcacctagaagcaagttcataattttgccgagcttgaattattggggtgcaagggttgctcattgaacaagtgctaacaccgataacagaaaaaaaaaatcctcaaattaaacatggcagttcttggaatctaatagactgcaacaaccaaaagatgcgcatgcgccaagatgtttttcaactcatctcaatttcatctttgaaatgtaagtacaccctgagaaaaatcaaggcttgagggccaccgcaatgccgacctttgagctcttgtcaatggccttggtgtcaacttctgctgagatggtccacacagactttggcctccactcgtgctggagcagcgcgctggccttgccggaattgttgaagcgggccttcacgacggtaagcgggtcgagagtgtgctgggtaccgaaggtgagggagttctcgttgctcgagaagctgtgggtcagctcagctccaacagctgtggccgaatggttcacaatgtggtaataagatgcagtgagactatctcccttgttgttcctgcaagacagtttcaaatcaattatggattttggatttttggtaaacaatacaatcaactagcaagtcctacatatgggatcagttatatctatctaaagatgaggataatagagattgatgattagttgatatgagatgcaagccaagatacttatttctagattcaacatatttgtttgattttaataaaagaatgtaacaccaaacgtcagttttcaatgttgataaggtgtgtattgtgcaaagtatcttgatcgtatatggtcaactaaaatagtagcggcttttgaatggagatcacaaacatggcttgtaaacattatcttgctctctgtagttaacgagaacaaggaaacatgtcaactacaataagatattaacattgataagtttactctattttatctcatgtttcctaccattattgaaagaggtagatcatgaaacctgataaaaatatatatatataaactctatttgggctataagttgttcagatggcaagaacagacacattgcttctagcgggacagatggaatggtcaataggatgtacaaatgtggatttcacaataacttaaagagttatgaagttagaagatgatgaaggtaacaattcactgtaagcccaagacacttacaggttcaatgacgcgataagatcatcattactgaagctcaatccagcattatatttggtcaagttccccgtggcggtatcaagtgagacatcagcaccaacagcaagagccttggttccaaaaacactggagagattgactacaggactggcagtcaaaccaatacttgcactaacaccagcataatcatgcgagtattgaagctcaaactgaaaccaaaaagagggagagtgaggacaaccaaccaagaaggtttcattgaaaataagcagtaatgtggtgcatgagcaaattacctttccagatctttgatccggaacagcaaagctcaagatggacttcaatcctggtgttagctcatcaacggttacagtagtaacaacctggccaaagatagaagcagtcaatacaaaaaagggagagcatggcataacagctaatcacagaacatattgctcaatgcaatcaaaactagtagcatattcggtacgaattcgtcagatggcaacgtaaaatcatttcatatagaacaaggattcaaaccattgcaatgtagcaggcaaccacaaaatctaaataagttgtgtgcaagtttatttgggtgtgtctgtgtatttcatatagaacaaggatttcagaccattgcaatgtagaaggcaatcacaaaatgtaaattagttgtgtgcacgtttatctgtgtgtatgtgtgcgcaagcgtgtgcacacgatgtgtgtgcgtgagagaaagagtcatacatttgagtctgagtttgctttcacatctacagtgatgttcttgttctttatctgtgattggatctcaccaaaaatcagatcagccttctttgtactggtagcagtgattgcctgcatcaaggaataacaagtcaaagagctaaacaaataacatcatagctgccacaacaggcatgattgtatcaaaatttacaatcatacaggaaaagcaacactaagataaccctcaaatatacaccccaaccagtcaccacctttacaagctatcattacgaacatgtaattgattagtacagcctttagtagtttaggttattccaacaatacaagacagttttgtgtttattatgcacaaaattcactttcatcaatgcttctcttagcaggagcacacttcaactattccacttacaagcacttgcatgaagggatttctcccataacttttagttttctttaaaaaccgtaagcataccaagggcaaagtataataattgcataatgtaccaaacaagagtcctccctgcttcagtaatagacttgctttcttaaataaagaagactaattaaactaatgttctgcaaccaacaagttcatgttcaaccctctttcaaaacaatcaaaccaccaatcagttgccaagcatgctgttgttttaacccaactccctacctatcattatcaataacaaaaaagacctacctaggatatagattactcctaaatcattttaccactatccaagagataatctctcgaacaatcttttagcttacaaatcccgcgtctcactaagcaacaggtacattgctaatcctcctaaacaagcgaaacaaaccaaggcacaagcgagacctggcaaatctcccggcattcatatacctcctacaatccactaactatggactataaataaactaatccatcgcaaagatcacacatcacacattaacaacagcaggtaggggcagtaaatcacacaaataaatcaagaaagcctcttacatacaacaagtcaacaacaaaaaaaactcgagagcacttacgacgccattgctggtgtaggtggtgagggtgaacttgtggtcggtctggtagtccctgtacagcagatctgcagcaaaaacaaacaactcatcatcaacaacaaacaaacaaacaaacaaacaaacaaaaagaaaatcaaatccaagaaccaccaaagctctaatcccacaagagaaggggacgcggccgctcacccctggccttcttgccgatctccgggtacaggcctggccccaccatctcctcgtcgacgacgcgatgcggcggcggatagcttgcgcgggtgggaggaggaagaagaaggcggcggcggataggaggtggaggttgcgggagaggagaggagaggagaaaataaaggcggaggaaaaaaaaaacacggcgcggcgaggctgcgtgtgggccctgataaaccctagatttttatttcgtttctggttttatctttttttttcttcggtttttttctttattttatcctttgcttctgttatatcttgagttcaaatgacgttgttatctctagatgtctcaagtatctaacccgtcctttggtatcatcttggtatcggatttttttttgttgttcaaaattcaaatggtttataaatttgtgatgatatcaggtgcagaatgggttagttcaataatattttaaccatttattgcaaataaatgtaaatactatttcattgaatctaaatttcacattttcataattcacaattgaaagtatattgtatgcctcttatcatctacttgttaacttatcagctacaatattttaaaacttaattttgatgtgttttcatcacaatctaattttcagcactgtcttttacacccaacataatatagatataaaacttttttcaaaatttattataattgtttcgtttattttgtcacgacttgtcagttataactcaaaaggtcaaagcctatgtcaactaataacctggttgtgcagctataattatgtgttgcttttgttgtgccccatagcattttcattttttcagagtagctgaatacacaggctggagatgtggctgtctagcctgctgagacttgagagctagagcatcaaacgggtttattcttttccaaaccatgtgattgaatgtaaggattctaaggcatatattctctattcaacaagatgtacatgattgagcgatgtataatcaaatagtccttttgatattgtgtctaaacttttgatcaaaatcttgtctagctagattcatatgttcttatgttccaaatcacgaatgcattgcaattgtatacagagtgcatatcggtataatggaaaatattgaaaatgcgacaaaggtccatgatatatacatatcttgatccaatggtccaaatggccaatggataataaatacataataccgtgtgtgggtttttatttccattgcagcttaaatgtaactaaggctgtattcttttctttaaaaccaggaaatagagaaataaaatagttcttctgctagattcttatattttcatggaacccaccgtattgcctgcttatacatatatattgtgagattttcaataacaaatacttacttttgccctaactccaaactgtaacttctttattttccattaacacgttttttttcaatctgttaaatggtgtgcgtgtgttttttttgcaaaatcttttatatagaagtttattttaaaaatcaaataaacttatatttaaattttataatcattaatatcaattaattatactctaatggcttacttcgttttagctgtcgtaaaaaagctaaaccaaatatatccaaactaggcctaactcttcatcagccaatgagtgaatgtaccgtgaaagtatagcacgaatgtcatttgaggttccattagaaaaaaaaatggaaaagcaaaataaaaagggcaagttagggatgacttaggat

SEQ ID NO: 41803 - DNA, 2463 bp, Oryza sativa
actcatattttatgtaattagcttatagatatcgcaaaacgtgttaccactgaaagataccataaaaactagtaatttgctaatttgctaaggacactttcggctcaattggagagaaaaaactagtaatttgctcaggacactttcgactcaattggagagaaaaattctttaaaaggatgaggatgcccctaaggccaaaaacttccaagctgaggtcgtgtttagttccaaagtttttttttttccaaacttccaacttttccatcacatcaaaactttccaacacacataaacttccaacttttccgtcaaccaaatttccaatttcagtgtgaactaaacacaacctgtggctagagcgaaaatggaatatgatgtatgctagcgatatacttggggtgatggcaaatttaaagttgcataattttcaaaatttcactccatgtttgaagcatgtggtactagggacattctcgtctttcataagaacttatctcttcaattgaggcgaaagtgtcctctagcaaattatcaggttttagggtatcttttaaccgtgacacgttttttacgatgactaccaacaaatcacacaaaatttgaatgacctgtagcaaaatttactagcttaaaattgatgaagagggcaaaacctacacatcaaaatgtcacttcaagcccataatcctacccaagccaacatggcccaggctttgagggccgtgtctacgtagcccaaaatcaattaaacaagaggttaaggagatgttggtttaggccctgtttcattcagcttagaattattataatctgtattattagaagtaagctgaaaataaacaagtagattattatgatatattattataatctataagctagattagtataatctaataatcttctagggaggagctttttccggattattgagtggctaaagacccactacccttagatgcttccaataatctagagacaaataactcgtagcttattctaaaccagcttattataatccagcttagagtaatcaaatttaataatcttgattaaaaaaatcttaaactgaacaaacaagcccttagctaggcctaatatcccctttcatgatcagttgcctgactccgagtgcagctgcagctcttatcccggcgagtagtccttcgtactcggctgtgttattagtcgccctgaagttgaggtgaattgcatgcttgaattgatctcccaaaggtgatgtcaagatgaatgctgcccctactccttggctgttgtgtgcaccgtcgaacgccattgtccacgtttcgttgtcgatttggttgtctgacttattatcaggcatagtccaatcggctacgaagtcggcaagtacctgggacttgatggcgttcgtggcacaaagcggacatcaaattggcttagctcgactacccatttcgcaatgcggccgacaacgtctttgtttctcactacttcaccgagagggaaggaggatagaactatgaccctatgggcttaaaagtagtggcgtagctttcttgatgtcattattaccgcgtagagcagtttttggatctgtgaatatcttgtctttgcgtcgtggagagcttcgctgacatagtagactggtcgttgcaccttctctctcttgacaacaatgacagtgctaacggaatatggcgtggtggcaatatatagaaataattcttcattaggttagggggcaacaagtacaggtggatttgataggtagcgcttgagtgcaatgaatgcctcttcggcttcctgtgtccatacaaatttgtcttgcttcttcagcagggcaaagaaaggtggtcctcgctctctcatcctagcgacgaacctgcttagtgccaccatgcatccggttagcttctgtacttccttgagtcttgtaggcgacttcatgttctcgattgccttgatcttctcgagatttgcttctatttctctgccagagacgaggaaactgagcagcttgcccgatggtactccgaacgtgcacttctctggattgagcatgaggcggtatcgtcggaggttgtcgaacatttcccgcagattgtcaatcaatgagtcggttgtcttggtcttgacaacaatgtcgtcgacgtaggcctcgacattgtttccgagttggtcactgagtacgccctggaccgtgcgctggaaagtgtttcctgcggttattagtccgaacggcatcttaacgtagcagaataccccgaacggcgtgatgaatgctgtcttctcctcgtcctctttcgccatgctgatttggtggtagccggagtacgcgtcaagaaagctcaacaactcacaaccggctgttgagtccatcggttggtctattcgaggaagagggaagtgatccttgggacacgccttgttgaggtcggtgaaatcgacacacattctccatttcccgttgtgatg

SEQ ID NO: 41804 - DNA, 4982 bp, Oryza sativa
ctcaatcacctccctgggtacccccggcatgtcggatggctgccaagcgaacacgtcagcattgtcgcggaggaaggtgatgagcgcgagttcctatttctcacctagtgatgccccgatcttgacggtcttgtcggggttggcactggagagtggaacaatcttgattgcgccgtccgatttcggcgtcttgtttgttttgctcactttcttgggtggctcagctgtggcgggtgggctgggcgtgtgctcgaccatgtcgaggctccgcttgtcgcattgcactgccagcttagcattcccttgaatagtgattgttcccttcagtcccggcatcttaagcacttgatatgcgtagtgagatgcggccatgaacttcgggagtgcagttctcccaatgatagcattgtatgttgtatcgaattcagcgacatcaatggtgatctgctctgttcggaagttatttgcttggccgaaagtcacaggcaacataattttgcccaatggtttggacgatgactgaggagtgattccatgaaagggttgatcggtgggtgtcaactcgcttcttgggatccccaccgcgtccaaggtgctggcgaagagaaggttgattgagctgccgccgtcgatcagaacttgcgcaaccttgatattccgaatagtgggttcgaccacgatcggatatcgccctgggatgacagcagtcttggggtggtcctcttctgagaattctatcttctgctcagaccacttcattttgggcacagctccttgccacgtcgaacaaacttcccgttccactttcttgtattctcgctttgaggagtatgccgtggaacctccaaagatgtacgagacatggagatcagagtctgggtatgctgagtccgattcctgagcagttgcctcagcgtccttctcgaccacgcgtactcgcttgcctttttccaatgccatgtgttttgcgagcgactttttgaagacgaggcaatcttctagagagtgtatgtccgacttgtgtatagggcaccatgttttctttgtgtcgctgccttatgggtctgggcgcttgggagggtccgcgtattctgttgcgagaacttccgcttgagctttccttttcccactcttgcgatttttcttcttgcttgactcaggtgcgtccttggctggtttcttatctcctccggtcttcggtttgtcgttcttgtgcctcagtgcgtcgtccgcatgagcacattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgggtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacagtagcccccgagtcctttgcagtcgaccatcgtagccttctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaaatccgatatccaagcgacgcttcgtcttccccgccggaactctcgccattttccccactccctgctacagtgtaaagctgcgccggcgaactagggttctcaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggtcaatgggcgccatccgacgtaacggaagagaacttgaaggagatggtggcgcacggcgttctcccagccaaggagatcatcgggtggcggccagcgagcggtgagacttttccgacccctgatacacatgagatcgtagtcttctcgcatttcttctatggcggcttcgctcttccgacctcgaaatttttccgcgggatcctgaatttctacggaatcagcttacatcacctaaacccgaattccatagtgcatatcgccaacttcgtccatgtttgtgaagcctttttggggatcaaacctcactttgccctattccgccggatcttcttcctcaaaccccaaccaaacaagaacaaaccgtgtgtagtcgggggggcaggattccaactaaggggaactctgagtcaaaaatatttctcgatgcccttcaagacttcgaacaaaggatggcatgcaaactggttctatgttcagaatcccgagcctgctcttcccgggtactcttgtcttcctccagtgtaccaagatacttggaattctcttccgatcggagatgaagcagtacaagccttggagttgttggatcgtatgttaaatcttaaagaacaaggcttacagggagagcagatcactcggcacttcattaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcaactgccagtcgtgccatataatgcattcaatccgcctccacaggtatgcatcggaaatcctcaaaccgtgatcagaacatagttttatcttcacgctgagttgactaactatggaagcatcttgtccaggaatatgcattgatgaagtcagatccaccagtctctcagcgccggtctcctcgccaacacaccgctcagggaggcggagggccaacgatcagaccagatccgcaacctcagacctccaaattggctgatcaaacaggtcctcgtaaaagaaagctggtacttgatgatgatgaaggcgacgatgataaatctggggataagggctcgcctaataaacccccaaagcgtaccatgcccaggaaaaaactggctggccgtgcgataccaaagatcagaacatcctccaggtattagacctctcgatatgattccgcttcggcatgtttttctcatgaaaatgatactgaatactgaaagaacactctgcaggaaaccatctgatatagatccatctggaaaagaccctgatccggctatgacagagcaaaatatatccaaggaccccgagccgactaatgaaaaccagccgactgctgaaagccagccgactggcgcccatgcttcaggagatagggccaatccgagtgacctgccgccgactggaaaccagtcggcaacgactgaaacggcaacaactcaagagcccccgactggaaaccagtcggacgcaggccctgatccagagattcccgaagtagaagcgcagacgacgacttcgcaaggaccagaggttggtaacgactcgatagctgggtcttcaggtaaagaacaaagatctcctcacgctcagctaggtacatcttcaggttagttgtcttctcaaacaatggcgatttaaataacctcagtttatccgtctaatatcttggaaacacaccaggaccatcagatgatgacggggaagaaattcctcgcataaaggcgaccgacgactctcgtcctcctatcttgatcaaatggtgggatgagaactcacaagccgccggtatagtcataaaccgtcaaaaagaagatgaagaagtgtgccagctaaagaaagcgcttggagaagccactcgtattgtaaatgtaagtcttccgggtgacagccttcgataactttgttctctttttagcagaaactaaaccatgatccatcatgcagagaatccatcttcgcaatgaggccaagactacaactttggaaaagctggttcctcatttgggaactctagaagcagtcagggaccagctgcatgaggccaaggagtgcgccaaaaagacagaaaaagagttaagggaccgaatcgcccagctccaggatgcaaacttcgaactaagtggttcttcaaaaggtaatcatcccgatctgttccattgatttatgctgtcataatt

SEQ ID NO: 41805 - DNA, 5112 bp, Oryza sativa
tacttgtgagctcgtaaaataataattaatcgatatgcatatgtttgataatatgggatatacgggctgattcaactcttgaagtactctaaccctataaaaattttttgaattcgaatttgtatagtctcctatatccttctcaccagccttgggttatgcagacgagtggaaaatacccgtcccgttttcacccatactatagttgtcaaacataattccctccattccaaaataccagactcaaccactcttaatctaaagaccaagaaatatttattattaccttattgtttggatcacccaaataaatataaagcatgtacccaatagaattaaaaatcttgagaatgaaggatttaaataataataatttaatagaaaagaggtgctagttaatgtcatgcatttatccatgccttatattatgaaacgttaaaaaaaatagttgtgcattatactccgtctgtcctgtaatgtttgtcgtttctaacaggcttgtgaaaattaaggaagctatgaaagtacatatttgcctatgtgccttctcctcgtcaacacgtgaatgcgtgatacacgcgggagaaatccccaacactggaagaaagaggcgtctccacccctaacaccggaaacgccggccgccgcgccagccgccggggctcacccctaagacgtcggcgaggccctcctcctgctccaagcaccccggaggagggagatcccgcatcggcttcatcatcggaagaaaacaaaagcgccgccgctaccgccgccatcccaattggtcggagccgccggcaccctcccccaacactgctgcggcaccggcggcattcctctcgagccggtaaacgctgtcgccgccacctgtactcgccggagccgccgccgccacccctccttgccagagccgtcggcggcgccattctcctaagccgcagacgctctctcccgacgccgctgtggcaccagtgacgttctttcaagccccagcatccccaagacactggcgagtcctcctcctgcgccgctgctcccactcctgaagtcgttgcctaagctcaccgccacgacaagctgcgaccatgaatggtggggtgggtaggcggcggaaattcctcacgccatggaagaagatggcgcaggaaggcatcagcggcggcggatcatcggccgatgtcacggcgccgttcccctagcagcctcatcctcaggtggcggaggtagacactcagcaggctagcgaccagtggaggatgacagagggataaagatggaaacggtttttctgattgtactacgacgtcaaacatttagactccttttaaaatgaactacactgtcaaatataacgggacagagggagtattatattatggaacggagggagtaataataagctacagtagtaaaaaaaattcttgacccctataaatagtgcagctactctcacttcccctagctaggtagtgcaacacacacctctagcttctagctagcttgcttctccgagcatggccgccaccaccaccaccatgtcctcatccatggcggcgtcgctggtgacgtcgctgcgctccctctcggcacacgccctagtgccactcgtcgcgtcggcgctcctcttcgtggtggccgtcgtgctgcggcggcggcggcggccggtgtacctgctgaactacagctgccacctcccggacgtggaccggaaggtgaacctggaggtgtgcgagtacttcggccagcgctgccgccactactccgacgacaccgccgacttcatgcggctcatctaccgcaagtccggcctcggccaggagacgtacgcgccgcccttcatcttctccggcgagttccagaagacgcaggcgttcgcggtgcaggaggcggaggaggggctgtttgccacggtggcgcacctgctggcgaagtccgacgtgcgcccgcgcgacgtcgggttcgtcgtcgtcgcctgctccatgttctcgccggcgccgtcgctggcgtcgatgatcgtgcggcggttcgggatgccgccggggacgaggacgtacagcctcgccgggatggggtgcagcgccggcacggtggggatcgacatggcggcgagggcgctgcgggtgtcgcggcggggcgggtacgcgctggtggtggtgacggagaacatgagcctgaactggtacttcggcgagaacaagcacatgctggtgacaaactgcatcttccgggtgggcagcgcggcggcgctggtgaccgacgtggcggcgcggcgcggcgacgccaagtacgagctggtgcgcacgctgcggacgcaccacggcggcgacgacgcggcgtacaacgccgccgtgcagatggaggacgaggaggggaacgtcggcgtcggctcaccaaggacctcgtccgcgtcgccggcgcgggcctccgccagcacatcgccacgctcgcgccgcacgtcctccccgtctccgagctcctcaggtcaggtctctctctctctctctctctctctctctctctctcctttgctcttcgccgccataatggctagctgaacgaagcatgcagcctttgattgcgttcaggctttcacagatttcagacgccttaaatggacatgaaaatttgctctttttgctgcaacatatcaaatatctgagctgaaaaacagagcttatgtggtactacactcttaaaatgagtaatccctctctcaagaaaaaaacttaacctagagaagaaactcaacctagagaagatgtgatgtccaaattctcctagaatgctgttctaggagagatcacaggttgagttttttttgacgaagagagtagtattcaaatgatataacgcataataaattcataaatataatagttccatccaacaaatttctatatttatttatttgtttcttcatagcaaaggacaaaacgttcaactaacgaaaagatcatggcagaatccaaactaaaatttaagagtttgtaagagaatgagcaaaactcgaaaacatagaagagcaattaggtgaactctcagtgatgcacatgaaattttctcatgcttgtaacattgctataacgacgacatacgaaaattttgatttgaagaagctttaattttgtaagaaaagtacatgtataattttgagataaaaatatatataataaaccaagctttacgtatatactaattaaagtaactccatttatgatggaggcagtatattatttttcaattccctgaggtgtgtagatctaagatgcgaacgagtttacgaaataatcaaggagaacaatattctatgtttatgatattgcccgtgaagatgtgctatagctaagggaatatatcctatgcacataattttttcgtgcgcactccatgtacatcaactagcaaatgtcacaaaatattctagaaaaaaatggcaattttttaatagtattatacatatctgcaaagtctcgtaattcattatattttacccataaaaataaaaaatctaccaattgttagggtaaaaatatgtcagaattttatcttctttttacagttaaaatataataaatttgaagataagatttaacatgttggtgtaatactcttggaagtatgtgtctaattttttctagaattttctgtgacatttgctagttggtttgtatggagtgtgcacgggaatcttgtgtgcataggatatgttctcatagctaatcaagttatatttgcaaatataaataattattctacaacttagacaaaccaacttataaatgtgtacaaaatcacttcagtacatgattaagcatcgactaaaatatacaattcgatcactattcttccaacaatgcatttataaatacttggggctctccaacgtatatacaagttttaacatataaacaaaataaaacaaaaactattattgattaaagtttggatagaacagtcatcactgtcagttattgaacagtacaggaggtgaaactaaaagttaacattatcactttggtcaataaattgataaattttagtaccatatatttgacgttgtttttttaacaatgcaatattatccaaatattttggcaacaaaatttttcagtgacctttcccatgcatttgaactacttattttttacaatatcttattttatataatctcgaagagatatttcagttaaagttagttttatttgattagatgttactattataggacgacaacttgttctctgatgagcacatttaaagttgtttgtactctacaattatatacaccctccgtaacaaaaaatccgaacggattcaaactcatgagtattttttttttttgacgagggagtatgtaacgagttttgatgctttaattgtacttgtcatctctagaaacagtcccctccccattaaattatcactggctcccgtctttagaaccaaaaatccaaaatatttataaatcaaatcggtcaactctcaagacatgcatataaaattatagcgattttgctatatatttgtcgataaatttttccccaaaaatttgacagatgtaattacagtacaatcgtagggtaattacactgtaacttgcatgtaattacactataactatagtgtaacttatatgtaactttcaaaaatctctctgtaacatgttatttcggtaaaatggaggtcgtgggaacaaattctttcatatatgtgtgtgctatgattttttttcttccttaccaaaacaaatcttgtaatagatctacgtgaaacttacatataagttacactgtagttacatgcaagttacagtgtaattacactacgattgtactgtaattacatctatcaaattttgggggaaaaatttgtcgacaaatgtataggtagtcccaattatagaaactgagccatggtctttaattagttctcgcctagcaccaatcgtttttttcacattaactacatcagattttacccatttttacacagtgttattctattttgctgttaaagccagatcacttttcatggttgtgatatatcgtagatttggtatgatcttgatttaaaatagacaactccacggacttctcctgtggatagtta

SEQ ID NO: 41806 - DNA, 754 bp, Oryza sativa
  unsure (1)..(754): unsure at all n locations
aggagtggnttatgactcccagtggtacagtacttcatcaggttgtacataacatccatagttcaataccaagatcaaaccatgcaagaaaaccaaaccagcaggaaggaaaaaaaaacaaggcaggttcatgcttgaggactgattgctgaagcctcaccttagtctctcttctgttggacaggcacggccaggccatagaacagcagcaccagcatcaggaggtagccgacgacgacgagggcgaccagcctcgcgtcatctctagccagatatgcagagaaagccgagtggagggtgagcacggcgaaggccgtcagccgcagccatggcgatccatcgccatcggctgcggcagaggaagaagaagaagaagcagaggctcttctggtagagttgttcttgcctttcttggccatgaagaacagcagcttgaaggggatcccttttctctgggctctggacaaggtgaaggctgatgctttgctttgctacgaagcttccctgagtgagtggtagactggtagctttcactgcttgtttgccaccacatcagagaggatcaggcctatgtgacaaacaataagctttgttgaatgaatccatcataatagacaacaaagtcaaggcatctgattcggacaacacaagagcctccaagactgcaagtcactgtcacgctaccagaactatgctcaaaggactttggaagatggcatataggaggtattgaaaatttgcatcgatgcaacaa

SEQ ID NO: 41807 - DNA, 920 bp, Oryza sativa
aataattcagctaatgcatattctatgtgcccaaggttgttgcttgaattaaatcattaaccaatagttcattccttctgtgctctagctactttgatactccatatccactccctaagttggacatggttgctattcctgatttcgctgctggggccatggagaactatggattggtcacttaccgggaagtttctttgctttttgatgagcagtcttcatcagcatctttcaaacagaatgtatatatcataactcagattctttttagttacatatttcatcatttatggttcactttgtaaatagtgatgcattattatttattagacattttctttgggacgtccaaattccttcagtgtaagcaactgttctttttaggttgcaattaccgtggcacatgaactggctcatcaatggtttggtaatcttgtaaccatggaatggtggactcacttgtggctaaacgagggttttgctacatgggtaatcaattatacaacactgaattttagaaatttaatatcaggatactactgtatactgaatggttggaccttttatttcgacagatgagccatttgtcagtagattcttttttccctcaatggaatatctggacacagtttcttgatagtacaacctctgctctcaaattggattcacaagctgagtcccatcctattgaggtaatagctgtttgatacatgccatggtctggtactctggttcaatggttcaaaacattgatgcatttcttatggtgtacaccaaatttgtctaaaaccgtaaatgctatgcattatatcgctgtagaaagtagagaatatattgttgtgcaaattttgaccatgataagtgacgctgatgcataatatgctggttacattcttaaatatccactagctaattcactg

SEQ ID NO: 41808 - DNA, 2395 bp, Oryza sativa
ctctagggtgggtaacaatttacaacctgtcacaccatgtacaagttacaggagttggagctatctttgccctttttttgttgatcatatcataaatatgaacaaattgtaaacccactaatatgataaagctccatttttgttaattacatatttatcgaaggtcaattcttgcttacttctttatcttgtttcttcattattgctgtgtgactccacaaattctcctaatgcatcctcttgtactaaacttgtggaactgttactctttcagaaagcattaacttcatatataaaaaagtatgcctactcaaatgctaaaaccgaggacttgtgggctgttcttgaagaggtatctggtgaacctgtcaaggatttgatgactacgtggacgaagcaacaaggttatcctgttatcagcgtgaagcttaaagggcacgacttggaacttgaacaggtaataaattatcgaaaagagtagcgtcattccaatgtactgcacattcatctacttctgaaccacctatatgtaaattcattatgcatatggtttgcttttcctttctattttgccgaggtatgattagtgaggtacaattcctaaattaaaatcctgtatgaaatgtttatgacaaatattacataaaaaaattatgacagaacttcatcttagtttaatttttgtgcctgctatttatgaagatgtaattggctgactaaatttacgttgccctttcagtgcaagacaagttccacaagtagttcccataatatcaaaatttcaacggcacacgggtcaaattctgttttgacgcatttctgacgctctctctctctctcttttttgtcacaggaccaatttttgttaaatggaacctctggtgctggcatctggattgtccctataactttaggatgctgttcacatgataaacagaaaagattattgttgaaacataaacatgataacataaaggccattgtttcgcaatgtgatagccgacagaagggtggaaacttttggattaagttgaacattgatgaaacaggattttatagggttaaatatgatgatgagcttacagctgcacttcgaaatgcattgcaggccaagaagctctctctaatggacgaaattggtaaacacaacctgtggcactattaaatttctattgcaatgttttttttcctgggcgctattgcagcgattaaaggtgttataacactatattacaggcattgtggacgatgcacatgccctttctattgcctgcaagcaaacattgtcatcgttgctccacttgctgtatgcgttccgtgacgaggctgattacagtgttctttcacacataaattctgtatgtgtattttatgttgaattaaattccaggatatcagttattcgttggcaatgatttgtatatatctttactttggcttgtcaggtaacttcaagtgttgcgaaaatatcaattgatgctactcctgacctggctggtgacatcaagcaactttttatcaagcttcttctcccgcctgctaagtatgtttaccatgtttgctgctttttagttctcaatatattatttcccattgtatgttcatactatgtgtatgtttgttaaacatgccttcctttgtggccatgcatacacgatgacataaattttatttgcagaaaattaggttgggaccctaaagatggtgaaagccacctgaatgcaatgctcagaccaatgcttttggttgcccttgttcagcttgggcatgataagactataaatgagggattcaggcgtttccaaatcttctttgatgatcgcaacacttcccttcttactccagatactagaaaggtccttcttttacccctactttacatggtcctctttcttttttgactcatctgtatctttttttacaaaaatgaattgatatctgtatatcttctatttgaagacgaattcatctctgtatattttgcatttttttttcaggctgcatacctctctgtgatgcataatgttagtagcacaaacagatctggttatgatgctcttctaaaggtctacaggaaatcagctgaaggggaggaaaagttacgtgtcttaggttgatatcttctcagccatcttgtgttaacaatgcttgctgatattttgggttatccagacttcctgagggctctgtctccttatctgtaggcacactttcttcttgccaggataaggatattgttcttgaatcattgaatttaattttcacagatgaggtaaattgctaaatggtttttttcttccatgactccattggaaggacctgattgaacttatacttttacattagctacctgtaagttatatacaggtctcatttgtttctcttgcttataggt

SEQ ID NO: 41809 - DNA, 5017 bp, Oryza sativa
caagataacaaaggatggcataatagggtttcatttgcaaaagcagcatttagcaaacatttgagaatttaataaaacagttaagtaattaaacaatattaatccaacgctatacaacataccctgttgtataggcccaaccattctgaacaaccaccccgtctgcacagttctatctccaaaccaggaatattccattccaaaccaggagctaatcaaattattaccaatttaatcatcatttactatggtgagaagtgtgaaactaatcacgaaagacattgttagacccgcccataaccgctggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaaacagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaaagtgtaaatctcaatcttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagagggtttattgcgtcagcgggctagggtttggtgaaccgggcgcacgggcggcggttcacacgaacggacggccgagatcgaaccaatccaaaacggacggccgagatcgatcgggtccacggcggctcacggcggacgaccccgatgacgtcagcggtgacgtcaccgacagcggcggctcggcggaggagacggctcgaacggcgcacgctcgccggcgaacggcggcgcgaggacgcaaacggagggcaccaagacgaagcgggcggcacggcgaactcaccggcgaccaaaacgacggcggaaggtcaacggacggcgacggcgacgaggaggaagcggcgaagctcttcggcttgacgacggcgacgaagctccgacgatctccggcgacggcgaaggggcagacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcgacgggtagaggagacaccggggatccttttaaaggggctaggaggcgacgacgaaggcccatggcggcggcaacggcgaaggaaagctcggcttggagagagggaaaccgatccgaaacgaactcgattccacgaacttccaaaacgatttagccaaagattccaaaggagaaaaggtagaggagatcccggagattgtttcccctctatcaattcggccggagaaggaaaggagcggccggattggaaagcggcggcggcgacgcgaaactagggtttcggccggaggaggacgacgaacccgacaggtgggccccacctgtcagcgggcggacgcgcgcgcgcgcggtggcggactgggccggctgggccgaagagagagaagagaggttttgggccgacgccaaaagaagacttttaaaacctttttcaatttaaattatttcttaaatgcaattccatttattaaaatacttccttagctcaaataaatcccagaaaaatctaggaattatagaattaagcaaagtatttaatgaaattttatctggccactttttatattggcatttattaattaaaactagatcttctcttcaagacttttaaaattatttctaaaaattccaattaaacaacaatttatatattttgaattttcagggtgtgacagcgcgcaagtataccatatcgatatgtgacgtatgtcgaagggtaaagggtataccttacccgtaaccttgacaccagctctgagtaaggtcagaatcatgacaaaattttgaggacagaggctgtgtttagttccttccaaagttggaagtttgggttaaaattggtacgatgtgactgaaaagttgtgtgtgtatgacaggttgatgtgatagaaaaagttggaagtttggatctaaacacagccagaggtgagcgtggtgcgaggagtgagaatttgaagattttttttatattccttattgttggtcataaagtaaaagatagccttaagcttaataaggtcgattcaaacgtacatgtctcacggtgtataatggggctacaaagtgatatttaataaatggtctaaaaaatcaatacttaatctaaaactggacacactttttattttaaaaaaggacttgtcacattggactaaaaaaccggttaaaatatcgcaaaacaatataagttggttttgataaattttcacatttaacaaataatatgttaagttactttttacatacgttctctatcctaaaacaaactaagattatggaatgtgaataaaccaatttagtatgggatataatattttgaaacgtaaaggtatatcgttgagacgaatgcgaagtcacattagcataggcttgagagcacaagatctaggtagagggctatgaaagaattgtacaggatatagccatataggtagtggtgacaatagtggatgggagactttgactggagtgaggaattgttacagaatataatctcttctcacctttgaaccttttgtcagttcctcgacggttagttgatctaagtgaaagtttaagaaaagtataggtgaaagaaattcaataaagagaggaaaaatggggatagacagagaaagtgtcaaatgtactagataccgcactcaaatatgtggcaaacttaccattacaatcaactactcctatatgacaaacacattgtattatatatagcaactttactataccaaattttgtagtttcccaaactttgtactaccaattttttttagaaacaaaacacaaacgctctagactggaagactagaccgacatactgagattaatgaattcaccatgaacaccttactgttgacgggtacatcgtttatcaataaaaaataattagccataaataaaagtaccagtgtgaaatctagaacttgaactcggttggattggttacaccataagaaaactaattagttaaactacactcacttcgcttcgcttgtactactaaaatttgatagagcatgaaaccaaatggctaaattccacatcatccatccgctgatttcacattttaagtttgtaatgatttgtcacgttttctatgtcacgatcagctcagctggataagcctgattaaacgcaaataatgggacttccactaacgtcaccaaacagatcaattcataatatatgagagggccttccctaggcccaagatctggaacacaaattatactacaatctctccgtgaatgaatgaaataatgatacgagtgtctcctagtgcctctccaacccaactagccaagtgacccagcagcgtcgcgcagatgttctgagctcaccgatgtacgatcggatcgagccagcagcagtgccggatcaatggccaggggaaaaaagatcagctgattattggttcgtacatattcacacttattcagtctttactgatggatttgattcaactaaatttatggtataaatctgatatttatttttaattctagccactgcattctttcttcctatattttctttttatttttgcatcagaggacagcaacaatcaaacattattgatcctgtatgtactcggcattaacttggactatactgaattatcacaaaaaaggaagatctgatcatggccaactatagcaaagtgcctaagatcagatcctgatcgatgggagaccaacacaaaagtatacaacaatagaacacacaactgaatctacagggtcaactaagtaattcaccggacacaaatcatcacatattgacacacaagaacatctcactaggagcagagatcaaacttggagaggcacagaaacaaagcttctcacttcctcagaagcccttcccatggtgaagatacctggccttgttaccagccagcaatggcctggagagcaccgggagcccccactgcgacgcgaagatgatggtcgggcagatgtcggtggcgccctccatcgtcgtcgccccggcacggcggatcttggaggagagctccgccaccaccttccttggcaggaggaccgaggtgatcctgctccatttcaacttcttgacatgg

SEQ ID NO: 41810 - DNA, 1254 bp, Oryza sativa
tttggtatggtaaggcatctaaggacctcagcattgaaatcttggaagtggactagaacagcaccctgatagttttagcttttgagaaatcaatagagttaaggagtcatttacaaaatttcacaggggaatatagataaataccttaagaatagcatagataccagggaggccatgtccacatcctagctacagaatcacagagatggataactgtaagcagcaagttgggtacatcttctgagattacagctacttgtatcaaactgaaggacttaattatttagatattccactacaggctgttactaactatcgagagagattgaacctcgaaaacctggtattagtgacttcaacataaacagttgaaaaagcaagtggaaaatagaatgtgataaagctttttcttaaagagtcaatgtggttgtggacatacctcgctttccaaaaagaaaaaactcattctggatataccttattctgttatgactcttgtaaagtcttatttcttttgttattactttaactatcaaaacacaacacagttctactcaaaatatttttaggcgtgaagtatctcacctccaatacacgtttgccttctaaaagcaatcggtcttctttgatgtctgagtttaaagtcgtcaccaagtctagtgaaccttcccagagcttcaacccacctagtgcacacatatatttccaagcttacaaagacaaacagtaagaaatacgttacaaggatcaaaatgtattcagtcctgaccttcatatttccctgggaccaaatcagagtttttgactccaaaaacatcagaagtacttgctctcccctaaaacagtaaggcaaaaaagatagattaagttgaatttgtgggaggatgtaacaatgacctgtagcatgcagcagaacaactagagaaatttattgtaagttccctagaagttattggaacagcgatgaccgagtgaacattatgtttgcaccaaacgtgggtgtgtggaatgtcaccatgcgctctgagcatatgacttaccaagggaggattcaacaaatagctgagagaaccatttcagtgctaacaaatgttcttcatttttgtttggttttaggcagaggggagggaggataagaatattcctcaatgtttacatgattacatccggtttcctctgttattgtttccattggtgaagcatatactgaacatgatggacagctataataatctcataattttctcactcagc

SEQ ID NO: 41811 - DNA, 1259 bp, Oryza sativa
tgaacatcaggctatttttgttgtgtcctagtagtagtgaatttaaatggaaaattttgcaataaaaatataaattaaaatatttccggtaaaaaaacctcaacttaaaacttaattaaataaccctaaaataatcccccaaacctaaagtcatgaacatcaaggtaattgttgtgtcctagtaggagtggattgagggacttgatatttatgccacggatgctataaaacctctctccctccctcgtctccctctccaaaaccctagctttctccttcccctgctttgcggcgcgccagccaatcaccccaaacccctcccagtcccagcgatggatcagcgcaagggcagcggcagcgacgccaacggcggcctggcggaggcgacggcgtcgaggctgaggttcgaggaccccgacgaggtcatggaggagaaccccgccgccgccgccgccaccgtcggggcggaggaggaagggggagagggaggaggaggggaggaggtgatcggcagcgacaagaccagcgccgactactacttcgactcctactcccacttcggtaagcggcgctcgcgctcgatccggtttcttggagatgctgtactgttccgcagattttcttttttgggtgatgataatgctaattaatagagcaatgaagtttttagatttttgtgctgttttagttgttagggggaaggttcgatatctggtgcgaatttgtgcggcctaaaatataacgtatattcatatgtagtgttgttacttggattgagatattatattttggttgttcttgacagtaatgctgtgaaagattgaaggttttttgcgtgttagccgttaagtgcactcgcatcattcatttagtagcaggttgggtggtaacaattcatttttgttttttggcaatggtggttgtatgacagattggtatttagttggttttgtacttctgttgttgatttatcaggactgcaattgaacataggttttttgagattcagttggtcttttgggattttcactttgcactgctgaataattttagcttttgatctgtacaggtcttgagattttcattgatactgtgtgctccggttttgcctaaagttattgtgtaatttattaccttgcgcagtttataatgctcctgctctgttttgcgcagtaactttatgaggtgtacttgtcttgcaggtattcatgaagtaagtgaatctggaagaaatcagcctcctttgttgcaccacagtt

SEQ ID NO: 41812 - DNA, 1130 bp, Oryza sativa
gcgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 41813 - DNA, 2319 bp, Oryza sativa
  unsure (1)..(2319): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctgatttcctcgccgagtggaccgagtgccaagaagacatgccagaggaaaagatggaatattggactatgcattttgatgggtcgaagaggctcacaggcactggagctggggttgtcttgatttccccgactggagaaagattgagctacgtattgtggatacatttttctgcgtcccataacgtggcggaatacgaggcgctactccatggattaaggattgcaatctgtttaggcattcgccggttaatcgtccgtggagactcgcagttggttgttaatcaagtcatgaaagagtggtcatgtccagatgataatatgaccgcttatcgacaagaggtacacaagttggaaaataaattcgatggactcgagctcacccatgtcctccgacataacaatgaggcagccgacagactggccaattttggatcaaaacgggaagcagctccttcagatgtgttcgtcgaacatctttacgaaccgaccgtgcccagaaaagagacagtcgaagccatggatactcgaggcataagcatgatcgaagctgactagagagaaccgtttataaaatttttgagcaaagaagaacttcctcaagacaaaaacgaagccgagcggatttccaggcgcagcagactttacattattcatgagactgagctgtacaaaaaaagtccatcaggaatactgcagcgctgtgtgtctgtggaacaagggagacagttgttgaaggatatacattccggtatttgtggtaatcatgctgctgcacggaccattgtcggcaaagcttaccggcatggttttttctggcctacagctgtgtctgatgcggacaagattgtgcgcacatgcgaaggttgtcaattttttgccagacaaactcatttgccagcccaagagttgcaaaccaacccgttgtcttggccgttcgcggtctggggccttgacatggtcggcctatttaaaagggcagtcggcggttacacacatctctttgtagctatcgataaattctccaagtggattgaggctaaaccggtcatcacgatcacagcagataaagctagagattttttcatcaacattgtgcatcggtttggggtgcctaatcggacatcactaataatggcactcaattcactggcggagcatttaaagacttttgtgaagacttcggcattaaaatttgttatgcctccatggcacaccctaggagtaacggacaagtcgagcgcgctaatggcaagatacttcatgggatcaaagcacgagtttttgaccgactacgtccctacgctggcaagtgggtagatcagctgtcgtccgtactttggtctttacgcacaactcctagtcgggctaccggccagtcgccgttctttttggtttatggcgcagaagcaatgttgccgagtgaagtggaatttgaataactatgatttcggaacttcaacgaggagggctatgaagaaggccgagtagatgacatcaatcgactagaagaagcccgagaagcagctttaattcagtcgactcgatatttgcaagggttgcgccgttatcataatcagaatgttcgatcgcgagcctttttagtcggtgacctggttctgaggaaaattcaaacaacacaggatcggcataaattatctcccttatgggaaggaccgttcataattgctgaagtcactcggccgggttcttatcgactcaagcgcgaagacggtactctcatcaacaattcttggaatattgaacaccttcgttgattttacacttaggcatttcgtttgtatctttcctctttgactgctaacttcaagtttttccttgaagttttcagtcagggggctactataataataatggtgtgtgatttatatcaattcaatttgcttacttgatatatcattgccctgtttgatttcttggcttagtcaatgaggactgaaagttttttaacaacttttgtgggttttaggatcaacaaggtttgacaaaaacttttaagaaatcaggaactaagttaagatatcaagcatagcataaattcatcagtattgtacaaattgtgcctccgtcatcattaatcatcaaaattattgttatatcaatcagtatcagttttttcatcatcagacttatcagaccaagtcggccgaaggtcgacatcttggaatctctcaact

SEQ ID NO: 41814 - DNA, 1898 bp, Oryza sativa
  unsure (1)..(1898): unsure at all n locations
tagcataaattcatcagtattgtacaaattgtgcctccgtcatcattaatcatcaaaattattgttatatcaatcagtatcagttttttcatcatcagacttatcagaccaagtcggccgaaggtcgacatcttggaatctctcaactannnnnnnnnnnnnnnnnnnnnnngctttctgcgcatcactgatgaggtcaagagcagcttcttcgctcgtcccgtctgcaaagccatcgatggcatccatatcaacccttggataaagggatttggtcatcgccaacgccagacttgctcccatacttccagcttctttgatgttcttgaaataagtatctggagtgactctcagcttgtcgaagatttcggtagcatcaagtgtacttgaaccggcgttattgaagaacatggcctggatgaggggagtagcggcattagcgactttatccctggctccttcaagattgttgatcttgtcaactaagacatcaaactgtgcttgagacttgatcttgcggtctgcatcaacagattcacattaatgaatcagcatatataagataatggcttttgaggtattgattattggtaccttcaacctcctttatagccgaatccctctgccttgccagctctgccttgtcattttccagagtatggatctgcttctctagttaagatatcttggcagcttgcactacatcaactttggttaatcaagattacagagataacaaattagttgggcagagtttgcgcgaaccttttgatgagccactcagttcgaaattggactcctggagctcagcaatccgatccctcagatcgtgttcattcttcttggcaagttgtggacccccgattttggaaatcggaaatcatctgtgtttatccgtaccaatccctggatcagtagttggtacacacatacatagttgaatcacaacatatcacgaatgaattcaggctaaaagagttaaatacttacattagggccaggtaggccaacaactatcagagaacaacagcggaagaccaaataatataagggtccggttaacatgccacaggcagtcgactggggaacgagacctagaacaagaccgcactccgatcatcttgttggatacgcaagcgtaccgacaagggtttctcttcaacactctcctaaaagatatataattagcaagggtgagtaccaaccgtactcagcaagccaccacagcaacgatgcatatgatagagggtatttcaaggaatggcttcaggttcttttgcataaagctagttttgcaattcttttcacaagcctaagacctagcatagactgatcaaattttagtaccaatattcacattaaacaacgacggttctgtccactatccattatgatcccaaggatagcttcccgccattgagtcgttatggttttctgagggcgtccacattcccgcctctcaggaagtggctccatcagcataaaaatcatcatgcaatatcccatcccacacaagttaaagaatttagagtctagccaagtgtaatacatgtcccggtgctcaataacaacgagcacggctattcgaatagatttggtttactcacactacaatggatgtacactttacccgcactccgcgactgcccaacacatgcgcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaaatctcacacacatattaaattatggttcaagttaagttctctctcacacacactcatggcagtcctaccaatgacaacaccgatgtaggg

SEQ ID NO: 41815 - DNA, 33293 bp, Oryza sativa
cagtccttaattgactggggacgatactagccttttccagataccacccaaatcctccgtccgccccagtcttaaacagttgttttgattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaacatggttgcaaatatttaagggtaaacaataaccaaggcatggcataatcacaagtaggatgttcatcattgcatgcaatttttatttgtaaacaaaacaatttcgcaattaggatcaacatgttcaaggaatagtgatgacttgccttgctcaggatagtccttattcttgatataattcttgatcaatcttcacctcctggaagttgctgacattgcctcacgactaaccgatacacaaagtctataatacgcgagaaaaaccaatattcaagcaacaatcaaatatgcacaaacaaaatatatttgttgaggttaaacctaaggttgctcatattattcgcgcttgctaatgggttccaacatgctaagggctaaagtttcttaatctttctgttatcatggtggtctgttatcatggtggtctatttaggagctagccaatgtagtatgaatgagatacgtatctggctactatgtggtttagtctagcaaatggctattcatgcatctatctaaatagaacggttatacactagaggttttgttgccggatagatttggatcggtcaaataattactgtgaatcatttgtattattattttattgatggaggctttattttaattatgtacatattttacttgtcaaaataaattataaaggttaacaattacccttgctttgtatgttagaattgtttaggttaatcatattatggttacagattatcccatcacataattttacaatgaataatcctaatttacagttgaactataattataattatatgaggtcaagatttataactagtatttatctaatatacatgtttgtcatacactccctcttaatttcatatatgcaatacgcaaattaatactataccgtaccactataatgggatgtatagtatatgtgtaagcaacaatatcttattattggatcatatatttgagtagtttctttttactgtaagctatacaatacatgttgattttaagatggctctatttggttaactaatggatatcaaccgactatatatatatattctacttcacatgacattgtatcaactaatttttttaagtggtccaaatacaactagctctgtgattactctcctaaacaagttaaagactcatctatgtgtgtttatattttagttacaaaatatgaggataaagtaatatgaggctaaactttatgtaaataatttataagtcatggaattagttatatttggacataggctagtaaatggcactaatattttcctttacacccattaatttgaaggattgattataactaatttatttggttgctacagtgacaagacatattaaagataattatgctactgtacaatatccatttttttttatttattggcacactatttaggttaactattatctaatcatttgatattgattaatttataattataaatatattttattgaatagtgaattatatatcattggaaagcttatgaatttagatgaatttaggttcaagtttcactcaaatccgagttaaaatgaataagttatgctagtgtaaagattcaactttgaattaatccgagaaattgcgaaaagctactgttcataatagatttatttttaatccaagacatatccattgacaagtgggaccccgggtttattcctttttcctactgaattattttctaaagggaaataggaagagctaatgacaagtggggcccacatgtcataaactcgagaccataaaacttctataattagatttttaaccacccggacccacatgtaatagactcaactaataatgattaagaaggggattactattcactaaacacgtggggcccactctaatttctcctctcctttctctctctcttttcttttcttctcctttctctctcttttcttttcttctcctttctctctcttttcttttccggtttctctcctccttccctcttctttctctccctcggcttctcccttcctctctctttctcggctccctctctacccggcggcacggcgacaaatagggggggggggcagcggctcaccgacggcggcggtggcgacgacggcggcggcgacgacggcgcacggcgcggcacactgaggcggcggcgcggcggtcacgaatgcggcggcacgacagcacgagggcggcggcgcggcggctcgaaggcggcggcgcggcggtgcgtggagagggggaagagggagaggagggggaacatggagtgaggagaggggagaacggtggctcttataggggagagagggaataaggggaagagggaagagaagggagggggtgacgcgacggcggcgcggcggcgcggggctcggggcgtagcggggctcggcgcgcggtgagggcgacgggcgacgcgatgacgacggcggagcgtcgacacgacggcgacgggacggcgcggcgcggcacggggctcggcgcgcggcgatggcgacagggcggcgcggggctcgagatgacggcgacacgacggacgcgacgcgcgggcgcaggacgacatgacagcggcggcgcgcggcgcgaggcagtgacggcaacgcgacggcaggcggcgcggcgtggggcgcgggcgcggggcggcgtggcagcggcggcgcgcggcgcgaggcagtgacggcaacggcagcgcggggcaaggacggcgatggcgacgtcggcgcggtggcaggtgacagagagagggggaaagaggaggggctgggttaggggacctcgtcgaacacctggcggccgatgaatagtgtcttttcctatttaatccccattttagcctatttttttgtgtaaatttgattttataaatcctagattttgtataaatgaagtttacccaatatttgtgtcattccaaccaatggatttattctagattaatattactcatattttatttatataatttatttgaatttttaattagggttaattcttattattattatatatttttcaaagttttcctatttttcttcttttagggttttggttgatttataaattgagaaaagttgcaaattaaatttgtatttactcccaagcatttaggtgaccgtattaagtgttcaaatgtgaatttgcccaaaatttaatattgtccaatatttaaggtttattaaagattctataattttctaatgagaccgttattaacacaatagcacattacctcaatttatctatatgttagtttattttatatggaggggtttaatatatcaaatttcaatccctaaatgcaattaggaacttggtgcaaaatcgatctacatatcgaattaaatactcccgtaattctattatatatacagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccataaatcatatctattgcttaaatgtagttcttttctttactttcttggtgatcatttacagtttggcaagtaatagcaatcataacaaccagcatgatgcaaaagttttaaaaagttcgaaattttcgtgattttcattgtcttgaattttcaggatgttacagaagttctctggcctcgtgcagttgactcctggtggcttcgaaggttccaagataaggaactagtttctctagggttgcggttttcgcctcgttcctaagatgaatcctttgcggagcagtttaatcagcgctcgagccagacggtaaacaagatggctgaggtcaggcgttaaggaacttacatttacaatgcgagtcgcttgatttagtgcctttttcagtaggcatacctcttcatcttctttttgccggtttattacaattccttgaggttgcaagttgtcatcccaccacttgaccagaatgggagggcacgaaccttcggctgcttgtatgcggggaatttcttcttcatcactgatcattggccctaatgtatccactaacaaaggttagacaattggtcagagttatttgggtcgacatggtttcagacaatgagtggactcggatgcttttaaaggagatccagatctccggtcattgctggcgtcttgtccacgagggttgtctgcatgggttttgacttctggaatctcttcgcttgcccctgtgtccgactggtttccggtcaggggttgatcaccgggttctacattatcggttgccggctgattgtcacttggatgatcctcagcagttggtccggtttctttggaagaacttgcgtccacgttagtcgggttagagtctttcccggacggatctatatcagatggtttcctgcaaatttgattatcagtattattgccgcaatggatgcgcatcaatgcaagagagattgttatatgagttatacctagaagacttcctgatctttggcgcagggcgactggatgctttcttccttggagtagcctgttttggtagtttcttggttgtctctcggtctccaggcctcctggtggtatcatcggcttcgtcgtcacttagaaccagcttgctctttcgagaatctgactggccgactggatcagaagcacttggctgagtttcagaccgaattcttggtcctccactcccttgcccagtttggtggcggggagatcggcgttgagcgattgggagatccgacttcatcaaagcaaattcctgagtgtaatatccttcattgttaactgattcaacaagaagacaagatcatattttgagaaaggttgaagtgtatgaatacgtaccggtggaggaggattgaatgcattgaacggtacgactggcagcaagtgtgagtagctgacaacaatggcgtttgaaatgatcttatacatcatttccttcatgaccttgaagtcaagagaatctgggtcttcacggtttgggtcatgcttgccgtcaaattcgaaggctgtgcgagatctttctttgattggagctaatcgacttttgatgaagtgccgagtgatctgttctccttgcaaaccttgttacttcagttttagcatgcgttccatcaattccactgcctgagcagcttcatctcccataggcaatgagttccatgtgtcctggtaaactggaggaagacagcagtactcggggagtgcgcgctcaggattctgaacatagaaccagtttgcatgccagcctttgtttgaggttttgaaaggcatggagaaatatttttggctcaaggttcctctgagttggaaaccagctcccccaacaacgcacggtgtgcttttgtttggctggggcttgaggaagaagatgcggcggaacaaggcgaaatgaggcctaatgcccagaaaagcttcgtaggcatggataaatttggcaatatgcactatggagtttggattcaagtgatgcaagctaatcccgtagaagttcagaatcccccggaagaatcttgaggttagaagagaaaatccgccatagaagaaatgagcaaataccacgatttcgtgtgtgtcgggggtcgggaatgcttcgccgaacgccggtcgccacccgataatctccttcgctgggagaacgccgtgcgccaccatctccttcagattatcttctgtcacatcggagggcgcccactgactctcgaagctttctctttcttccgccatgaatgtgaactggatgttttaatttggtccgagatatggctggagaggaatggggaatcggagtggtggacgtggggagaaatttcgtgaagtttttgagggtgggttggagcagattgatgaaccctagcttcgtcggcgcggttctgtactgtagcacggagtggggaatggcgagagtctcagcggggaagacgaaacaatgtttggacttcggtgtttttagggtattgggagtactaatgggcctgggcctgtacagtatttcagcccaattatgtttttagcgtggcccgttgtgatccctagggacttaggcgctttttgctttggcaatatgtgctcacaatgatgtggcccgatgctgttaaaatgcttttttacgcgattcaataattctttggaatgattatgatgcacatgaaaaggtgcccgacagaaaggtgttataccatttttgtaagcttttttaggctacaaaagttgttgggttaatttgagatgactagtttattagtagtcattctcctagcatgttatatgcttattttgattatggtaagggttatagcctaggctaatgaacttcttaattaccatgatctttatcatatttggtggatcattttaagagtttcttactcggattcctaccaaatatatctatttttggaccttttgagtgtttatcattcggcccttttcatattttttgtccttgatatattcaagtaagaaggagtcggctgggtattttattgagtaccatgcatgcttcgatataaaatcactcgtttcttgactatatgtttagtttttcaactaatcacatagtcgggggtacacctaattaggtgcatctactcgatgcaccatgttttattttcgcccttcacagtcttttagcactcggcaagccgaagcaagttgaattgaagcactcggattattgttttttgtttcgagaagactattttggtcaactgcgaaggtctcgggggctactgtggagattatggttaccccatatctacatggcggttatattccagctggatatacggtaccaaatatagatagaatatctttatgaggactcgggttagattctaaacttgtatgtcaagaaaatacccgggatcctagtcggttacgattgtattttatctacaatcccatattccgttaggatatggactgtactttgtaatacggatcccttcccctatataaggaggggtccgggttcctctcgggacgattcttttttctcccaatcatacaatcaataatacactcggcggaatcatcctcggacaggagtagagtattacttcttgaataagaaggcctgaacctgtataaaattccttgtctccaaacccatccactttcctagcttgatagccaccccctttattattgtcgaaatcttgtttcgacaggcggtcccttgtttcttggtcctccaagaagcaaaattccattgcattatccaccgccgaagccgaatatgtcgccgccggttctttttgtgcccaactcctttggatgaaacaaactctaaaagactttggctacaacttcaccaagatcacactcctatgtgacaatgagagtgccatcaaaatagccaataatcccattcaacactctcgaaccaaacacatagatattcgccaccactttttgagagatcatgaccaaaggagacatatgccttacacatgtgagaaccgaaagccaattagccgacattttcaccaagcctttagatgagaaaagattttgtgagcttaggagtgagctcaatatcttagattctcgcaacattaggtgatgggtggttagctaatttatagtcaaacatgtatcactaaaatgtaaattaaaaaaaatgagcttttgtgtcttgagatcacttcttggtagaagatgatcttgataccaggaataaagctcaaacattcgccttcatccaaaaaccccttttgtgaaaatttttgcaaaatcctttgtgtaccttttattttgaaaatttggtttttatccccttcttgtggtgtatattgaccattattatataatgttgattgttggctggtcatatgcatcataagtctctacatgtccatagttctttatttccccttgttggattctcatcttcttcttgtttttgggcctgactgccctttatctgtcaggccagaagttccgggcctccctgtccggaacctccgggtgtcggggagtatatatactcagggggagttagaaaccctagtctctctcctcattcttctccctccccaacgccagccctagccgccgctacagtgccccgagtggcgattttcttttccctccaatcaaattcgattcttctccgtggattcatctacattggtggctgggaggttcttcctgtgatcgattcgcagtttcttctctcaaggtagcactttttgattccctctctcagttcattgtatttttatcccgatctctaaatctgtgaacctagggagaaaaccacttggatagtcttgtttctgctatcttgtggatcaccgatctataggatttgttcacatgcactggctatttttgagacctctgttcttcatttttgccggccggaagttccggtgttcttgcacccggaaccttcgggcgttgtccagccagcctgtcattcttgcttctctcaatttttgcctaactactgcactccaatttgttgattcctgttgcagtaagcactatgactcgtgagaaaatatagaaagcctctcaggatgtgtccggtgatgagagtcctcctatttagtttcctcgtggtcgtttgggtaaagagaaagttgttgagggcggcagtggcagtggcactcgtacttctcccaggtttacaaggcaatccagcaaccgtcctgttcagattagggatgctgacagtggtcaaggaagtgatgcacctaatacaagaggacgggggagaggtggtggtcgcagttctggggctgaaagggcatctcatgatttccctataggatctcgtgagaatcctattcggctctacaagactcttgtttttgacaccactcctatgcaccacattggaagacccaagtccaactaccttcatcaacttgccaagtgtagaagagatcgtttgattgatccagagtcacagcctgaggagtcacaggatcctcgctttaggacattcactcaattggattggtatatctcagtgattatggctagagagaattcagtggttgggatgaagtggattgattgggcttacatgaggaagaaaaacaatgaagtgttcaaccaagtgacgcaagtgtgccacaacaagaatcttggagatattctcgccatggagtatgactggaatgaggaagttattgcacagttcaatgtgaaaacattctttggtactacaaggaagggaaccccttatgtgaagtggttgactgagggtgttaggcacaagatttccatggcatagtttgctgagatgttggggttagatgatgaggatctcaataggcccaacattcatagtgaagcacccctccccatgatcaaaaccaagttcatgtatgcaaaggatgcacctaggacttgcatgggatctactcatggattgcatcccaactacaaggtgttgtactccatttttgttggtctttgcttccaaaggttggagatgctactgctttgccatccaagcatgctcatcttctcagtcacatgcgctacaatcagcctccttttagtgtgatgaagttgatttggtatgagatcgccaacaccattcttgagcctaagcggagttgcatctatgctcctttcattatgaagatgattgagacaatcactggggtgttctacatcaaagatgggcgccataatccttttcgccctcatgctccaccttcctcttctccagtggtccctcgatctgttccttgtacttcagctggtccttctactagtgccccaccgagttcctcgagttcttctcccatcaagaaggctcttcaggcaattttctgtatgtgtgctaagactgccaagaaagtgaagaagatcgaaaggcgtcagaaggaagatagaagagaggctgggaagcaagtgtcagatgattctgaggatgaggtctatgttgatccatttgaggcttatgaggcagcccgcaacgttgccggtgaaggtccatccaccttcttcaatgaagaatcttcccattctgatgatgatgatgatgatggtgatgagggtgacgccgaggcagctgcagaggatgctcccaccgatgttgatgagggtgacaccgttgcacagtccgatgaatctcatctctccgacgataccgagattgttccctccgatggagatggagatgagtgatcctcttcttctcttcatggtttcttgctttttggtgccttgatgccaaagggggagaaattgtgaattgaagggggtcatttaaatcttttttgctgccttgactgttgtctggtcatttggccggaagttccgggtcctgtgatccggaggttccggccaagcagatctcccctctattttccctctcttatggacatgtaatcgtattctattatggttggatgtaatgactattagatgctttattattctttttgtcagtaagttagaccatatggatgttgcattttgatgtgatgattgtgttcttttcatctttttgagtgattgccatgtcatctagtctttctatttgcatcactaatcattcaagcactttcatctgcatctcttctttgataagggtagtgtgaggtttcttttgagctttccttcatcttatgcataatgttttcatttctagttctttatatgcatatctttagggggagcttcacacttctctcatcattcaaaatttaaattctattgtctttttatttgctttaaccatgttgtcatcaatcaccaaaaagggggagattgaagatgcacttaaaccccctagtgggttttggtgattaatgacaaggtggttaaaggtgacaaacgtgtttatcaagtttattcataggagtttagtcccaaaccaagttttgatggctaagaatgcaaggagacctcccaatttgaatgttcctaagtgcgaaaaacaccgaaggtgattagactaggtttttcactttcgaaattgagtttaggaaaaaccgtactattaagaggggtttcaagtgtggttctagggtatacaaagtgctcttagtcatatccatgagtcaaaagatttttggaatcatttttgaaaaatgattttcaccccgggacagagagggctacccagaggttctggccggaacttccgggcgccgtttatttacaaaaaaattcctaagttctgcccggaagttcctggcacttttgcccggaacctcctggcaggtttccagttcaaacttgtgagtaacggctagatgacgtcacctagcatttatatatatggatttcgtccccaggtcaccctttggccattccacttcagttctgtcatgttctagggttttctagccactcccaagcttcctttgcttcctccactcaaatctgtagtctatcttgtgagattgagagattagatgagagtgtaggagtgttttggagatggcttgaagattacgtttaattgagcactttggataccttgtgggctgtcactttggatactctcagagatcttctcctagacggttaggtgtcgcccgtgagcttccaaagatcttgtggatgtcccgggaaagtttgtgagggttttcctcacctccacaaggaaacgagataagtgagtaaagattcttgtgctgagttttcagaggttgtcctatgtagagcaacttgcacttgtggccttttctagaaggaattttgagtttgatcttggtggtcactcaattctagaaaatgacctagaagtgttgttgtcgaaacgacaactgcatacgtcgaaggatgttgagtactaaattttgaatttcacttaggatcccccattacatggccctagggggctatttatagccctattgcaggctcttactactaggatctagattgtacaggggaatttacatgattacccttatgaaagggacatttacaggggtacataatgttatagggtctcatgggcccctgatgggccatctagcgattgccggcccttaggcttgatgggccggaaaggcttcctcggcccttgcgggggcgaacttgccatggcgaagtcgtcttccttcggcagatagtcttcgccttgcacccatcgcccgagacgcccctggcctggcaaggccctcgtgcgactcttcacctcacgccgttcttgctccatagccttcgccacgggtttcggcagatctggtcgaagagcctcatgtcatccgccaacaagtgttaagttgaaggctgtggacctcctctgagatctttgcataagtgaggcaaggggttaatcgagacccggctctttggagcacctcaacggagagtaggattcatgtgatccgaacttcgggaaaaaatcgtctttgtctctcttgtgcatgatctttgtgtgaatctgctgatattctgcaatcttcatcttgttcctctgtgtgcctaaacttcccttgctaggacctgtttttcatctcagttttaatttatctctgctgctcggaagttcctagctcaagaactccggaagttccgggctactcatcctgcccggatgttccggtgttcatcaccaggaggttccgagccctattaatttaactgctgtgattgttgagaaaatttcaggaaagcctattcaccccctctctaggctacatctctacacgttcagctatgcttgtgcttctccttcttctcaagcttcttcttgtcttccttgaagtgggggcaatccttgatgtggggtcaatccacaatgaagtgcccggactctttgcacacatagcacacccttgcgaagtgtcttccacttgacttgttaggggaatacttggacgaacttcccttgaagaagacactttgcttcatgaacttgccgaacttcttgacgaagagtgccatctcttcatcatcgatctccgccttgctcttgctcttgcgactctcttcttcttcttactttgccttcaatgccaagtcttccttcttgatgcttgtcgttgagctttggttaatgtattggatgaactccttggactcttgcacaagcatgtcatgggcaaggatgcgcccaagcaaatcatgaggtgtgagagtcttgtagtccggacgctcacgaatgatagttaccaaggtagagttccttggaatgattgctcgaaccatcttcttgaccactacctcatcggtcatgtccttggagccaattcccttgatctcattgacgatcttgctcaaacggtcatacatgtagcttgggctctctccatccaacatcagaaacctctcaaattgccctttgaggatctccaccttggactcgcgaacactatccgtgccttcatgaaaatttcgaagcgtgtcccgaatcactttggcactctcaatgccgtccacgcggttaaactcacttccgctcaaggcgctaagtattgcattagcggcttgagcgttctaatgctcgttctcgtcatcctcattggtgggatcctcgggtttctgcaaaacatagcccttttcgactattctccaaatagatgggttaatagacttcaaatgcatcttcatcttatgtttccaagcggcatagtccgtgccgttgaagtacggagctttgccgctataagtactcacataagaggttgatgtggatggatagtcataataaaacgtagctcccttttcaccatccttgccattccccgtttggtccgacatgatctctccaagcggttaagcctaattaggagattaggctctgataccaattgaaagggtcaattaggcctagaggaggtggggtgaataggctaatttaaaactttatgcggaagctaaacctgagttagggttggaaagtctgatccacagtcaaactatccgaaaatatcagatagtctgatgttggatcagactgtctgatccactaaagaatcacaacaagcagatctagtgcacaaacaagagtatagcacaaacaacagctagatctatagcggcacaattaagcaaagctaaagagaagatgaagagatatcaccaacgatgaagttgaggggattctactctccgttgttcccggagttgttcccggagttcaaatccttgaggggattctactctccgttgaggagctcactaagagccgggtctctactaaccctttcctcaagaggttgcactaagcactcctcctccactaaggggtacctctttctttgcggaggcgagatccggccttcacaaacttctcccggccaaccacacgttgatcggtggctcgagagtgacacctagccatctaggagtcctcaacctccaagagtaacaaacaccacacaactcttggtcaaaccctagtgttcaagatcgagtgaaacacacactaggccctcaaacaccaaatccacaaccaccaagatccaccacagaaagaatgaggagggatttgagaaagggagaaagagctcaaagatcgaaagcaccttagcaccaagctcaacccaaagtgaatgtgaatgaatgagttgggtcaccctagaaaaagattaggtgggggatatttatagacccccccaaaatgtggccgttggaggggaatctttcatcccacgtcagatagtccgatacaagatcggatagtccgatattttaaacctccaagacaacgagaaacagagaacgaagttcgatgaaatttcggactttccaagacatcggactatctgatgttaaatcagagtgtccgatattttagaagcaaaaacttcgtcctcaaacagagactcaagttccatgaaatttcggagtctctgtaccattggactatctgatccaacatcggatactccgacacatagaaaaactcactcgaaagtatttttcaaacaaagacagagagtgaagttttgtgaaaaatcggatagtccgatacattggatagtctgatttcaaatcggatagtctgatgttgctccagtaaaaatgcaataactttttactccaaactccgatttcgaagatcttagactctatggaaagctagtttcgtgggctatcaaaaccaacataaaacatggtccaaaaccttcaagagatgttgaaaaacttgcaaagaaacctggtgtaagtgttgtgacaagtgaacaactcggaattgaaattttggcttaggtttttcaactcacacaaagatgaagcattttgagcactagtgttctaccaattatatgcatgtggtatccctcttaatagtacgacataatgcaaggtaaaagatacaatataccatttgatcattgccgcattgcatcgtgatgtcgcattcatggggtatgcatctcattacaacatgtcgaggacataacaaccttcacacttgtttgaataaaagtgttagtcctctctaatcgcattgtaatcaatcatcaaaatcattaggggcctagatacactttcaggccccaatcctccagtattcggaaggctacatcccacccaagtctatccacaagcaccgatccagccccttccgtcataagccacgcaagcgccagtatacttcaccaggcagccttcgaccgcagcaatacatccggcccctcacgtgcagctgcaagctcagccggtcgctgcccaaacacactctcaaccgcttggccaagtgtcacaagcgatggcagaaggggcttcggtgtaggttcaagctttccttcaacaattcagccaaccccacaacatttcaggtacaaccccttcagcctagccgaaggggaacacaagtcaaggtgcgcccagttggttgccgtggaatcagccgggtctgggggcttcgccttggagtcaaggaccgcagttcgacttcatcaacactgctcaggcaccaaaccttcggccgcaagaaacaacaccaggcttcggggcaaaccaagcaccaaaccaggccgccatggtgtggccccagccaacgttcgacccatccatggcggctcaccaaacagcaccaatcagagccaggcaactgaacaccgtggttcaacctcacgtgcaggccgtgacctcgcccttcgccacaccatatccgcagcaaggtgccgtgaatagggcagggggcgaaaaggggctaccactgagtgggggaattaagatccgtccgatcccaccccagttcaagttcccacccgtcccacgctattcaggcgaaactgacccaaaggaattcttctccatctacgagtccgcgatcgaagcggctcatggcgaccaaaataccaagggaaaggtaatacatctcactctagatggcatcgcccgttcttggtacttcaatttaccagccaacagcatttactcatgggagcaattgcgcgatgtctttgtccttatctttcgaggcacctacgaggagctgaagacatagcagcatctacttggcatttgcctgaggccgggggaatcgataagggagtacatgcgtcgcttctcgcaagcccggtgtcaagtacaagacataacggaggcgtcagtcatcaacgccattttggcagggctgctcgagggcgtactcacaagaaaaattgccaacaaagagccgcagatgcttgaacacctgcttcgcatcatcaacgggtacgcaaggggcgaagaagattccaagcgacggcaagcaattcaggctgagtatgataaagcctccgtcgccactgcccaagcccaagtacaagctcaggtcaccgaaccacctcttctcgctgttcgccagcctcagccggcgaaccaaggacaaccgccaaggcaaggccaagctcccatgacttggaggaaattcagaaccgactgtgcgggcaaggctgtgatggctgtcgaagaagttcaagccctccgcaaggagttcgatgcccagcaagcaagcaaccatcagcagcctactcgcaagaaggtccgaaaagacatttactgcgccttccacggacgctctttgcacaccaccgagcaatgccgaaatattcggcagcgtggcaacgcgcaagatccaaggccgcaacagggagcagctgtcgaagcacctcgcgaagccattcaagaacaagcacccccggccgaacagcgccaagatgtgcagtgcagagtaatccaagtgattacaagggccgatccgccgaatcaactgtcgaaacgacaaaagaagatgcagctctgaatggtccacaacatcacttcggcgggcgaaggggccccgcaatatctaaaccagaaaatctcgttcgggtcggaagacgccaaaggagtaatgttcccgcatcaagaccctctggtgatctcggccgagatagctggcttcgaggtccggtgaatcttagtcgacggagggagttcgaccgatgtcatcttcgccagagcatatgccaagatgggattaccttccctagcccttacccaagcaccggcctcgctttgtggtttcggcggagaagcagtccaagttctaggccaagcgcaattgctagtagctttcggcataggcaaaaacagacgcgaagagcaaatattgttcgacattgtcgacatcccgtacaactacaatgccatcttcggccgtgcgaccttgaacaagtttgaagccatttcccaccacaattatctcaagctcaagatgcctggcccggcaggagtgatcgtggtcaaggggctttagccttcggccgcttcaaagggtgatctggccataatcaacagagcagtgcataatgttgaggccgaaccgcatgatcgggcgaagcacgcgccaaagcccgcccctcatggcaaggtaatcaagatacagattgatgatgccgatcccacaaagcttgtatcgctggggggcgacatgggtgaagaaaaagttgagaacatcctagaggtgctcaattaaaacattgatctcttcgcctggggccctgatgaggtgggaggtgtttcgatagatctcatcatgcatcacctggcagttaagccggatgccaagccaaggaaacagaagctacgcaagatgtccgctgatcgccaagaagcagcaaaagccgaagtccaacaattgctcaaggctggggtcattcaagagatggaccaccctgactggctggcgaatccggtgctggtgtggaaatcaaacggcaaatggcgcatgtgtgtcaatttcatagacctaaataaggcatgtccgaaggacgatttcccttgccacggatcgaccaactcgtggattcgacagctggctgcgaactcatgagcttctttgatgcgtactccggctaccaccagatatcgtcgtaaaaagccgcaaggctttcgaccatgcgtccgacctgtaggagaccttcgacaacttacgcgcggcgggtatgaaactaaatcctgagaagtgtgtttttggtgtttgcgtgggcaagttgttgggtttccttgtttctaaatggggtatcgaggcgaaccacgagaaaatggaatgaagcccccgtcgagcgtacgtgaagtacagaagctcgcaggccgaattgcggcactcagtcgattcctctcaaaggcagccgaaaaaaatttgcccttcttcaagaccctccggggcgtgggaaaattcacctggacacccgaataccaagcagcgttcgacgagctaaagcaatatctgcaaagcccacccgatttgatctgcccagcaccaggaagcgaactgctactgtacctggcagcttcgctagtggcagtcactgctgcccatgtccaagagacagagtcaggccagaaaccagtttatttcatctcctaagccttgcaaggagtgaagataagatacattgaaatagaaaagcttgcttacgcactggtgatggcttcgcgcaagcttaaacactacttccaggcccacaaagtcacagtgccatcacagtaccctttgggcgtggtactccggggcaaggaagttactggccggctcagcaaataggtggcggagctatctcccttcgacttgcattttgtcgctcgcactgctatcaagtcacaagttctagctgacttcgtggccgaatggacaccggcgttcgaccctgagcctgagcccgtcgaacaaccctgggtgatgtactccgacggcttgtggtcgcacaagggggcgggcgctacggcagtactcacttcgccagggggcgtgccgattcggtatgccgcaaggctgcatttcgacacaaccaacaacgcggcagaatacgaagccattcttctgggcctgaaaaatgcgaaagcattgggggttcggcacttgctcatccgaaccgactccaagttggtggcaagtcatgttgataagtcctttgaggcaaaagaagaaggattgaagaagtatttggaggctgttcggtctatggaaaaatgctttaccggcataacggtcgaacacttacctagagaccagaacgaggaagtagacgccttggcgaaatctgttgcttgtaggggcccgcattcgcctggcatcttttttaagtcctacacgcaccaagcgtgcccatagagagcctggatattatggcaatcgaccaggtagaactgggcgaagatccagaagactggcgacccccgttcataaggtacctcaagagcggctggcttccggaggacgaagcagaagcaaagagcttacagctcagagccgcaaagtacaagatggtctcgggccaactatatcgatctggggtgctccaacctttgcttcgctgcatctcattcgccgaagttgaggaaatggcaaaggaaatacaccaggggctttgtggctgtggagattatggtaccccatacccacacggcatggttatccgactagctataggggatgacttatatttatgaaatatgtaacggatcatgacttgggtattatgtttccctgtatattgtggaacggcctaaagtcctggtttgataagattgtaaagtagatttaggaaaccgataccgtattggttaaggtttctatcttgtaattttgccccccatcctatataaggggggcaggaggccctctagggggcatgagacaacctgatcgtcagatcaatatacacccggcggattcaaatccccaaacaggagtagggtattacctcgcatcgagagggcctgaacctgtctaaatcctttgtctctgcatccatccacttttaggtctcgtgcgctacccccttttcatattgccgaaaatttgtttcgacagttggcgcgccaggtaggggctgcgtcgagtttcctatcaacgagcgcgatggaatcaacttcatgagtcgccgacttcgttttagcttcgggagttttcacttcctttccgtcgataacttcttcaagctcctcttctctgacttgatccaaattagtcagggggaaactcaatcgagggattacaacaatctaccacggcaagtttcagattcaatctcctatggctgccgtcagcaccaccttcatcttcggactggttcttctcttctggagtttggcttgcatcgccaccaccgaaaattccgatgggacgtcagtcgtcaacttgatcgtatgacatgccgtgtccatcatctggtttaatctgttcggcgatatcaatctacccggatcaccaagcaacggatcaattctcaaccgccagcgttttttttagatgacgttaaatctcctggtgatattcaattaccaatctaaattggagtcgacgtggaatgtgagccaaccaataggagcaattttcgcgcaaggaagtgcagcactcatgcatgtattgcatgtctgtcacaagctgccgatatgatctcctgtccatccattaacacatatacggaggacactgagaaaaaagctaagtgcctttatttttcctctttatgtgatattttccattgagcaattttttatatctactcatgctaactactcgtctagcgccggacgcctagttttatcattatttatcatattgatttttaatgtcagattaatctcttgctattttttgttgttgttcgcatataattacgcggcactattgaggcgattgatgctggtcatggattcgaggcgtctcagctttccggtcgatcggccgcgagtccactccgccggcttgtcctcgccaccgccattgctgatagcaacaacaacttcaccgccggcttgcctctgtcgccgccgactagtgtcctcgcctatacggttggttggtcacaccaccgttcatgggcatccacgtcttcaccgaccggccgcctcgtccgctgccgactggtgtttccgcctgtatggttggcggacttcgccaccgttaatgggcttcatcatctacaccactggcttggttccactggcgccgactggtgtttttgtcaccattgatagactgcttcgttcccacatcggctacttttgctgtcaccgagggaatacaataaagctaagtcatcatttattttattctttatatgatattttgccttttcctttgcctcactacatcaactggttcgccgttgactagtgagtcgggggctatagatgttatatcattttttttaaacaattttcataatatttatcttgattgcttgcgacatattctgagtacaaaagtgcctatcgagttatggagttccatcttcctatgctttccgtttggtttgccaatggatagttgcctttgggctgattcctagcacccgggggcttgttggatggaccgaataacgcaaggtgctaagtattattcagaataaatcaaaagcatagagataagataatttattttctgctcttaataattgcaaaagtacccgagtagtaaactccgacccgtgaaactttgttccattaatgacgaactcatgtcactcatatgcatgtttggaaagtgcttaggccgactcccggtgtttggtggctatgactagtcgggcagaatgtttaaacgtaatgagtcatctgctcggggaaatcaaaattgacaagagaagaaatatatatttataaatattttaaaatacttgaatttttctcgagtattatatttatatcagatactactcatcctatatgtttgttctgtaggatccagatccagatatgcataaaagggattcatggctttaagcttatctcttacgctccaggaatggatcagtcagaacatccgcctgcacggctggcctattatactggtgtttccgccgccgactggtgttgttgggcgtctacgtcttcaccaaccgaccgcttcaccgactggccgcctcatccgccgccaactggtgtcaccgcctgcacggctggcctgttatgacgccaactgatgctatcttcttcacggctggctacatcgccgtcaccgctaataggcgtcagcatcttcaacacaactacaactactgatggacatcatcgtcttccgtcatcgactggttatgccgccgccgactggtgcttttatcttcacaaatgcgcgtctttactaccggtttgcttctgttgccaccgagtcgtgttgacttcatcacggctatgcaattttgtcaccatggtggagcaacttcatttttattatcttcggcatcggcaaactctattgcctctacttcaccaaccatgacgactacaagagtttcgacacctcggcatacgtcaccaaatatgatgccgtgttattttattacaacaagtggtgttccaatctttaatatttatcttcactcaagtaatgactactcgacgacaagaagttacagttctcgactctatgttcagttgtttcccaactaaccaaagagtcgggggctacacaaatacaagactcttaaaattcgacaagctgaagtaatcaattaatcagccaacgagtcaattccaggagtcattatcttcgtctttgctttagagcagagttatcaaccaatcagctcagtttcgaccagttggacaacatcatctactttcctccaagtgaagcatctgcaacagctataacaccaatttgatggattattgtcactgacatcatcaccagcatgtgtacttcatcggccctgacatttacaccattgctaaggggcgactacgtcttcgccttcggttacttttatcatcatcaactctcatcaccgacttgttatttcgtcttcacggttgacctactatgcaaacgctgatgagagtcatcgtcattatcatcggctgctacactgctattgactggatcaccgacatcgtcatctttatcaacatcctatcaagcctcttcaacatagcccactctactgctattgatgggcaacttcgtcattatatttgatcatctatgattgctgcttatcatcattactgtcggttgtgtttgtcgtcgccgactattttcttcatcttcatgattggtggatttcgtcatcgcctttgatgcgtgcctacatcttcaccgtcggctggctttcgtcaccaccgaccggtatcctcgccttcatggatggctcattatgtcgccactaatgggcatcttcatcttcttcaccagctgcatcgtctgtcaccgactaattatttcgctggtatggctacacaactttatcgctgggtgccttcatattcattgctggctgacctaacggttgccgactggtttcttcgcctccacggctatgcaacttcatcacttttgattggtatcactatcttcactactaccaatatttttgccacctctggtgggcaatattatctctatattggtcgtcttgtctctatgccaactgcatcagctaccatcaatggacaatggtgactatgacagaaggacaagctatatgctcaggggctcatcaactcaagcgtgaggattatatctccaatttggacttgttccggatacatgcaacatgaatttgatgatcatgggtctattttctatgctcaaagactggactatttattattccccgtatgggttattaaccgaatacttgcgccagtcgaaattcaattgttatatctattttggagtatcccataaaggataatccctcagatcagaagctattcatatgagctacacttggtctatatcacccgaaagatttattactcgggagcatgttacatgcgtgatcctttaaagggtgtcgaaggcatattttttggcctaggcctaatatgtctgcagcccatattttcaggtgtggcctgtcacgtttttttagggacttaggcatctttttgcttaggcaaaagtgcgcgtgattatgtgcccaataccttaaaatccttttataccgcagttactcaactttttaggagttggtacaatacattttaaaaggtgccaaacaataatgctttatatagctccccgctgacttttttatataagtcaaggcgctgtttgggttcataaagcaattgattagatacaatatcattgctttttgccacgtaagtgtgcatttttattgaccaatattatggcttaggctgattatatattttggtcattttccaaacgattgataaatccttatgagtttatttactcggattttataccacatatggcatatatttctaggtgtggtgaaaccatgtgtcttttatggactcaagcacatctgttaaagaagtgtgcgcatggtgtatgcccaatactttggaaatttctttattcacaacatacaaacttctttatagctgttttgctatgtgaattttcaatgatgtagccaactttaggttacactcatcatattttacaaaacagtcagtatatcactcggatcatgttattcagggattcacaccgcatatgctatatattgatatcaagtcacttggttgattacaattatcaaaaccactcggttggttggattatttattccttgactatatgcttagtttgtttagctaaccacatagtcggggggctacacctattaggtgcatctagtcgatgcacctgactttatttttcagccctccacagtcttcatatttaaaagtacttcggagaccatagcgaagatgattaaagcactcagctttggagtaatctagttcgagagaagattatctttttgactgtgaaggtctcaggggctactgtggagattatggtaccccatatccacacggcatggttatccgactagctataggggatgacttatatttatgaaatatgtaacggatcatgacttgggtattacgtttccctgtatattgtggaacggcctaaagtcctggtttgataagattgtaaagtagatttaggaaaccgataccgtattggttaaggtttctatcttgtaatcttgccccccatcctatataaggggggcaggaggccctctagggggcatgagaatgagacaacttgatcgtcagatcaatatacacccggcggattcaaatccccaaacaggagtagggtattacctctcatcgggagggcctgaacctgtctaaatcctttgtctctgcatccatctacttttaggtctcgtgcgctaccccctttgcatattgccgaaaatttgtttcacagaggcacacagcaggccgcaagaacagttgcctccaaagtgtttcgacaaggtgtgtactggcccaccgtgctgaaagtctgtgttgagcaagtcaagaaatgcgaaagctgtcagcgccatggccgaagctaaactgcgccccaataagagctgcagcctatcgcaccaatttggcctttcgccagatgggggctggacatcattgggccgttcccggtggcgcgaaacgggtacaagttcgcaattgtggctattgaatacttctcctgatggatcgaggccgaaccacttggcgcgatcacttcggcagcagtttagaagttcgtatggaaaaacattgtttgccgtttcggagtgccaaaagagttcatcactgacaacggcaagcaattcgacattgacaagttcagagagatgcgtgaggggctaaacatggaaatcatgttcacgtcgatcgcacacccgtagtcaaacggggcggccgaacgcacaaatggtaagatcttagaagcactaaagaaaaggcttgagggggcagcgaagggtaaatggcgagatgaaatgctatctgttctctgggcccttcggacgacccccacaaggccaaccaagttcagcctgttcatgcttctctatggcgatgaagcaatgaccccaacatagctaggggctaattcaccaagggtgatgttctcttggggcgaagaggggcgcgaggtgtcgctcgaactcctggagggggtgagagtcgaagcactggaacagatgcgcaaatacgtcgcaggcacttcggcaacttacaacaaaaaagttcgaccgacggagctattgcccggccacctcgtcctaaggaagaaagcgaactcggtggcggtcggcaagcttgaatcgaagtgggaaggaccgtacctcatcaagcacaagtccaggacggggtcctttcgcctagcgacactagaaggcgaagagttcaatcgttcctggaacgctgcctctctcaagcgtttctatgtgtagaacgggtggcacccgaatcgccaacttgtaaaaatgtacatattgttatgtaagcctttcggcactatgtatgcctttcggcacgaaaatgcaaaaaaaaagaggaaaatgaaaaaagacaaaaaaaactggatgtagggctattatccatcccggaggcccgaaccagtataaaatctttgtgtttttcgccttactatttgtgtgattgataatttgtgggaaaagccctaaggcaaacgcctgatcagcaaaaatgctaggggggcgaaacgaatcggctgaagcatcgctcgccaaacgttaaaaccgcaatcttctaaggtcttctgatgatttcgccaaaagcgaaccatatcctccaaacgttttgtatgaacacgatcgtaatcttctaaggttctcccggggtgcgcctgcagccagccggcaaccttaaaaaccttatagctgtggccgtattttaccatctcgcgataaataggccgaaacgggcatcgcacttttggcagacccttcaacaccacgaatttctcgtttttgcttcgccaattcccagagggggcagtgcacaattttcggcgaacaccctgctaaacagtgcagacagggcaaaaggcaaattgcatagtaagaatgggcgaaaaagagcaaatattacgtaatacgaaaatggcgcaagcacatacgccaaaggcatcgaccataaaaaatgactaagactgagtcatacattccaaatatccaaaaggccattttcagctacattaagaagggtaaggggccatcggccaaatatacattgttcgtcttttgcggcaaacgaaaaaaaagaaaaactacaaaaatctaaggaaagggcggagggcctcacacctctgggtgatcctaggcatcgcctccaccccatccaaccgccgcatcctcaccttcgccctggtctgccacctctgcctccgccggttgctccaaaaggcacgccttggcagtggatcggccgtccttctgctagaactgctccaccacgcgcggagcgcgggcgaaacgtcctgcgcactaacctcccattcccccttcgcatagttagggaactcggcgacgtgctcacagccaaactggtgcagaaggcccatagtgaaggccgccgatacacgtgcacagcaatcaccgtacgcagtagcgcagtccgaaactacaccagcagcctgctgtgtccactccgaaaagtcaaaggcagaggcatcttcggcggggactcctcgcaccctcacacccatgtcgaagagggcaaggcggagcatttggcacaccgtttttgcggactcggtggcctttgccatctcccgcgaaaaccgctgcgactcctccgcagcgcttgcctcagccttgctgacctccaggtcaagagcctctatcttcggctcagtaagattgtaatagtcggtcagcacagccgaatgggctttctcctttttaagctcggccatgaggcgatcaacctcagctctagcctctcttcccttctccagttcggccttaaggcgatcgacctcagctctggcctctcttcctttctccagttcggcttggagtcgcttgtttttgcgccttcacctccttgagggtgttggcgagggcctccatctccaaactcatgcggccaatctcatcatccttggctcgaagatgtatcctaaatctgtcaagacgggcccgcacggttcgctctatcgaacagtgagccgcaagaatctggatgtaaggtaaaacggacgaagagagcaaatgttagttgtgggatctgtaagaagaaaataaagacaaacaagaagagagagcgaacagcatacccgaactgccaagcttttaatagcagaatacccttcgtcgaactcattcagctcggtgaataggctcagagtgccgacaggagagacaaggttgcttaccccctcaacaaagggaataagttccgcccgggtctcgaaatcgccaggggcgaagtggggcgccgcgagagaatattcaggggcagatgtttcgacggccgcccccttccccttcggcttcactagcagcgaaacaatcggctgacgcaaagggcttccaaaaaccctagctgcagccttcacgacacgatcagtggaggctgaggccctggcggcggcactgccacccgctccgctagcgtcgatcggaagaacgggggcggtcgaaagatctaagctacgaccggtgggtgaagtcggggatttgtcagaagactcgtcgtcgctaaaaacacgagcaacatcgacgagtcctttcttcttggcggccttcttaactggacaccccttcgccacctttcccgccgaaaacgcaactagcgcctttgccccctgcaaatactttcaatgaacgggggagctattcgactccaccccagtgtcattatgccctggacttgtagtaggagtgtagccaggggtctcggcgtggttttcgaccgcctcgtccgcagcctttccggccgcagcgtccgccccctcttcttcctccctttcctcctcgccgtcacgctcttcgacgtcgtcctcgtcatcagcgtcagaattgaaggaagcatggaccctttgctttctaggggccagtctcacttgtccgtgtgtccgctttcgcgaaggccctgtatcgtcgtcggccttgtgggggttcgcccggggaggcagttcgccgtcgtaaacccggtccacccgaccagcggcctgtcgtgtgagcagctggctgtactcgatgaccgacacatcgccgatcatcctccgggctttggcatcggcctgatcgagagtcaacactgtgaaaataaaaggtgtagccatattaagcgtcgagccaggaaaaatagcgaaacacataagcgcatagcgaaagcgcaatctcaccgttcgtcccctcaggaagaaccagcttcggcaaaccgttgacctcttcatcttggtcaaccgcgacttgccacgaatgggagaggggaaaatgagaagcatacagaactcctccaccaagtcgcggcagctgatgcgggagcagaccttgcgcagcaaggcgaaccgttcctccatggcgccgtccacggcgatcttgggtttccggttcggcgcaatcgccctgcgccgacaccgaagggccttcgccgactcggacccagcctcgaaggggatggtgtgatagaaccacctcgccatccagtggcgatcccacttcgacatggcagcattcaccggccagagatcggagtgctcggggcgaacgttgaagttcatgctcccgaacatcgtcttctttgttccggccggggtcaccaccgtcttcaaattcacggtggaaaaaatatggcgccaaagagttcagcgctagattcaaacccggaggtccggcacgcccagtcgaagatggcgatccggactagcgccgacgggctcaactgtgggagctctacctggaaaaggcgaaggatctccggcaacaacacgttgcacgggaaccgaagccccgcctcaaaaaagacgatgaacaccaccgtccggttgtcgacgggctttggtaccacggccttcccagggcgaaagcctgcccctcaaccaacgccccagagctgaccaacttcaccagctcgccatcatctatgagagaaatcaccaaaaaggccgtggtgtcgttgtcaatccggccgggatcgggccctttcgccgaagcggggtttggctttcgaggagccatggcgaagggtgtgtgcagtggcaaacaaagggaatgggcgaaagatatgaggggtcaaggggcaccgtgaaaggaaagaacggtggaatagagtgcgcatggcaaaaatgacaagtgtggcggtgaaaagggaaaagagggtgagaatatatagcccacccaggcaacggttcgcctacccaccagtaataaagcgccacgtatcgcaagggtaggcgaaacggtaaattcccatcaaccgagccgcacagtaataagcccacgaagggaaagcccattactgttcctttcggcccaggaaaaataaaaaaataactccaccatccgcaagaggtgaaagctacaaaacaataccaaccgaaaagacacaacgcactttctttgcaggaataagataggtttcggcaggagcatcggtcgaaagggggcgccacataccataccacatggtctgcacggtctcgcccgaagctcctatctcacccttgcccatgaggggctagttcgcggtttggcatgaggcccttcgaccaaacctgccgaaaccatgcgaccagtaaggattcaagcctaagacgtcaagatcagttggggcgaagcccacatggcgaagactatggatcaaagacggcgaagggcggagaatcactcgggtgcctcgcagagccaaagacctcttgggcgaaggatgtaaggcgaagagtgtatgtcgaagggagacaacttcgccatagcaagttcggcctcacgaaggcccagtggcctttgggccaacgatcgcctgacggcccattaggagcccatatacctcaattacactgtatacccatgtaaatgcccctttcataaggggaaccatgtaaattcccctgtataacttaaaccctagtagtaagaacctgtaatgaggctataaatagccttctaggtccatgtaacagggggatcccaagaaaaaattctcaattatatacactctactttctttccaaccactgttaagtaaccagtcttttgacgtatgcagttgtcgtttcgacaacagagaccgacatgaaggtcagaggacccttctgaaatagaagtctctcaatcggggctttataaaattttgatgtggatgatctaacggttgaaatttctgatcgtctatatccaatggactatattttgccaccggcgtggatgcatagttttgcaagaaaggactatcttttcacttatttagatgtgccaagattcatgccatactctagaaaattattgttttgtgaaaatgcgcctcaacaatattgttgatcattgcaagttgctaccagcaagtgcttatccctttgctctatctactgttcatttagttccacatggatcactgcagaaaataagcggcatcatcccatcgggaagaattttgagaggaacgcggtggagcatctgtcccaggtgttgactgtcgcccggttcacgtagaaccactgctttgcctttcccaggagtgagcaaggaaacagacatagcctaacggcgtccggactgacacccttttccgtgtaagtgctgcagatgagcgcttgcgtcctcgttaggcttgccatagaatgggcttgcctatgctatagttagcagcctgttcttaaggtcgaaatcggtgtctccgatgttgacagctgggccagcaggcacgttgtcaatagacggggcaacgaattaatgaagagtcttctcggccttgttcctgaaacttggtgacactgggatggctggtttcttttcggagagtctcttctgcggagggacgacgcgaggtttgacactccagaagaaggcctctggattctcgttaaagttttccggtaggttgaaaccagtcatacactaccctattttcacgacacaagtgaaaacaatcaaggttagcttatagtcatctcattattaatcttccgcagcaatggcgccagaaatgcttgttggtatttcttaacgacattactagaaatattcatcctcggcaacggcgccagaaatgcttgttggtatttcttaaggacattgctagaaatattcattcccagcaatggcgccagaaatagtcctcgtatatttatggttacagaagtaaatccacaagcgcacagatataccattgtagcatttcacccggaagtattccaaggtatcgtatttttaatcccaaggaaagatcatatgagtggactttgctaatacactttatacatatattacttgtatttatcaaagtctaagtaggggttatatttaatataggggtagagtgacaagaagcaaagctgttcaaatcctcataataaattaattttaactaagtggaacaagaaacataaagcactcaattcctatacttcaagtatacactcaatatctagtttacatatgttactatacaatcgtgtggccaataccccctaacagtgtcctcctggtacttcgagagtccaccccgggttgccaagttccttactacaacctatcatggccgtccaaccgggggtaaatacggaggagtaccctccctatgaatttttcttaggaatatatactaacatagaggaatacccgtactgagctgtcaccatca

SEQ ID NO: 41816 - DNA, 21005 bp, Oryza sativa
actgatcgataacgactatcaacaaaaccccccaagcttgaacctttgctcgtcccgagtgaaggacgaaaggaaacaaagacttggttgttgatcaggagttgctactatgctgcatatctctcaaattaaataatctttggcacggtggcttacccttacccctgattcccacaagacactgcttttccttgccttgagcgattgaaagatagaacagtaattagagcatcaatcacccaatatttattcaactcttattctggaagttttcaaatgattttgcaaaagaaagccaagttcctcaaatgattcactcagtctctccaagtgtatcaaaatgaattccttaccaattgttgcctttttgattcctactctaaggttttaatatgtagacctcagtagggatcaaacatggcatacttgtattcacatttattactaaatcaaaaacttagactaaagcagatgactaaacatactcaagatcaagatcgtgcaaaatgtgtgtggtatatgataaaagtggtacatgaaggaaaataaagaaaaagcttctcctttgcgcttactttcttctcccaaaaatccttcttttattgattaggagagggtatgattacattttttttcaacatcatgctcatgcttgatggagcataacttttttttttcataatcatgcctttccctcctctctttttttttctttctttctaggaggagaaagcacatgaaagcatggagaatttattttggtggtaataaggaaatggaatggaatattgcttagctcccagtgtaggagtttggcatctgcatatatgtggatgtatgatcttgatcatagagcatgagaagtttctacacaagtcacaagagtttgacagagttcaatggaatgacaagtaaccaaaatgtatatggtttaaacatgatagcacatttttggctctggtaggaatttatatcaaatgaggaactttccattttataattttgaaaaacaaaacatccggaattcaagtcaaactaggatcaggatcatagtaactcttatttactatatcatagctcacaataacttagacttagatcagcaagtgcaactcatttatctcatgttcccagataattgttggctactcatatttgacctttgagagagcacttaccaagaacccatatataagagatataaaacagagcaactattcatcatttcaacaaagagaactagcttgtcttacctagcatgactcaagcatatcctatctttttggtattttctattttgcaaatttttatgttgttttcaagttttataagatgcaattggaaagggaaaatatgcgatgtgatacaagttacctcagtggggggaagagatgtcccccccccaagcatggttttcgctcagggtccttgataaggattgaacccctgaaagcggaagtactcttgaaggtcatcgtcctgttgctgcatcatgttcctgaagttggcgaactgcgcatcagcagattgttgccatccttgcgtttgtgctatgtgttccgtgaggttgtactgtatctctgacgtctgcatatcaagagtgtccatcctcctagtgatttcacccaagtcccaacgagaggaacttgagcgccattcacttggagatggaggcgcaccacttgatctggaaggttgattgtccccccattggatgtcatgaggcgcacgccaccggtcctcactggcacttgcccaggttgagactccgatactgtgacgtggagcttgggtccatccgggtgcatccccaattggctcccaacctgcctcatacatctgcacaggtgttgaggatgatgaactttctcgttcatttcttgtcatgttgcgcgtctccctgtatgctccacctgcacgagattcttctatggtctgcaggggaatggttagttcacggcagttgtacaaatgataccccgcatttggcaacgggatttcatttgtacaaccagagaaaaagtaaatcaaagatccatctactccatgtttcagaatatgcccttgcactagataagtctcatcaatacacagacgagcggctgagataaaagcaatttggtcgtgttaacgaccaaatttggtaatatcagcatcggaaaagaggattaggccgaagctgagtcaaaggcgaagatcgattcgagaacatagtaagaatcagctggagtccggatcggctatgattgggatcggctaagtccgagtcagactaggttaggtgatacggtcgattccgacaatacgacttggtatacgacatcgggttgagttgatatgcttcaagatgattgccacacatggatagagtcctgagaaggcaattgtatctattaattaggatattttatgtaatttccttagagatatgtttgggcaaaagtctgccataaagacttatggtattttagagtttgttagagataagagtcgtgttcgatatggacattgtttgtaatttttgggtataaatagaccccgaaccccatgtaatcaattaacacacttgttcaatacaatttcggcgcatcgccacccttttgctttagttttatttcgacgagttcttgctttcgggttgagctgcatcggtttcgatcttgtttatgtaaaacttgttatgacgacttgcgttctcgggattagtgcttccatctttatgatactctgatcttgtttatgtaattcgttgagttatcatatatcttacataatctctgacaatatcgctatataacctacaatcggctaacatctgtcggtagagggcagccgattaggttaaacatcgatgttgacttagattatataggatatccaccactctacgaaacctccaggggcttgattgtctagatattgttcttcttttcatacttaatgctgcatcagttgagtttgatctattaggtcgtgcttagaatatcaatctctagcctgtcttctggttgccgattagggtagtatcggagtttcagtcgatcttatctgatttaactatatttactctatatgcttcattgatatgttaaatctgtcctttatattaagatcttgttgcatttaagtatattagacttttatttgatatattctacttgtcttaatatcttagtatagagtggtatcggagtattagccgatacatgctagatccatttgatcggctatgctatgaacatatataatcctattattaatatatatttcgatctaaatgatttatactgtctcggcatggcgaccgatctatcccaatcacttgatttaaatatatatcgatataaggattatatattgttaatatctacagccgatcgagtggatatagttctttcttatttatttatgactaccgatcgatttacacatgatatcggctcaaggataaatgacatgtcatcggcacttagccgatcggctatcatttatagatttaaccacggtttctttgcctttattttttgttggttgcaggatcaaatcaactggcacgctagcatacccgaaggcgagttttggacctacactggagttaagcagatctcgcaggcctcgtgtttttcattaacacgcttttggcacgcctggtgggacatataagaagtcagaagtcttttctcatggatgacaagccgccagcatcgccgtcctcggctagccccggtcctgttaatgagaagatacaacagttgggcctatctgaagttaatgaaggcaacatcgtgaacatcactctagacaagctgacacccgatcaaaagaaggattttgaagcgatgatgcagcaagcacgcaaccagttcttgagttcatttatgcaaacccgtaagggaactatggtgcagaagtataaggtaaaggtggttgcggatattcctgggactagttcttccaaagatggatcgatcgccatgccgagacagtatgaatcacttagatcaaaatatatattgataacagccttatatattttaatagcatagccggtcagatagatctagcatgtatcggctaatactccgatactactctatatcaggatactaaaacaagtaaaatatatcaaacaagagcctaattgtagcgcccgttccgtcgtggcgcctagcgggaaaactatctcttaaaaaccctatttgccaaatccgtttctttgcttgttgtcgtgtccgtgccatctcagatctcgaatccccgatctatcgtcaagttcaatcccgaatccaaatccttcccaaatcaaatccctccgcaaaagtctatttagcctctctcgggttcgatgggccgaatccctctcggcccatctccccctccctccccggctctctctctctctctctctccccgctctgcccgtgagccgcgccgagccctcctccctctccgcccccgctgccgttcccgccgatgccgcccaaatcgccgtgccgcccgcgcgcgcgcgccgtggtggccgatcggccagtcgccgccgccgtcagcgcctgccgcgcctgcccgcgcctgccgcccgtgtcatcgctccgctccaaaccgccccgctgtcatcgccgtcgtcatcgacacggccccgcctctctccgtgcgctagccaccaagggacggaggcagagcccctcctccctctgccgcgtcgcccccatcccctccttcttttcccaaagtggcaaggggcaagccccctttcttccttccttttcctttttcttcctccaccggcgtcattcccctcctccctgtcgccgatttggccgctagccggagcgccagctcgctggcttgaccgtccaaactcggttcccctctcccaaaccgacattgtcgcccatataaacccaagcttccccccctttcctttcctctcccattcgcctcttgtcgccgcctcccgtgctctgttcgctgtcgccgttcgccatcgtgcgtgtcggaggagccggcacgagcgaggacaaggaaggggactccgggcgctcgacttcttcctctcccccggcccgaggccggagagatcactcccgtgtcgtcggcctctcgtcacagcgccccgcctcatctcggtagtgcattcccccgttctccctcctcgatccatctcctccccttagttttcggtagtagcatgtgtagccttcccgtagctagctggcgccgccccgaccgttgccgccgctcgatgtgtgctcaccaccgtcgccgcccgtgctccgtagcgcccgctcgtcaccggcctcgttcggcgtagctccgcccaattcgacactagcaatggattcccgtagccgcgtagatgctctcaccgccgggaatcggcccctcgtgacctcatcgccgtttcccccttctcccgccgtcggttgccgccgccgcaatccgccgccgtcgagcatcccccggtgaatccgagccattggctcgtctcccctcgtcctgtgcaacatcccggtgtgctcgccttcgcctgtatcgccatggttcgctccgccgctcgccgttgtcgtccgccgtccgttccggccggcgtcgtcgtctacctcccgccggcccgcgtggcagccacgtaggcgccacgttggcgccacctcggccgcgacaagcagaccccggtccgccgcttccctccgccccctcgcgcgcgcggtccaccgcgagccgtgaggctgcgcgtgggcccgccgcaccgcgtcctccgcgaactgcgcgcatgtgccgcgcctccctccccaaaccctagcacgccccgcgtgcacctcgctcacggtgagccgagtcgccgacaagcgggtcccacccgggaccacgcgggatggacccggcccaccggctctctcccctccccgcccgcgcgcgccttgggccgccttctttggccggccggcccattaagctcggccgagccgccccattctcttgggccgcgccctagccgcccgaggaaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaatggcatgcttagaggtcaataatagggctttattttcgccgtttgctgagttgtcccgtttcgtgtgtagtttcggagcccgaagacccgcagtgcgatgatttcgaggatgaagctcaagatctcgagcgaggcaagccacctttgaacatcttgagcctatatttgaacttaattatgttgcctgaaaaatattatgcattgataggatcacacttaatctgcttgtcccgtctgcaaggcagattggcggacctacctaatttgttgcatttgacccttccattgtaattgttataccatgttcgcttgtacccacctagttgcgcctcggtaatcgtgcactctgcacgggtatcgacggtcgccttcaaacttaaaatctgagaaacatcttgggtaaaacttgggttttacaaaagacttagaaaacccgacacctgggtcggtgcttgcaaactaaatgaatttccaaaactgcggatcggggaatgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccatggtcatgggcggatgtgaggtgattcctagcgtagttttgtttgactactgccttgtgaaatttgctgttgtggaataggtttgatgtttggaaaatctacggctgatgggatcagccaggcccgggtggccgtttgaaagctgttggccgggtaccaatcttgatcaattcaaaagactgaaacattgcacatactccgaccggatgagacgcactgtctcatccgtgtcgtttgagaagcactcccttagttgtttcagaaaagagtttaaataaaatcaatcgcaaaaacaacggcctttctttgaagcctgcattaaacacttatttcccatggcttgctgagtactcctgtactcacccttgctctatataaataatcccccccccagttgctgaagaagatggagttcttccaggagcaagccggctacgatgagttttagggtttcggcctagttcccaagtcgcgcctgtgatgtttggtccaagtcttggcttccgcttccatttagtaatgcagttgtgagctcgggatctgtccgcagcccaacatgactgtactcctactctataataaagagacctctgttgctgtgatattctgtcttcctgtgataccagcactgtttcctgggactggtattgattaacaggttaatttggagcgtcacgggctagttccggttgggactagttcgaggcgtgacactgcaaaaccaatccttgagcagctcaaccgatagttttgctccggcaacggttggtgtggatgcataatctacataagacatgcacctacgatgggttcgttcttctccatcatcttctacaatcggctccagccttgggaattcggcttctgttactgatggccaattgacaaccttcatgaccattaagttgagctaggattgtagcagccaccatggtccacctgctccaaccactgagccgatggctattttggccgatgcattgttcagcatttggtataagtagccgaggaggattttgcctagaggaaattctcgttttgactcaagagcttcggctgcaaactgccacttggttgtaggaccacagctagatccacagaaaagaaacttttccagccacatgagtagaaaggccacatgttctcgaggagtaacagatccttggcccatgtatgcggccacatagaaagaccagccacctatgcttttggttctaaaatcaaattgattcttggtattcatgctcatagggttggccgatgaggttacatctagtccggtgatcataatcagagtaggagtcatcggcccttggttgaacagaaaggcattgatggtattggaccagaaataagtggcggcggccatcagaggttcatccttagctgaattggctatggtaagggcaagcgcttggccgattccgatttcatcccaatgtgttcgcttgctagctgataggcgcttgtaccatgtggtccaactattctcaggagtagttttctcaagagatggccaagacttaaaagtattcttccagtgacctaggttagggttggctaatctaaaggggattctgttggtttcgccgatgatgaaatcagtagggtctaagttgccgattggaccaagaaagtaatggttttcatgcgacaggctgggaatcgcaactaaattggagaggtgctgcaaatccaaaggattcgagaagaaggaaacaagatgagggaaggggaaatcgaattcttacgaagaaaagggatctagccgatgagaacttacctcggcgtactcggctgatggcgcggtagacgggctggcggaggacgacatcatcgcaggcggaggtccggcaggagatggaatcgctttggaatcgccttttgcgtcggcggagtcgccggagagagagagggcaaagtctgtttcagcagtaaaaacggaagaggacggtgcgagatctctcgagggtgacggttagtatttaaagcatgggagtaacggtcagaaaacggcaaagtgcgaaacttgcttggagttgacgtacagcaaatccgaaacattaccaaatattccggacttggcgggcttgtattaatgaccgaatttggtgatatcagcatcggaaaagaggattaggtcaaagctgagtcaaagacgaagatcgattcgagaatagtgtaagaatcggctggagtccggattggctacgattgggatcggctaagtccgagtcagactgggttaggtgatacggccgattccgacaatacgacttggtgtatgacatcgggttgagttgatatgcttcaagatgattgccacacatggatagagtcctgagaaggcaattgtatctattaattaggatattttatgtaatttccttagagatatgtttgggcaaaagtctgccgtaaagacttatggtattttagagtttgttagagataagagtcgtgtccgatatggacattgtttgtaattttcgggtataaatagaccccgaaccccatgtaatcaattaacacacacgttcaatacaatttcggcgcatcgccacccttttgctttagttttatttcgacgagttcttgctttcgggttgagctgcatcggtttcgatcttcaacaagaggtaaaacttgttatgacggcttacgttctcgggattagtgcttccatctttatgatactctgatcttgtttatgtaattcgtcgagttatcatatatcttacataatctctggcaatatcgctatataacctacattcggctaacatctgtcggtagagggcagccgattaggttaaacatcgatgttgacttagattatataggatatccaccactctatgaaacttccatgggcttgattgtctagatattgttattgttttcatacttaatgctgcatcagttgagtttgatctattaagtcgtgcttagaatatcaatctctagcctgccatctggttgccgattagggtagtatcggagtttcagccgatcttacctgatttaactatatttactccatatgcttcattgatatgttaaatctaccctttatattatgatcttgttgcatttaagtatattagacttttgtttgatatattctacttctcttaatatcttagtatagagtggtatcatagtattagccgatacatgctagatccatttgatcggctatgctatcaacatatataatcctattattaatatatatttcgatctaaatgatttatactgtctcggcatgacgaccgatctatcccaatcactttatttaaatatatatcgatataaggaatatatattgttaatatctacagccgatcgagtggatatagttctttcttatttatttatgactgccgatcgatttacacatgacatcggctcaaggataaatgatatgtcatcggcacatagctgatcgggtatcatttatagatttaaccatggtttctttgcctttatttcttgttgattgcaggatcaaatcaactggcatgctagcatacccgaaggcgagtttggacctacactggagttaagcagatctcctaggcctcgtgtttttcatcaacacgtcgctaacgacccttagcccttttgctatccgagtaatcagagaagtgcactcaacaggagcagagaactttatactttctaacaattgccttatcatacaattcacaggagcaattttgatctttctaaccaaggcaaacatgataatcaattcatctcccctatgggccttagatcacctctaggaaacaaagtcatagcaatccatttgtgcatgagcctaagtgtaggattatggatatcattcgttctaggtttcttgcaaattggagcaccagaaatattttcccaaaacctatttttctcgaacccagaaattcctttctagagatcgattttacaggaatcgtgaaaaccaagaagtgtacttaagcctttcatgtaagtgtgtactccttatggaaaaagcgaaaggaaattccatcttctatttctttcaaagtgcacaaaaattgcaaagtaagcaaacaagaaccaggctcatctaccacagcaaatctctgccaaccaaccgctttctaaatagtacgaaattcaacatccatacctatcttttttagcagctccggtgagtattctcgtgtgtgagcatactcccggtcgctcagcatgtagtaggcttgtctctcccgatcactgacaaggtcgaggtcgatgtcgttcaggatgtgttgaaatggggtggaattccctctctcggccggttgcttaagtagtgcacccacaacggtcaaaaccgacctgtgaggcccactagccgttgcctcaatgaaggaggcagccaaccgttggcctggctagttcgaccgaaccaatgggtttggccgaacccatggtgggcccaaccgtccccgctttcggccgttgggttccaacggtcagtgtggtcgtggcacagcgaattttcactgaaaattttattttggtttgctctgaaaaattcatttgaagaatttcctcaaaattcaaaaatcctatatgcaactttgaaattcaaacatgtgatgatacaaaaattcaaattgttgaaagcaaatatgcggatacataccaatttacctgttggtgaaggtcgtgtcatttaaagtccgacgtgcaagactgtacctccatccagttcagttcgtggattttccacccgtctccggaggtgatggagcgggcgtctttggcttctccttccacacattccttggctttggtgtggaagacggcttcttctgagtcggctgctctatcttcttggctggtatgggtggttttaccggcgtcttccaataacggttcctaggcatcgttgtttccttctctaggaaattctgcatgaatttcaccaggctgtccattttgggtggctccacttcgaccacttgaatattctctgggttcagcccgtactttattctgaccatggagcattgttccatcctcggttgaaactcaaacttctcttccttgccgttgatgtggaaacggatactccccgttcccacgtcaatgttggctcccgcggtgctaaggaatgggcgtcccaggatgagcggtgtctccttccccgtgtccatgtccagcaccacgaagtcaaccgggatcagccagtcgtccatcccatgataaggacaagcggccacgaattcctacagacgttcccatgcttcaggaatagactcatcgcttgcctactggaaacatgaaatccttccacgaagggcattggttttgcccatcaggaagaatttcgagaggaatgttatagagcatttatcccaggtgttgacagcagcacggttggcatagaaccattgcttcgctctcccgagaagggagaacgaaaacagtggtagcctgacggcgtcaggactgacacccttgatggtgtacatgctacagatctccaggaactattgcaaatgagcattggcatcctcattaggcttgccacaaaatgagctagccggcgccatcgtgatgaggctggacttcaagtcgaaatccacgtcccctatgttgaccagctgccaaatggccaaattgtcagcagagaaagcagcgaactcgcggagagtcttgttagccatagtcttgaaggttggtggcgccggtatggctggtttctctattggtagagttttctgcggagcaacgactcgcggcctaacgctccgaaagaaagtttctggattttctttgaagttttccggcaaattgaaaccagtcatgcactaacctgttttcagaacaaaaagtaaaaacaaccaaggtttatcctgcaaaggaaaatgattatacaaaggtaaaaataaagtattagttcaagtaatcactattataaatcttccccggcaacggcaccagaaatgcttgttggtatttcttaacgatattactagaaatataattcccaacaatggcgcagaaatacttctggtatattatggttacagagttcatccgcaagcggacggatataccattgtagcatttcacctgagagtattccaagggtatcgtatttattttatcccgtgggaagatcatgtagagaaaacttgactaataatttatatattacttgtgataatcatattctaagtaggggttaagataatccaagggtagagtgacacacaagcattaactactcattctcataatatatcatctaagctaagtggaaagaaaagagagaaaatctattcctatacttcaaaaatcaattcctatacttttaatatacatagtatacatacattctagttaaccgatatactagctaataccctctatccgataccctcctggtacttcgagaagccacccctgactgctgagttccttacgacagcccgtcatgaccatacaaccggggctaaatacggaggaataccctcccagggaattaacttaggattatataccggcacggaggaatacccgtactgagctgtcaccatcagcggcccacctctcatccgcaatatataaccctaaataatgatatcccgtaatctagacaccacgtctaaactaccacgtactactctaatatcatcgtcatgacatagagtaattgcataaggaaacactatacccgcaccaaagcatctcccagataagctagccgtatattcagcataacatgaacataatgtaaagtaggtactcatatactcggaaagtatttcaataccataaatatatttagaagagtattctagtaaaagtacaaggcttacaaaagagaagagaaaagctactagagccatacccgaactcttcctaaggattccggactcctgatttctactctattcctattccaccagctagatactactaaactaaacttgagagaaatgagagagctattgcttgaggtgtgtgagtgaagtgaggatgagagctccttttatagcctcccaatgacggttgtgacggttggaattgtcggtaataccctctaaccgtcattggggagccatctcagccgtccaggagaaccctggatcaaacggagctatggggggttcggtcgaaacaccatgggctggcccaacccagcccatctttggctggcggcctcctttgttgtcctcctccgtagacttgtgaattttggcccaatgtgtcgtgttatttttgagttcttggcccattcatacataagtctggttctcgacatcgtccgattgatttatcgtctgagttgatgtcgattctcctccactttattgtcattctctgcaaaaggttagtatacctaatactaatggaatattattattctaacaaatatatgcattgcaagcaccactagttctcctctattttagtaatattgacggtcgaaactaatcgataacgaccgtcaacaatgtcgtcacgggacgctaggtccacgatctcaacgatgttcaccctacggtatgaattgagacctaggactcgagcggatccagactatggagaatagatggttcatgggggtctagtcccagatagccgaccaaacaagctaagtcatctgacatatcatcgtatgatcccaaattgatggattgatgtcatcgggagtggatcagacaatgcttgggagaagaactggccgacgtagacgaggtcatggattcgacaactttgatgaataccttaaaccctgtcaaagtacgcattttgtcttgtggatggggcataatttgtatgacgagatgcgttgagtatcatcaagtttgcaaccgttgcatccagttttgtccttcagcataacactgcacccatatagagagtgagaactcgttttgttaatggggcaccacttcttcctaatcttgtgagtggactttgttagagtgcgcaacctagcccaccaaccatgggccactcaggtcttgtcgatggggcataatttgtatgaggagatgcgttgagtatcatcaagtttgcaaccgttgcatccagttttgtccttcagcataacactgcacccatctagagagtgagaactcgttttgttaatggggcaccacttcttcctaatcttgtgattggactttgttagagtgcgcaacctagcccaccaaccatgggccactcaggtcacattgagtttgctccaccacaggctcaaccgaagccacaactctaggtcttgagcctacacaacccaaaagactagtttgatgggtgaggattgcccccaccttttaagtcgtgctctcccatcatcaattaccgatgtgagactaaactcaacaatctccaccgtcgtcacacatcgggcccaacaatctcctatgtcacattaacccatgtgaccctgaagacttgttacctggcctcccccatcatgtgacccatggaaattgttccaggttctaaacctggactctgatattacttgttagagtgcgcagcccagtccaccaaccatgggccacccggtcatattgggcctgctccaccacaggctcaaccagagccacaactttaggtctcaggcctacacaacccaaaaaactagtctgatgggtgaggactccctccaccttttaaaaagtgctcccccatcctcaattaccgatgtgggagtaaacccaatagacttcgcagtcggctccttgttctcggtggaagtcggatggtagatcaacgactgttggcggctgttaaatgtcgattctataccgccaacatctgcataaagttcggataataaaacatccaacatagtgataggtgcttaatctcacatattccacaagtgttggtgtatatttgtatgtagatgatataccctgatgttgggaggaaacctagactaaagtgaggagaattatatatctatacaaggaggggttgtgaacttcatcaaaacatcagtgaattaacccaaaactctgagaaatggatagagaagagcccagggagtccatagaccgaaggccaggccaggagggcccagcctaggttcgggcgaacccctctgatcgccgttgatcctagggtttggcatcgacgctccagatgctctcccaaagacggttgcggggcagttcggacatttccccttctcacaaccgtcatacctgtcctataaatagacctcactttattcactctcacacatacttccaagcttgagctgaattataagaggctctattgtactatattgtatactagaataggaaggaagggagtagagtaggagtcggaagaattccggagttgtcagtaatcttcccctatttcttttattctgtttattactgtgaattcaatataatattcttcttgagtaatttagatttatcttgtgagaattatctcttggttagttccgaagtagcatacgggattattgttcactataatcaactaaaatataatgattgctttagtgagttataaacactaaagtagatagtaattgcttagacgtggtgtttaggtaattattatccagtaattgctgcgtatcccacagtatgtttgaggtgggtgtagaggtggtgacagccctcgagatcacttaagtcctccctgtccgggtacgtagtagagcgacatctgggaactgcgggttgccagtgcctgaaatattgcattaggattaaaattaagctttccctaacaatgtttctcactattaaatcctctctatcctggcttatcatttgcttggtgtccttggatgaaccggaggaagatctgaccacacatgttctcttggattcgatacccttggaatactccgtaggagaagtgctacatcggtatatccgtgcgcttgcggattttgtctgtgatcgtaagaaatactaacaacgacgtaacagcgaagactgggaatgtgacggatccaacatgcagaagagtgaacatcagctgggttggaccgccctggccaagctgattatagaggccattgttagaaaatccgtctcttgtacccatctcgtcgaaacttttttcatcaagccccctacttggcacgctactatcaacagtttatacctgactacggtatctatatagtatggtggacgttgggactaagctatacgtgagattgcggtaaagtaatctaaagacaacgaatttttgtgttgattcagacccccgagataggtagtagccctaattcaattataaatttataatttatatctcacaaattataatggtggagcaagcagcaagctaactaatcttgccaaccaactagtactcgctaataactatccgacgacttgtagccgccggctagttatcaacagcaaaagtaagtctgaaacttaaatttttatagcggctgattttatataaggaaaacgataaggcttggaatcatcaagcgggtcggctccgggtgcacgactcttttttctttcccctgctgagcgcgacttcttaatcatgacggtggtggggaagtaaaaaaaataagaagtaaaaaaaaaagtgaagtaaagtgaggacaaacgatcgagaaatgcgagggcgagcagcaagcatgattgagaatagtaaagggatgacacggcaagaaattaagaagttgtgtgctatacatcctcttatcgtgccaaattgagacaacggtggagccaaggaggctgcttcagcgcgtcctgctgctccaggtccaaatgctgctgcgtcgtcccaacaccggggccaccagcaacaaccttcacgccgacgacgaccccaaccgagatggccggtgcggcatcaccgccctgcagttggtgctgccggactccgtcgacgacgacgagttgctcgtcctcgagtccacgctagacgacggcgcctccttcttggtcgtcgtcgtcctcccgatcgctagcgtcaggtccagctcgctctcttcaagaacactagtgtgagcctgtggcttgtcattgtcgctcccagggaaggtgtgccatggcctgctcgaccctgcctcgttctcctctgcatgataatcgtcttcaggtatgcaactgatgccttgcattgtgattgcagagccggcgtccatcagtagcttctgtactcggtacagccggtgcagctcctgaacctgaacaaagctgctgttatttgcttgaggcctgaaggttcggtactggataaggaagcaagagtttggaagtttcagtatggagtggtgttcttatcttacctgctgcttgaatgtctcctcctgcctcaacatggccatcttcatgtgttccttctcgtactgcttcaggtaccttgacatcttcttgtggccggagaattagaccttttttggctggctttgaagccaaatcacagctgcaaaatacagtgcgagatcaacagattgctctctctctctctctctctctcgatggatgcatacgctcaatttttttctgccatggcagtaacaaaccaaccatataaaattttgcaccctagctatctttatagatggatgcaaggaaaatggaaactatgagaaaggaattgagtggcttttactcacaataggtggaggccgaccagttcgaacgcttatcgggatcgaagcctcaaagaaccttgcaacaggggcacttaactttctcaacaatccacaagagcctattttaaaggcggagagagagcgagagagagatactagcaatggggattacagtgtggattgactgaaatctgaagcatttgagagtgaaagggatgatgcccccaccacaaaatgtcaagcagactagaaaagcagggagacatagcaacccccacttgctataaatatgtgtgcatccatcttgtgttgtatctatccagaaatagatttaaaggaaggcactacaccagaaaggaagaaagaatcacccgaaccaagagacaggaacagctaaagtaaccaaggcacttcacatgtgtgcatgcctgcctgccctggaatcatgctcctcgctcctaacttgttgacatcacagacctcccctcccccactcaggaatatactacaacagtacggacccccttttttctttcttttatttctcaatctagttgaatgacatgactgattaataattgccacccaagattgtttataaccattgtggatctggggatcttgtcgacttccatgagtaaatgcagtcgtcctggagagcttaagcttcaagttaatttgatgatctgttcctcctcttaaagtctgaaactgaacatgacattcagtttcaggtatcacacttctctaactgaataacatgaccccccccccctctttctttctttgttttttttttctgacgggagatgtatgttagtaattaattggtgttatcaacctaaactataaacggtgtttcacattaattagtgatgctaattccaatccacctaattcgatatttgaaaaatgacgcgcacttattgcatgtgaactacagaataattctacttagatgtttgcatgtcctaccttccctttccggcttaatttttctctccatctcttttcttatcaaactaaattattagtgacccagcaccaacaatgttcccccagctttccaagaaacccgatcgtcgccacgtgcgacaatggactccaatcagctagcatgataaatctgagacacggatggggatcaccagcggtgtcctgatgagaaaggcccttttggagatcagaatgatgaagtagcattaagaaatggatgatcctgaactgtatatatgccgcctgccttggagggatgcgagcttcttcagacaactcacgcattaacagccaagcccgggaatctggagacaagggcatgattttgagggatgtggatgcatgtgcctgccccatgatctgatcctccatctgtcctcttgggcaccatgcgtacatgcgctggacttgtcctccatgtcttcttggttagtacagtagacaataggcatacatgggaggcaacggatggattgccattgattcagtactgtgctgtgtactttacagatgatggcatcccaatgctttcttgtttccttcccgccttgctagctgtgctaaatctgtgaggatacgctaccattatctaagtacaattgccagcaggtttaaggatgtaatttatcgtgtcaattgcagataatgaactgcaaatctatcaagttaatttcacctaacacacatgattaagcctacgggtctgtttgtgttcatgccatgacgatggtgtgctctctgcaatcgtgccgcaagcaaacacatagtttgttgcactaattaaccggcttggcgttgacccttctacacaccaaatactaatcttttgtaacgttcatgtgtgtcaagaacttaagatagttcaagcatcgaaccatgaatcagacaggacctacttgatctgataaggtaaattatagctctagctgtcgtttaaatcctgcagtgtttcactgaccgacccatgagggcaaccaaattttaaaaagagtaaaaaggctaaatatcttaagactacatatttaataataataataaaattattccaaaactacaaaatttagggtttaaatccctagcaataatgttatgtttgaataattagcatccaagttttctgattaaattgatgctcaacatgtgattttgtggtaactttattattaaatctgtagtactgcaccacaaatatgtagttctataataacttcggtgctataaatatatagttttatgataaatcattgtttgataaaagatttctatagttttgtcatcattagtcttataaaaattactttcataaatgtggacaatgctacattta

SEQ ID NO: 41817 - DNA, 4349 bp, Oryza sativa
aatcattgtttgataaaagatttctatagttttgtcatcattagtcttataaaaattactttcataaatgtggacaatgctacattatgaaacggatggagtacaagcataattaaactcatgagactaaactgcagctaacaacacctaattaaatgactgatctatacccatcaatgttcgttccattgctctctaaaaataattaggccttcgatctcgactctcgactgctatctccttttcgctggaccagcgaagagcgctagcccaagtaagatcgaggaaagggtggtggtctgaaaaaatgagcacaacgccacagaccaacaggctgcactatgtttaatttctccgtatataaattaattccttaggtatcattaagtacatgaacagtacttgcaactcactcagccaagtgcttaccgagagttactatggtaatctgcctctcgcattttggatagttttgatggatatcattgttggtggtatggcatgaggcccttcgaccaaaatctgctgaaagctatacgaagagtggggattcaagcccgagacgtcaaagttagtcggggcgaagtccccccatgacgaagactatggaacaaggacggcgagaggcgagggatcgcacgggtactctgccaagccagaggcctcttgggcgaaggatgcagggcgaagagtatatgccgaagggagacgacttcgccaaagcaagctcgcccccgcgagggccgaagaagcctttcaggcccatcaagtctaggggctattgagctgacgatcgcccgacggcccatcaggggcctgtgaacctcaattaccctatgtacccatgtaaatgtccctttcataagggtaaccatgtaaattcccctgtataaccaaaactctagtagtaagaacctgtaataggagctataaatagtctcatagggccatgtaatggggggatcccgaagaaaaattctctaattaatacactttacttctgtcgcgactgagaaaaatgcattttcccgaacgctagtgtattaatccccgtcccaggaaaagtcggggtacaccacacaaacatgatacaaaagacacatctttattatatcgataatatttacattattacaaaggcacttaaggcctgacaatcaaaaataaacagcagcggactagcgggactatggctccatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtgcaaggggtaataatataggggttaagttttgcagtaaacagcatttaaaagtcacttagttgcccaaagccattttataaagatgatcctagagctacaaagtgttattaatcaaggccgtaaaccctcacgaacctgccttaattcaaggcctacgatgattcagaccgaactggcaacccgaccctgggtcccagctcatcccaagccaacccaggccaaccattccacattttagtagttaagcaggttttaagaattaaaacactaacttgggtacattgctaggcttgcccataaccgagggcgcggctattcgaatagattatactctgatcagaggtgtacatctttacccacaagacacatcatcctcacgtgtaaccacgtgccacataccaccacggcatacggacggaagacgtcacatagttcccaacccatcctagccataaacaaaagtaccgacccagccccatctacagccggaacctccgggacaggcaggcaggattgagctcctagcagcaggacaccagccctgtgccatgacatctcgactaccgggccgcagctcgtgtagcctttatttgtcctagagatgtccatcgacccccgacttcgtccatctccatccgtgtacctttgtttataaccagactgagccacaaactaagccttacccactagacatgtggaagtacggtagtgctttccaacagaggcccgagcttaatccttatagtacccgaggtacgactaacaaaacccaaccacggacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaattagcgaagcatctacctaaattcatactagtggaaccatgaatagggtacccactagttggggttttgtttatcctagggtgaacaaggtaataataacaataacaacaatgataaggtcataacaaagataaataggcatggctaaataaaacagtgataacgcgggaatttgaataaagcgataatgcaataatttaaatcaaaataattttataaactaggattcaatatgctcaaggatgatgtgacttgccttgctcagagataacggccttccgaaccttcggcgatgaccgcgaaccacgcttcgggaacctcaggaacgacagaagctacgcgaagcacacaagcaaagctacaagcctataaagaagcaataacaatagataaaaagaaagcacagggttctttaggttataacaaacattaggagacttgaacggatcgattcggagctcgtatgaccaatgcatggtcatccgaagtttaatgttgttatatggagatttgtggattattataattaggttttacaactataaaacatgtgtaagcgctagcctggaaaagacaggaaggctgcgccgttgacatgcggaccccacatgtcaacctaagggaccacggcagaccgggtacacagagatggtccacgggtcgacggaagcggaccccatgtgtcaaccgaggcgagtggccgacaaacggactccactagacaccacgcgggctgcacacgtggaaaccacgcggtaccgagcgggcacactaacacggtcaccacacgcacaagcgaacgactaccgacaccagtacacgggtaccggggtcgacaaccgcacaacgggcacgggcgacaccaaaaggacgaggacgagggcgacgagggagagagatccttaccaccacgtgacgaggcgagggaacgacaacgacgaacgggcgcggcggagacggccgggaacgatggagacgaaaggcgaggggacgactccggtggcgatccttggacaaaggcgagacgtggccggcgcaacgcttggcaacgcagaggcgaggacgaagacaatgacggggctgcggcacttgacgtagcgaggacgacgaacgagaacggcttgacggagggacgaacgccacgacgaccgggaacgacgggaggacgacgatgacgacgaccggggccggcgaggaggcgacgtgggcagccggcagtggctacacggcgacgaggatggcgtggaacacgccgctgtgaatccgaagacggaggcggcgccgcgagacgatgagccggcgaggacgaacgaccgaccggaggagtcgtcgacgaggacgaacggagacgacaatgacggacagcggaggggttcggatggagggaaggcgatgccgaggacgacgtcgctggctcgccgctgcgatgccggaggtggtggtggcacggccaacggcgcacgggcacggcggaaggggttgccgaaggaactccagcgagaccgagggagaggcgccgcgggcgacggttttccggcaaaaccgatggcaggccggggtggagggcgatgcgccgactccgagggaggatggcgatgacgacagccgctgcaccggcgaggcggcacaggcggctggaggcggtggagtggtggcgacaccactggtcgtcggcgaggacgtcgctccgataatttccccgcgaaacggaggcgacgccagggaagaagaggcagctgcgaggccgctgggggcgacggcacggccggcccacacctgagcggcacggcaggggcggctggattggccggcggcgtgggagagagaggagggctgcggggagaggtggtgaggccacgggagagcgcgggagggggttaaaacgatagacggagcgagcgtgttccattttatagggtaggagagggagccgggcacggaagacgtgggaacggcggcggaaaagccggccggcagccatggaaggtggccggggttggcgcgggcgttcccgacgattgggggcacgaatcaagggggatattagggggaattgat

SEQ ID NO: 41818 - DNA, 11751 bp, Oryza sativa
tgattcgagtggtcactaatggggcaagaagcatggttgttggtggtatcatcatcattagtattgctaatgttattgtctgcattgtgtccgtcttcttggggcaggaactcttgatgcgcaatagaagatccggtgatctgaagtggctcagtgcgctgtctttggttaccacatggaaatgttgggatgctgacaatccttctcttgcagttcttcatccgattatgctcactttcgagttgtatggttttgtccacaagtttctcaaaatcttcatattcctctaggagtagttgcactgcgatctcatcttttaacccctagagaaacttctcttgtttgtcttcatcagtttccacatcttctggtacatagtgagccaaacgatggaactcatgcaggtactctgtgacggtcaaatcttcttgcttcaggtagcggaattctcgttttctcagtgtgatcattcctgcgggaacatgtgatctcttcaacacggctgaaaactcatcccaggtgatggtatgtccttctggccgtgatgcttcgtagctatcccaccattctgaagctggtccaaccaactgatgagttgcaaagacaacccgctcctggtctgtgcactgaatcaaccccagcttcttctcgactgtgcgcaaccaatcactagcttccataggatcgacggcaatggcaaaggttggaggcttagtttttagaaattctgataacttgcactgttgctggactgtaggtacttgaacgttggttgcccctgctgggttgttccaattctgtaatagttgaaatgctgttgccaacatgttggtttggttaaccacaatttggattagctctggtgaggtttcgttgatgcttttctcattcccattggcttgggttcttgagtcatcggatccatcattcacatagcctttgttaccagtgttatccatctgtcacaatgtagaggttgagagaggaagcaaacaaggaaagaatagaccagaactagggacaagaccttaaaggaactaactctttttgttgatgtgttgtttgttttgcttattctgcaagttgattaagcaaacaacctagcatggttacatcacaacccactgatgcaaaccacgcgctacacatacaagcaaaggaacacacgactaacgactctaccctagagggtggcttaggttctgcgacgggttatccaagatcttcactccttcacagctggcttcactgcttcctccacttcgctagcggatcccgcaatcttccggagcttcggcagaaattgacgacatcttcttcttcgcaaagctgaccatctagtactactagaaatttgaagaaggaagaaaagagtaaaccttttgcaaatagcattaggggaaggagaaaaaaagaactttcgcaaatagttttatttataaaatatgaccttaggttttatccacttggcttatcctacagtcgatatggctttgataccatcttgtcgcgaccgagaaaaatacattttcccgaacactagtgtattaatccccgtcccaggaaaagctggggtacaccacacaaacatgatacaaaaggcacatctttattatatcgataatatttaaattattacaaaggcacttaaggcctgacaatcaaaaataaacagcagcggactagcgggcctacggctctatcttcacaggcactcaactggggtataagccaggactccacctaagacttcttctccaaagcttctcttactgaagggggggaaagattgagcaagaatgagtacaaccacagtactcagcaagccacaccggcagatgcatgattaatgcaagggggtgcaaggggtaataatataggggttaagttttgcagtaaacagcatttaaaagtcacttagttgcccaaagccattttataaagatgatcctagagctacacagtgatattaatcaaggccgtaaaccctcacgaacatgccttaatccaaggcctacgatgatttagaccgaactggcaacccgaccctgggtcccagctcatcccaagccaacccaggccaaccattccacattttagttgttaagtaggttttaagaattaaaacactaacttgggtacattgctaggcttgcccataaccgagggcgcggctattcgaatagattatactcttatcagaggtgtacatctttacccacaagacacatcttcctcacgtgtaaccacgtgccacataccaccacggcatacggactgaagatgcgacatagttcccaacccatcctagccataaacaagagtactgacccagccccgcctacggccagaacctccgggacagacaggcaagattgagcccctagcagcaggacaccagccctgtgccatgatatctcgactaccgggccgcaactcgtgtagcctttatttgtcctaaagatgtccatcgacccccgacttcgtccatctccatccgtgtacctttgtttataaccagactgagccacaaactaagccttacccactagacatgtggaagtacggtagtgctttgcaacagaggcccgagcttaatccttatagtacccaaggtacgactaacaaaacccaaccacggacctcgagcccagcctaaaaccattttgggggttttgaatagagggggaggtgtgtgtccaattccaacataagccaaccataccatagtgtccaaatgatatgagaattcccaaagtctaaagttataaaaccacctaatgttgcctaattagtcagcgaagcatctacctaaattcatactagtggaaccatgaatagggtacccactagttggagttttgtttatcctagggtgaacaaggcaataataacaataacaacaatgataaggtcataacaaagataaataggcatggctaaataaaatagtgataatgcgggaatttgaataaagcgataatgcaataatttaaatcaaaataattttataaactgggattcaatatgctcaaggatgatgtgacttgccttgctcaaagataatggccttccgaaccttcggcgacgaccgcgaaccacgcttcgggaaactcaggaacgacagaagctacgcgaagcacacaagcaaagctacaagcctataaagaagcaataacaatacataaaaataaagcacagggttctttaggttataacaaacattaggagacttgaacggatcgattcggagctcgtatgaccaatgcatggtcatccgaagtttaatgctgttatatggagatttgcggattattataattaggttttacaactataaaacatgtataagcgctagcctggaaaagacaggaaggctgcgccgttgacatgcggaccccacttgtcaacctaagggaccacggctgaccgggtacacagagacggtccacgggtcgacggaagcggaccctgtgtgtcaaccgaggcgagtggccgacaaacggactccactagacactacgcgggctgcacacgtggaaaccacgcggctaccgagcgggcacactaacacggtcaccacacgcacaagcgaacgactaccgacaccaatacatgggtaccggggccgacaaccgcacaacgggcacgggcgacaccgaaaggatgaggacgagggcgatgagggagagagatccttaccaccacgtgacgaggcgagggaacaacaacgatgaacgggcgcggcggagacggccgggaacgatggagacgaaaggcgaggggacgacttcggcggcgatccttggacgaaggcgagacgcggccggcgcaacgcttggcgacgcagaggcgaggacgaagacgatgacggggctgcggcacttgacgtagcgaggacgacgaacgagaacggcttgacggagggacgaacgccacgacgaccgggaacgacgggaggacgacgatgacgaggaccggggccggcgaggaggcgacgtgggcagccggcagtggctgcacggcgacgaggacggcatggaacacgccgctgtgaatccgaagacggaggcggcgccgcgagacgatgagccggtgaggacgaacgaccgaccggaggagtcgtcgacgaggacgaacggagacgacgacgatggacagtggaggggttcagatggagggaaggcgatgctgaggatgacgtcgctggctcgccgctgcgatgccggaggtgatgcgtcgctggcacagcgaaaggggttgccgaaggaactccggcgagaccgagggagaggcgccacgggcgacggcgttccggcgaaaccgagggcagtcctgggtggagggcgacgcggcgacgttgagggaggatggcgatgacgacagccgctgcaccggcgaggcggcacaggcggctggaggcggtggagtggtggcgacaccactggtcgtctgcgaggacgtcgctccgataatttcccgcgaaacggaggcgacgccggggaagaggaggcggctgcgaggccgctggcggcgacggcacggccagcccgcacctgagcggcgcggcagtggcggctggagttggccggcggtgtgggagagagaggagggctgcggggagaggtggtgaggccacgggagagcgcaggagggggctaaaacgatagaacggagcgagggtgttccattttatagggtaggagagggagccggggacgggagaggagggaacaacggcggaaaagccggccggcggccttggaaggtggccggggttggcgtgggcgttcccgacgattgggggcacgaatcaagggggaaattagggggaattgatgtggaaggaacggggattaattccccccaatcaatttggaaggaagggcattgattcgcgtggatttaggggaggaatcgacgctaggtttcacgggagagagaagagagaaaggatgccgggcgggaggaaggagacgaccgggtgggtgggacccaccggtcgggcgcgcagttagcgcgcgtgcaacgcgcgtgcgcgggaggggcggctgggtggcgcggtttgggccgggcggccggcccaggaggagaggagggagaggcgacctgggggagagagggaggaggagggggctgggccgaggggaaggagaggaggcccaagagaaggagggagaggaggagagggagagaaagagagggaggaagtgaggactttggccgcaggccgagagagagagagggaggactttgggccagacttggcccaaagggaggagggggattatttttagtttttctttttagtaaactttgttaattgtttttgttgcttaataattatttccggtgctctgaaaattcaagtaaaatttgagggctccttttagaccaaggagaatttaacaaaaattctctggaccatattcgaatttttcttgtacgtattttagtgtttgtcaatttcttttcgatttttaattaattctattattccttttagagaatgatttttatttcgggataaatttatcaggacgtgacaacttctttcccaaccactgttgagtgaccacgtctttcgacgtatgcggttgtcgtttcgacagcagctggcgtcgatcgtggggacctccaagcgaaaccattgagagcgaatgccaccgaagaaggtcgtgaaggagaaggttacaaggcgaaaggaaagtgacgtcagggcggatatggccaccgaagagggagcagagacttcggcgcccgttgccgaagatggaggagcgccatcagcttccgcacctgcaccatcactaccgccttcggcccctgccacctctgtgcaggtgccgaacatggctggtatggcgaaggcggctgcggcggcaagggcactccagaccagggcggagatccttttgacaagccaactgctggtgccccaagccgctccgtcgtagtcggcagcggccccaactgcgctcaccgctgtgcaagcccaagtcaaccctaaccccgaaacacaaaccgaagccaacatggaagccatgcgacagaacatgacacgactccaagacatgcttcgccaaatgcaagaacaacagcaagcatacgagacggcaagacgatccaaggtcgcttcagcaccaatcctccagtattcggcaggttatgtcccaccccaagtctatccacaagtgccgacccagccccttccgccacaagtcgcgcaagcgccaatgtacttcgtcgggcagccatcgaccgcagcagcgcatccggcccctcacgtgcagctgcaagctcagccggtcgctgcccaagttgtaacaccccagcccgtttgaagcctgttagtagtgtgagtttggcccatgtggcccagaagtggatgtgtagtggtggtttagtaccaccttggaagtttaggtgggtgagagcctgcttataagccttggtgctccaaccatggtatccccgggttaacccttttacacgaagcgaggacgaaagtgtaagcgggataccatgcgaacgtgggtccgctcaacgtgtagagtggactaatgcggattttggaggcagggtgttacagttggtatcagagcataaacctccgttgtgtgatgcatgtgctttgggccatggtctgcaccggagggggttctaggcctctgccatgtaaacggtgagctgccggggcgtcagcccttaaggggggtaaaaggccatggtctgcaccggagggggttctaggcctctgccgtgtaaacggtgagctgccggggcgtcagcccttaagggggggtgaatgtaacaccccaacccgtttgaagcctgttagtagtgtgagtttggcccatgtggcccagaagtggatgtgtagtggtggtttagtaccaccttggaagtttaggtgggtgaaggcctacttataagccttggtgctccaaccatggtatccccaggttaacccttttacacgaagcgaggacgaaagtgtaagcacgataccatgcgaaagtgggtccgctcaacgtgtagagtggactaatgcggattttggaggcagggtgttacacaagtacaacctcaaccacctggccaagcaccacaaacaatggcagaaggggcttcggctctgcgggcgcagctccaagctttccttcagcagctcagccaaccccatagcatttcaggtatagccccttcagcacacccggaggggaatacaagtcatgatgcaccgagttggttgccgtcgaatcagccaagtctgggagcttcgccgtggagtcaaggaccgtagttcaacttcatcaatgcttcttaggcaccaaccattcggccgcaagcaccaacgtcaggcttcggagcaaaccaggcaccaaaccaggtcgccatgacacggtcacagccaacttttgacccatccatggtagctcagcaagcatcaccaatcggagccgggcagccgaatgccatggcccaacctcacgcgcaagccatgatttcgcccttcgccacgccatacccgcagcaaggtgccgtgaacagggcagggagcgaaaaggggctatcgctgagtgggggaatcaagacccgtccaatcccaccctagttcaagttcccacccgtcccacgctatcaggtgaaacagacccaaaggaattcctctccatttatgagtccgcgatcgaagcggctcatggcgacgaaaataccaaggcaaaggtaatacatctcgctctagacggcattgcccgttcttggtatttcaatttaccagccaataacatttactcatgggagcaattacgcgatatctttgtccttaactttcgaggcacctatgaggagccgaagacgcagcaacatctgctcggcattcgccagaggccgggggagtcgataagggagtacatgcgtcgcttctcgcaagcccggtgccaagttcaagacataaccgaggcatctgtcataaacgccgcttcgaccggtctactcgagggtgaactcataagaaaaatcgccaataaggagccacagacgcttgagcacctactttgcatcattgacgggtacgcaaggggcgaagaggattccaagcgatggcaagcaatacaagatgagtatcataaggcttccgtcgccgcagcccaagcccaagcacaagttcaagttgccgaaccacctcctctcgctgttcgccagccccagccatccaaggacaaccgccaaggcaaggtcaagcccccccccatgatctagaggaagttcagaaccgaccgtgcgggcaaggcagtgatggctgtcaaagaagtgcaagccctccgcaaggagttcgacgcccagcaagcaagcaaccatcagcagcctgtccgcaagaaggtccgaaaagacctctactgcgcctttctcagacgctcttcacacaccacagagcaatgccgaaacattcggcaacgtgtcagcgggcaagatccaaggccgcagcagggagcagctgtcgaagcacctcgtgaagcagctcaagaacaagcaccccccgaacagtgccaagacgcgcagcgcagagtaatccaagtgattacaagggccgacccgccgatccagctgtcgaagcgacaaaagaagatgcagctacgaacggtccacaatatcactttggctggcgaaggggccccgcagtatctgaaccagcaaatttcttttaggccaggagatgccgaaggagtaatgttcccgcatcaagatcctctggtgatctcagccgagatagctggtttcgaggtccggcgaatcctggtggacggagggacttcggccgatgtcatcttcgccgaagcatatgccaagatggggttagccacccaagcccttaccccagcaccagcatcgctccgacgtttcagcggagaagcagttcaagttcttggccaagcacagttgatggtagccttccgcacggcggaaaacagacgcgaagagcaagtattgttcgacgttgtcgacatcccgtacaactacaacgccatcttcggccgtgcaaccttgaacaagttcgaagccatttcccaccacaattatctcaagctcaagatgcccgccctgatagcggagaagcagttcaagttcttggccaagcacagttgatggtagccttcagcatggcggaaaacagacgcgaagagcaagtattgttcgacgttgtcgacatcccgtacaactacaacgccatcttcggccgtgcaaccttgaacaagttcgaagccatttcccaccacaattatctcaagctcaagatgcccggcccgacaggagtgatcgtggtcaaggggcttcagcctttggctgcttcaaaaggcgatctggccataagtagtgcacaatgttgaggccgaaccgcatgaccgtgcgaagcacgcgccaaagcccgccccacacgacaagataatcaagatacagattgatgatgccgaccccacaaagctcgtatcgctggggggcgacatgggcgaagaagaagctgagaacatcctagaggtactcaagaagaacattgatatcttcgcctgaggccccgatgaagtaggaggtgtttcgacagatctcatcatgcatcacctagcagtcaagccggatgccaagccaaggaaacagaagctacgcaagatgtccgctgatcgccaagaggcagcaaaagccgaagtccaaaaattgctcaaggctggggtcattcaagagattgaccatcctgagttgaccatcctgagtggctggagaatccagtgctggtgcggaagtcaaacggcaaatggcgcatgtgtgtcgatttcacatatttaaacaaagcatgtccgaaggacgatttccccttgccacggatcgactagctcgtggatttgatagttggctgcgaactcatgagcttcctagatgcatattccggctatcactagatccacatgaacacggccaacatccccaagacagccttcatcacaccatttggcaccttttgtcacctcaggatgcctttcggcctgaggaatgccagagcaaccttcgccaggctggtgtacaaggtcctttacaagaaattggggcgaaacgtggaagcttatgtcgacgacatcgccgtaaaaagccggaaggctttcaaccacgcgtccgacctacaggagaccttcaacaacttgcgtgcagcgggtatgaaactgaatcctgggaagtgtgttttcggcgttcgcgcaggcaagttgttgggtttccttgtttctgaaagaggcatcgaggcgaatcccgagaaaatcgatgccattcagcaaatgaagcctccgtcgagcgtacgttaagtacaaaagctcgtaggccgaattgcggcactcagtcgattcctctcaaaggcagccgaaagaggtttgctcttcttcaaaaccctccagggcacgggaaaattcaactggacacccgaatgccaagcagcgttcgacgagataaagcaatacatgcaaagcctgctagctcatatcacttcggccgcagtacagaagtttgtatggaaaaacattgtttgccgttttggagtaccaaaagagtttatcactgacaacggcaagcagttcaactctgacaagttcagagaaatgtgcgaagggcttaacctggaaatcaggttcgcgtcggtcatgcacccgcagtcaaatggggcggccatacatacaaatggtaagatcctaaaagcactaaagaaaaggcttgagggggcagcgaagggcaaatggccagagaaaattctatctgttctttgggcccttcggacgacccccacaagaccaaccaagttcagcccgttcacgcttctttatggtgatgaggcaatgaccccaacagagctaaggactaactcaccaagggtgacgttctctgggggcgaagaggggcgcgaggtgtcgcttgaactcttggagggggtaagagtcgaagcactcgagcacatgcgcaagtatgccataggcacttcggcaacttacaacaaaaaagttcgaccgacggagctgttgcctggtcatcttgtcttaaggaagaaggcgaacccgatagccgttggcaagcttgaatcgaagtgggaaggaccgtacctcatcaagcacaagtccaggacggggtcctttcgactggcgacactggaaggcgaagagttcgaccattcctagaacgctgcctctctcaagcgtttttatgtctagaacggatggcacccatatcgccaacttgtaaaaatgtatatatcgttatgtaagcccttcggtaagaaaaaaaagagaaaaaaaagatgaaaatgaaaaaaagacaaaaaactagatgtagggctattatccaccacgaaggcccgaaccagtataaaatctctatgtcctctgccttctttttatttgtttgtgcgattgataatttgtggaaaaaccccaaggcaaacgcctgatcagcgaaaaaggccaggggggcgaaacgaatcaggcgaagcatcgctcgccaaacgattgaaaccgcaacagcttgtttcggagaacaactagccgaacaccgttacactcgatcaaaaggaaagcacgagtgcttcctacaacgtagaacaaaacggatcgaaaacggaagccgaaagctgaaaagtcaaaacctatttcgctaatatatgcaaaggagccgacacgttccgacccaacgaaaagcacgcgaagtgacaatgca

SEQ ID NO: 41819 - DNA, 2049 bp, Oryza sativa
aacgatgctgggagatcgcctcctgccgatcagtcttttgatggtttcgccaaaagtgagccatatcctccaaacgtcttgaatgaacaaagatcgtagtcttctaaggttcgcccggggtgcacccgaagccattcggcaaccttaaaaaccttatagctgcggccgtttatcaccatttcacgataaacaggccgaaatgggcatcgcaccttcggtaaatccttcaatgccacaaatttctgtagaatcgaatcacaagaactaagccaaccaaaggggggtgaatggttggtatacccaaaaaccgaaaacttttagcggaaataaaagttaccctcgaaatcgacggatcgcggtctgaccgaagttgtcctgccggtctgaccgcctggttgccatcggtctgaccgcgattatatcttcggtccgaccgccgagatcagctgctgctcgctgtcgccgccgccggtctgaccgccgtgctcccgccggtctgaccgccgaaacccggtaaacacaaatcgaagaactcttaaagtaaatgatgactttattgattctctctgtgtttacaaagtgcaccaacagcactccttacaaaaatttcaactaaactcgaaaccctaactcaaaactcaactcaattgctctccaaagcgatacagggaaacctcacgctccccctctatttatacatgaggtaggcagcctaaagccacgaaccaaactcatactaagagtcctaaacaccttaggaaaccctctagtacaagaaagaaactttacataaccaatcgtacaaaatttggactccttccaaatttgactccgcatcccatacgcacacaataactccatcgtatgccatatggaatctccatcaaccacgtgcatcaactctagcctaagtatcccgcatgatctctgaccaccacggacgtcgtcttatccccaagccgactcccggtccatcaccgcaaatactctcccgaggcatcgagtcacctacacatggaacaaacaaagaaaccatattccgaaaccaagctatctccaacttgactcattagtagcaaacaacagtattatatacatctagtatccatctagaagtcataatcatgaaataatcacggatatccaaacaaacaacccgaaaccgaaatcgacacagtgtcggccggtcagaccgcgggctggccggtctgaccgcgcgcataccgccggtccgaccggctaccagagcccggtctgaccggtcacatgaaataatgaatcctgcgatcacctgtgaatccaatcatctccaaaaccacttcgtgaataaattccaaataacaaaaccaataatctctaatgcccaattgtttatcatagaataataatcaaaaacacctttgattttacaatctccaccttgatgaacacattggcaaacccataaaaaatgttttggtgtttggaaaaataaaaacaaaagtggtaaaaagcacacttcgtacaaatgtacacatcgtgctcaaaaatccaaaagaaaacttctccccgtttttaaaaagtaagaaattcccaattgaaccagaaacatgctcttctcaacaactctccaaaaattcatcttgcttctccaaaaatccaaaaattttcacattacttctccccctttggacaatgatttcatcaagcataggaattatgttcattaatgttcaagagtttagcatacatatagcatatcaagtcatgtgttgcaataaaaagaatataaacccatctataatataacaatcatgcattaaagtataaccatgaaccaaagattttacaattatgcttgaatcaacagtcaaaattcatgatttcatatgatttttaatgcaacatcttaacaagcatataggttgaaaaataaacactaaacacatatacctattacatttatcactctttctcaagtaacctttagcacaaaacaaccaagagaatttttttaactttttatttttcttgagcctttttgctcatatttttctcttttattccggg

SEQ ID NO: 41820 - DNA, 8965 bp, Oryza sativa
gattcggtattcatttttttcatattttttattatcttttcacaatgagcaattaaaactatttgaggaataaaaagtcaataaagcatatatatatagcatttatacatcaaaccatatgctagcatcaacattgcatatttgcttaattcaagtatagaatttaagtgtcatgcatcatctcccttaaaaacaaaatctaaatctcatgaaaagacaaaaatacatacatgctatgctagagacaaataaaccttcaaagtattgctagcatgtacaagaaaataccatatgtataaacaaagctctcttttctcaatttttctcattgtcatattattgctcgataaaaccatgaggtacaaaatccccctcaaaccataccaaaaggatgaattatacctaattcaccacgaagaaaagcaaagcgattagaatccaaaggtttagtgaaaatatcagcaatttgtaactttgtgtccaaaaactgcaattcaacatctcccttctcaacatgatccctcaaaaagtgaaaacgaatatcaatgtgctttatgcgtgagtgttgaacaggattcttagcaatattgatagcactagtattatcacaaaagagaggtactttctcaaaagtaagaccataatctttcaaagtagataaaagccaagaatctgtgaacaacaactagcagcagcaacatattcagattcagcagttgactgagcaacactagattgtttcctagaagaccatgcaatcaatgatgtaacaagaaaatgacatgttccactagtacttttcctatcaattctacaacctccaaaatcagtatcagaatatccacttaagcatatagaagatgaagtagaataccaaattccaaactcatgtgtatgattcaaatacctcattattcgcttgaccgcttgacgatgtgaaacacgaggagaagcttgaaagcgtgcacacaaacacacagcaaattatatgtctgacctagaagcagttagatacaacaaagatccaatcatatttctatattccttttgatcaacagcttcaccatcttcatcaggatccaacacagctgtagaaccaattggtgttgaaattggcttgcagttctccatcttgaaccgtctcaaaagatccttcatatacttcgtttgatgcacaaaagtaccttgaggtgtttgcttaatttgcaatcccaaaaagtacgataactcacccatcatgctcatctcaaattccctgcgcataatctcagcaaaatctacaaccaaagcgtgagtcgaacaaccaaagatgatatcatccacataaatctgaacaaaaagttgattatcaccatgcttaagaacaaaaagcgttttttcaacctttcccattgtaaaacctttcgcaagcaaaaagttgttaagcctatcataccatgctctaggagcttgtttcaagccatacaaagctttagacaatttaaaaacatggttgggaaaatctggattttccaaacctggtggttatttgatataaacttcttcctgtataaaaccatttagaaaagcacttttcacatccaattgatacaatttaaaaccttttgaagtagcaaaagccaacaaaagtgtaattgcctcaattctagcaacaggagcaaaagtttcatcaaaatccaaaccttgagcaacaagtctagctttatttctcacaatcaaaccatcatcattttgtttatttttgaaaacccacttggttccaataatattatgtccagaaggtggtttgtcacgcccggaatttctatccaaaattccaaacgcttacatatgtgtgaaccctcgtccaggaatcagccgaggcacacaataacaaattgataattgtcacatcctgattttcgtttcaggatttataaattatttaataaattattattagaatttatattaaatgatctttaatttacaagtgaagttaaatgtgggaaataaaatttcctaaatataaagcatggatggatttaatttttattaaattctccatggttaattatactctctggaattttctcagatttttcgaagctcaattcctaattttaatcatacaaagagcatttcagtaattacccacatattaaattaatcattaaatggtctaattataattttgttaagtactttgagtccaagtattttcaggatttttcttgaaattatttgggcattggaagtatttttaacaattcaaagatcatttcattgattaatttaattcgaaaagtaataataatcctcttcctagtcttgggccctttccagcccatctccctcttttgtgtgctcggccgtacagcccaagtcggcccagccgagcttcccccttctctttctttctttgctttgttttcagccagcccaacacgaaaagtctaatttgcctccccttctctctcccttcctctcagcccgcatagaagtctgtttttcgtccctgtcgctacagtgctccttcttctacctccagacagagcccgagctctccagcccgtgcacagtgccgccgcctcctcccaccaatctcgcctccccgttgctccttttttccaattttgttgaggggaaatattcctcttatcctcctctatctttacccccaaaaaatcggagctaatcgttgagtatctcatccgaatcgaactcgttttcgagtttatctccaaaaccgagtttttgatttcccggatcgatttcttgcgggaggagtccgatctcttcaatccaaggatataaataggaccccctagtcttcctctttcgtttgcccctctcccgtggtctcccgtgccccatagcctctccgccgccgccgccaagttcgccgccgccgccggccgaacttcggccgtgtcgcgccgtcgcctccgccgttgccgtcggtcgccgtcaccgctgtaaggtgcgccgaggtgtgggcaagctcggccgctccctccccgctgtcgccggtcaccggagccccgtcgccgccgtcgaccgaagccgcgccgccgctagacctcgtcgccggccgtcgtcgttcgtcgtttggttcgagggtgagtacctttgggttcgtctcgtcgtcctctacgtgtacatgtcctccaaagtcgcagccgaccatccaatctccggcgaggtcgccatcatggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaattatgatctacatgtttgtttactttttatgtattgtttatttggtttttattattcttttttttcgttttgcgtgttagcttgtcgtttccgtcgttgcgaaggttcgtgagtgcgtcgtgagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggataacttattattcactattatttaaggatggtttaatgatagtccacgatggttaatcgtgattggttaattaattacttgccaactaaaaattgataatggtgggttgtgagcacatggttttgagagttgtgctcatgacaattaaggaccggttcgcgagctactattgtgaaacattaatcgtgccaaccacaagccagcgtgggcaacggctttaccttttgtacagcatggttcattgcggagcaccagactgagaagtggcggagataagcccacgggggtcgctggggagtccatgcctctggttattgaggaggtgattatgatccaggaatggtgcactgtggtgagttgtgttgtgcagagggtattgtcacagcctctattcgggtactttccactatcgcgacgcatggtagacatgatgttgaggctgtgtcttgtgggtacagtggtacacctctggccagagtaaaactattcgaatagccgtgcccgcggttatgggcgggttgagcaatgtttttcatgattagtcccacacctctcacaataattatggatgttatacctggtaataatttgtttagctggttgggcctgtgcagcatgggtgtgctgttcagtgttgattaaaatttctgattaattactccactgtttttacttctcttaaaagttttgctaaatgctgcttttgcaaatgaacctatattatgcttgtgcacttgtatatttgctgtgtggcttgttgagtatgttatatgctcatccttgcaataatcaatcaacctcagttgaagaaaaaggatccagaaggagaagacgtttggcttataccccagttgagctgcctgtgggagtggagccggagcttcgctagattttattttccgctgcaaatttcttcttaatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaataatagagaacaattattactctaattaataagcgaataaaatgtcattacagaggtagatagttcctctcaatcaataaagatctaagcagcggaaaaataagataaacggcgcagacgactctactccacaggcagcttgaccagggctacacctaatcctccacaccatcagcatcactgtagaactcctcctctgaagaatgattgcaaggtgagtatatgacatactcagcaagccacgcagcaaatatgcaagtgcacaggataacaaaggatggcatagtagggtttcatttgcataaacaacatttaataaacatttcagaatttattaaaacagttaagtaataattaaacaatattaatccaacgctatacaacataccctattgcataggcccaaccattctgaacaaccatcccggctgcacagttctatctccaaaccaggaattaaccattccaaaccaggagctaatcaaattattaccaattatagcatcttttattatgatgagaagtgtgagactaatcacgaaagacattgttagacccgcctataaccgcgggcacggctattcgaatagttttactctggccagaggtgtaccactatacccacaagacacagccccacaacatgtcaccatgtgcctcaataccaccacggtacctcggaaaggagctgtgacagtacccctcacacaacacaatccaccacagcgcaccgttcctggatcataatcacccccttataaacaaggcatggactccccagcaacccccgtgggcttacctccgccacttcttagtctggtgccccgcaatgaaccatgttatacaaaaggtaaagccgttgcccacgctggcttgtggttggcacggttaatgtctcacaaccgaaactcgtgaaccgatccttaattgtcatgagaacgaccaacaaaaccatgtgctcacaacccacctttaatcaggttttagttggcaatttaattaattaaccaatcacgattgaccatcgtgaactatcattaagccatcattaaataatagtgagtcataagttatcccaatagtgtgctaaagtttctaagcatggctaagcaatcatatctaatatctagttgaaccaatatataaagctcaactagtcaagttacaatatcccaaggtatcaaggaataaagtaatcaagaacaaaagtgccataacaaataataggttaattccacccaatgacattcgaaaataaatgcaatagttgaatagaaacaatagctttaaatgggatcaacatgctcaaagggttgtttgggatctgtgtgacttgccttgctagccttgggactcttcaaattcttctcctgcaaactcagactctccgaaaacgtcggaatctaaagagaaaagagcaaaatcaccaaaacagcacataaacaagcatgaacagtacatgtggatatttttaacatgtagatctcaattttagaaaaatttagagacttcaaccaactatatccgagctaagatgaattagttatgaatttttaaagattaaatcggattaaaacacttatatggattttaattgaattatgacgcaataatgaattatttttgaaaaggaaaagggaattattgcgtcagcagctagggttcgcgatggaccgggtgcacggcgacggctcacggaaacgaacggccgagaccgatccatccaaaaacgaacggccgagatctatcggtccacgagcggcctacgacagatggcaacgatgacgtcggcgatgacgccaccaccggcggcggctcgggcatgcatgctcgccggcgaacgatggcatgacagcgcgaacggagggaaccaacacgtagagggcgacgcggcgaactcaccggtgaccaaaacggcggcggaagatcaacggacggcgatggcgtcgaggaagaagcagcggcgaccttcggcctgacgacgacggcggtgctccggcgacctacggaggggcggatgaggttggtgacggcttggcgatcacgatggtgacatccccgagcgacgatgacgaccggagtggcggcggcgcacggctggacgaacgacggcgatggcggcgctaggctacacggcgctagggctctaccggcgacgagaggcgaaggcgagggtggcggcgggtagcggcgggcttgggggtcaatttataggggttaggaggcggcggcgaaggcccacggcgaccggcgacgcgaaggaaagtctagggttcggaggagagagatcgattcgaatcaaactcgaatccacggatttccaaacgattttagccgacgattccaaaagagaaaaggtagaggagattccgaagatcatttcccctctattgatttcaccggaaaaggaaaggggtggccgaatttggaaggagacggcggcggcgcggcgcggctagggtttcgacgcgaggaggacgacgagtccgacaggtgggacccacctgtcagcggccgagcgcgcgcgcgggctgactgagccgaagaggagagagagagggaaggttttgggccgactttcggcccaaagccaaaagagaaaatttaaaaccttttccaatttaaattattcatgaaatgcaattccatttattaaaaatacttccttagctcaaataaatcccagaaaaatctagcaattatagaattaagcaaagtatttaatgaaattttaagcaaagtatttaatgaaattttatctggccccattttatattggaatttattaattaaaactagatcttctcttctaggcttttaaaataaattctaataattccaatttagacaacaatttatatatttgggatttttagggtgtgacatggttcaactaaagtccaaactttgtttctctcaaaattttcaagttcttcatgcatggcattaatccacgattcatcagttaatgcatgtgacacatctttgggttcaaaagaagcaacaaaagcagaatttgcacaaacatcatgagccgttaccttagaccttgtagtccgctcacctatattaccaatgatttgttccggcggatgtcgtcgctaaatgtgcaaaggagcagcgacttctgaagttgatccacgttctgtatcagtactggtcgaagttgtaatctctggaggaccatctcgaacagcatcaacagtacccgaacccgacgaccctggccagtctgaccgctcctcatgggtcggtctgaccggaggtgtgccggcagtccgaccggcctggcacccagtctgaccggccgagctgacctcgtcgtggtcgttgtcgtcgctctcgtcttcaaaaatatgaccatcctccccctaaacctgtgagagtgtacctgcaatatcgggtctagtacctgaactagcctcatcaaaagaaactttgttggtctccaaaacaagtacacgatagccacgagtatgtgcgggttaaccaagaaacaatccatcggtagaacgtgcctcaaactcatccaaatttccagatttcaagacaaagcacttgcaaccaaaaacacgcaaatgtgaaactttgggttgatgtccaaatcgaagttcataagaagtttttccaagttttgatctcaagaaaacccgatttgaaatataacaagcagtgttaatcgcctcagcccaaaattttctaggagttttatattcatccaacatcgttctagccatctcaaccaaaacacggtttttcctttcaacaacacctttttgttgaggaacatgaggagaagaaaattcatgttcaagacctctttcattgcaaaattgttcaaacgaagcatttttaaactcaccaccattatcacttcgaattcttttcaaagaaccaggaaattcaagctccaatcgaagaaacaaaccacgaaagtgttgaaaagcttcgtccttagttgccataaagaaaagccaagaatatctagaaaaatcgtcaacaataaccaacacataccactttcctccaacagattgcactctagctggaccaacagtgtccatatgtaatagctgtctcggtgcatccgtcatcacagaaacaataggagcatgtgaagtag

SEQ ID NO: 41821 - DNA, 1338 bp, Oryza sativa
gcatcaccaaagataatcgattcaatcttagctgccttctttagggaggagaaccaatttttatcaccggtgatgtgtcgcgaacaaccggaatccacgatccacacattctccttccttgccaccaaagcctacacacaagcagaagtcgaagcgtcagtactgaggcacacgaccagaagatccaataggcatatatccacgtgcaaaatcaattttagaatttacagaaaaattcctccgaggccggtatgaccgagggtgtgtagccggtctgaccggtggtcggtctgaccgaggctgttcagccggtctgaccggtcgccggtccgaccgcgggacccactgcggtcagaccggtttcctcaagggaaaaccagatttttgccactttgattttgcaaaggcaatctctctctctcctttttctgtttatgaactaatctgaaacaaaaaccaacaatatgtccatctttgccacaaaaagaacaagtatatttttcacgatgattagacacattggtagcactagtagatttatcaacatgagcaacaacatgagattttgcatgcacaacattggattttgaagaagatgcattcatattagatatgacaccaacagatttaagcacagttttgttagtatcaagtttaaccaaaatcttgccacttctagcaccaacacctaacacaacaggaggatgtctaaaattgtgagcataaggattaaaacctaaaccacggttatgtgtgctaatctctgattgatccaaaatcatgttgaggttctttttaccatcagaaaatcttagcaaagaatttttcaaataagaaaccaaagccaaatcctcctcctcgatttgttcgagttgatcatcggatgtggcattaaaaacagcaagaaaagaagacttagatgaagaagcatcaacatccaaagaggaaactaaagcactcgacttagaatcaacttttcgagaaagaacattcatctcatgtgttttcaattttgtataaagtgaatccaaagtcaaagtagacgtgttaatagattcgtgaatagatgtaactttcatctcccaaatagatatgtcaagaccattcaaaaagtggcgagaaatctcagattgtggataattagcatcataagaagaatcaacagatctacgatcactcaaaattttattaaaccgagaaagatagtcatccaaagcttctccaggtttcatctcaaatttaatatactcctttttgaaaagatcacgacgaagttctttaatattatttgttccttgatgaaaattactcaaagcactccaaatctcctgagcagtt

SEQ ID NO: 41822 - DNA, 16432 bp, Oryza sativa
aagcctggttgccgtcggtctgaccgcgattatatctccggtccgaccgccgagatcagctgcggtcgctgtgtcgccgccgccggtctgaccgccgtgctcccgccggtctgaccgccgaaacccggtaaacacaaatcgaagaaatcttaaagtaaatgatgactttattgattctctctatgtttacaaagtgcaccaacagcactccttacaaaaattctgactaaactcgaaaccctaactcaaaactcaactcaattgctctccaaagcgatacagggaagcctcacgctccctctctatttatacatgaggtaggcagcctaaagccacgaaccaaacttatactaagagtcctaaacaccttaggaaaccctctagtacaagaaagaaactttacataaccaatcataccaaatttgactccgcatcccatacgcatacaataactccatcgtatgccatatggaatatccatcaatcacgtgcatcaactctagcctaagtatcccgcatgatctctgaccaccacggacgtcgtcttatccccaagccgactcccggtccatcaccacaaatactatcccgagacatcgagtcacctacacatggaacaaacaaagaaaccatattccgagaccaagctatctccaacttgactcattagtagcaaacaacagtattacatacgtatagtatccatctagaagtcataatcataaaataatcacggatgtccaaacaaacaacccgaaaccgaaaccaacacagtgtcggccggtcagagcacgggctggccagtctgaccgcgcgcataccgccagtccgaccagctaccagagcccagtctgaccggtcacatgaaataatgaatcctgcgatcacctatgaatccaatcatctccaaaaccactccgtgaataaattccaaataacaaaaccaataatctccaatgcccaattgttcatcatagaataataatcaaaaacacctttgattttagaatttctcgttttggtttcgccaactcccagaagggggccgaatgcacaactttcggcgaacaccctggtagacagtgcaaaaagggcaaaagacgaattgcatagtgagaataggcgaaaaaagtattgcataatgtgaaatgtgcataatcataaatacgccaaagacttcgaccacaaaaaagtggctaagagtgagtcatatattcaaaatatccaatgggcccttttttcggctacaatagggaggattagcggcagcctgccgaatatacatcattcgccattcccggcaaacacaaaaagaagaagggaaactacaaaaatctaaggaaggggcggagggcctcacacctctgggtgatcctgggcatcgcctccacccccttcggctgccgcgtcctcttcttcgcaccggtctgccgcctctgccttcgccagttgctccaaaaggcgtgccttggcggtggaccggccgtctttctgccatatctgttttagccacgcacaaagcgcgggcgaaatgttctgcgcactgatctcccagtcccccttcgcatagttagggaactcggcgacgtgttcatagccgaactgttgtagatggcccgtagtaaaggccgccgatacgcacgcacagcaatcgccgtacgcagtggcgcagtccgaaaccgaaccaccggtctgctgggtccactcggagaagtcgaaggccgaggcaacttcggcagggacccctcgcatctttgcacccatgtcagtaagggcgaggcgaagcgttcggcacgccattctcgcggattcggtagttttcgccatctcccgcgaaaaccgctgcgactcctccacagctgacctccaggcgaagagcctcaatcttcggctcagtaagattaaaataatctgtcagcacggcggaatgggctttttctttcttcaattcggcctggagacgatcaacctcagctatggcctctctccctttctccagttcagccttgagccgatcgacctcggccctagcttcttttcctttctccaactcggattggagccgcttgttttcggctttcgcctctttcagggtgttggcgagggcctccatctccaagttcttgcggcctatttcgtcatccttggcccgaagatggttcttgaatccgtcaagatgggcccgcacggttcgctctgtcgaacagtgagctgcaagaatctggatgcaaggtaggaacgggtaaagagaacaaatgttaattatgtgacatgtaaaaaataagaagaaaatcaagaagagagaaaaagcatacccgaaccgccaagcttctaatagcagaacacccttcatcgaactcattcaattcggtgaataggctcggggtgctagcaggtaagacaagattgcttactccctcaacaaagagaataagctctgctcgggtctcgaaatcgccaggggcaaaatggggcgccacaagggaatactccgaggcagatgtttcgacggccgcacccttccccttcgctttgactagcggcgaaacaaccggctgacgcagagggctaccgaagaccctcgccgcagctgtcacgatccattccgcagaggctgaagccccggcggcggcactatcgcctgccccaccagcgccgaggaaaagaatggggacggttgaaaggtccaggctgcggctagcgggcgaagtcggagtctcgtcagaagactcgtcatcgttgaagacacgagcgacatcgacaagtcctttctttttggagatctttttgaccggacctcccttcgccgccctgcctgccgaaaacgcaattagcgccttcgccccatccaaatcctttcgacgaaggggggagctgttcgactccaccccggtctcgttgtgacctggacttggagtaggagtgtagccaggggtgtcgacgcggttttcgaccgtctcgtccgcggccttgtcagccacgacctccgtctcctcttcttcctctccttcctcctcgccgtcacgctcttcgacgtcctcctcatcgtcggcgtcggaatcggaggaagcaggaacccttcgcttcctagggacaagcttcacttgcccgcgcgttcgctttcgcgaaggtcctgcatcgtcgtccgccttgtgggggttcgcccggggaggcaattcgccgttgtaaacccggttcgctcggccagctgcttgtcacatcagcagctggctatactcgacgactgacacatcgccgatcatcctacgggcttcggcgtcagcctggtcgagggtcaacactgcaaaaataacgggtgtagccacatcaagcgtcgaacaaatcaaaatagcaaagcgcaggagtgcgtagtgaaagagcactcttaccattcgttccctcggggagaaccaacttcggcaaaccatcaacctctttgccttgatcaactgcgacttgccatgattgagagaggggaaagatgtgaagcatgcagaattcctccaccaagtcgcgacagctaaggcaggagcaaaccttacgcagcagagcgaaccgcgcctccatagcgccgtccacggcgatattgggtttttggttcggcgcaatcgccctgcgctggcaccggagggccttcgctgagttagaaccagcctcgaaggagatggtgtggtaaaaccacctcgccatccaatggcggtcccacttcgacatggcggcattcactggccagagatcggaccgctcggggcgaacattaaagttcacgctcccgaacactgttttcttcgtcccagcaggggtaaccactgtcttcgaattcacgatggcgaaaaatatggcgccaaaaagttcggcgctaggctcaaaaccggaagtccaacacgcctagtcgaagatagcgatccggaccagcgccgacgggctcaactgtgggagctccacctggaaaaggcgaaggatctccggcaacaacgcgttgcacgaaaaccggagccccgcctcaaaaaacacggcgaacaccaccgtccggttgtcgacgggcttcggtacaacggctttccccagggcgaaagtctgtccctcgactaacgtcccagagctgaccaacttctcctgctcgccgtcatctatgagagaaatccctaaataggcggtggtgtcatcgtcaatccggccggggtcgggccctttcaccgaaaaggggttaggcttgcggggagccatgacgaaggacatatgcagtggtgaatggtgtgtgcagtggcgaacaaagggagcgagcgaaaggtctgaagggccaaggggtaccgtgagagcaagaacggaggaagagagcacgagcggtgaaagtgacaagtctggcggtgaaaagagaacggggggagaatatatagcccaccgaagcaacggttcgcctacccaccagtaataaagcgccacgtgtcgcgagggtaggcaaaacggtaaattcccatcgaccgagctgcaaagtaaaaagcccacaaagggaaggcccattactgtttccttttggcccgggaaagataaaaataatataccaccgtccgcaggaggcgaagagtggcaaaacaataccagccacacagacaacaaactttatttgcaggaacaatgtaggtttcggcaggagcatcgatcgaaagggggcgccacacaccataccacatggtttgcacggtctcggccgaagctccaatctcacccttgcccgtgaggagcttgttggcggtatggcatgaggccattcgaccaaaatctgccgaaagctatgcgaagagtggggattcaagcccgagacgtcaaagttagtcggggcgaagtccccccatggcgaagactatggaacaaggacagcgagagccgagggatcgcacgggtactctgccaagccagaggcctcttgggcgaaggatgcagcgcgaagagtatatgccaaagggagatgactttgccaaagcaagctcgcccccgcgagggctgaagaagccttttcggcccatcaagcctaggggctattgggccgacgatcgcccgacggcccatcaggagcccatgaacctcaattacactatgtacccatgtaaatttcccttttcataagggtaaccatgtaaattcccctgtataaccaaaaccctagtagtaagaacctgtaataggggctataaatagtctcatagggccatgtaatgggggatcccgaagaaaaattctctaattaatacactttacttctttcccaaccactgttgagtgaccacgtctttcgacgtatgcggttgtcgtttcgccaacaatcattattttcttacaataatagataaaaatttgacatgtatatccataagtggatatactgcagccaaaagttacagcatgactccaagtctcgtaaccaacgaacaataaaagaaaaacaaagaaataaagttagaagattaagcttcaaaactacatccaattcttgcttcaccgctccaacaaaccgtggtgatccagggagcagcccaaccaccttttagcctttcactagacgccaacccacgcgtttcatggtgtgttaacaataatattataatacacgtgctttggatggttattagtgtcaataatataaaagtttattaaaatttgagacaaatgttgaatacgttggttacattcaaattatagttgattactcctttttttaaattatattggttagttcctttttgaactattaaatgtcatataaaaaggaagtaatagatcaaaataacagtcaacttcagttactactcgataattattagttttaaaattgacaattaaatgaaatactatatgaagaacccatcccattttttatgactgaaattcagaatcaatccctttttcactgaaatttagaatccatcgctattttgacagaaattaagaatccatacttaatatattatgttgtttcctatttattttatattttggagttgtgaaattaataattattttatctatttgtgttgtgttggagattcaatgtagtatgtttcataatttaataattacgaaatttagaattaaattgtggatatattatgaatagcacaaatttaattacatcttaaatatgttgttactaaatattgctgaaagtacatgtaaaaatttttttgaagttcaaatgttaaacaaattctattatatttatagttcacggtttaaaatagtaaaaattaaaattgataagtaccaaactatatgtatttggcttcgagaatgtctattatagcttgttacagtttaataattccaaaattcataattaataaacatgaagccatattcggtttagagtctcatttattagtttcaataattcaaaaattatagaatctactgtacctcagtttgatttcttgcttttatattaaggtaaaaaaattaattagtctatagagttgtgttttatttaatataaattttatggctgtccctaagaacttattttagtttgtgcttgaaatcacgtacgaatcttctgagttactgtgcaaaagaactttctgattagtggatgaacatctaataaacacctgaaatttactgggtcagtttaggtgcagaagaactggattagtggatgaacatccaaacactggatgtttttgtgtcaaatgatatagcataagcggataagccgtacttctgcttggtgtagtcgttttagatgaggaataaccgcgttaattagaaaccaatcttgtttgcgaaatagaaaccaagacgtacgtagctattcctgatcaaaggtgagaaaattgcaaaattggaactgcaaacatgagggcttcgttgttttgacactctgagtgaatgataaatgggtccatctgtgtctatgaaatataggtccaatgtcattatagcaaaggttaatgtttacagtgtcataattgcaaatcccccgatcaaggttgttttagatgatgccttgattgagaaaaaggaatagcacttgaattgtaggatcttcattcttcaagtcacacatgtctgcaaatcgggatgaatttcgctgcagcggctctcgtctctgacgaagtcccacaccacacgtgtatcggccgcgtgaagtctccagatggccggatcatcgtatgcatggttgacgacctcgatccagatcgtataaactaccagccaatgtacgtgaatccctttccagtactccaaatgcaaatatggccaatccatcaacagcatatggtttctaccagctatgataacggtggaaactaactaagataccatttatcaggtatatgttattacttttatcgtaaaatctatctcgagaggcctctcgatctggtcctatcacgcgacgcatctagggccgtccgatcccacacgctggtgtagtcgtctattccacatgccgatattgccgagaaggccagaacagaccgaatcggaagccacgtgacgcactctgttacgctagagagagagtagtttatccctgtgtttcaagcaaataggaaccacctatacttcaaattaaattttctcttaaactacttatccgatctgtggtccgattgcgccgttgtgttcgtaacaattaaatctttataacaagatctcacatgattatactttgatgaaaaattataaattatttttataatatatctaaattacttttagatttcactaaattacttcttagacatataaaagtaaatttagtaaagtctaaaagtaatttacataaattataaaagtaacttaaaacaaaaagaaaaagtaactttatcacgacatcaaaactaaatccgttatagaggtaaaaacatgagtctatatagaaattaaatttaataagcacaaattacgtcactgactaaaaatgattataaaataaacaactcacaatattatgaataacattatgaatgtatagatttcttttaatgccgtaacaagttactttacttttgttttaagttacttctataatataggtaaattaattttaagctttattaaattacttttatgactaagaagtaatttaataaaatctaaaagtaatttagatgtattataaaagtaatttgtattttttcataaaaatatagtcatgtgagatcttgttataaagatctaattgttatgaacacaatggtgtaatcggatcgtaaatcggatgagtaatctaagaaaaaattctataagaagaaaaaaatacatacacttttgagtatactagtagcaactagatagattgaggtagctggttatgaccatacagagaacggtctcgttgtagacacgtcctacttttatcgtgaaagaagcaacttgtatagtgtaggtagcgtgactggagattggataaaaaacgtagggagacgataagatatacgtacatgacgcacaacagatttgggctttagaattggcctacaataatttatattaaacacatgttggattaaagatatacggttgtataatacgatccttctaattaacagtcagattttttctgattaacgtgagagctcgtagataattattatagatagatagatagatagattagcgatccatccaccttcaactgattcctgcttcgtccaactgcccctactgacgaccacatccatttgacaaaccggatagctcccaaccccctagtgccttcgctcgccaacgccatccacgaaaggcagagaagagccattgcccttgaccgttgcatgaacggatcctggcacaaacacatccgatctaggggcacttaggccctggatctagcgtcgcggtctaaccgctactatcgctggcacctacgtcaatctcttcgttccactcctcaccttgctcaccaaaaggatgttgggttcacccacctcgattgtcgtaacaccgccattgaattcgtcattgtactgtcaaatcactgcctttgagcttgcctccaatccacacggctggatctggacacggaagcccacgatctggtaggcactatccctagagccatcaccaccaccatccacgatgccacgctagaaagcactattgcctcaatggttacacttgttgtcacacagcctgatttgggtgtaggggcacccgaactagtagtcaccaccgctagggccatcaccattggaagcactatccctgccaccgccaccatcttcgttgttgcgctgtgaaatcctgcctcctcaaccgctaccgtcgtcatcatgctgccagccgcccaccctctgctcattggcacgatgccccgccactcagcctagtccattgctacatcactagagaaaacctggccaaccaaaaaccgacaaaaccgccaacacgtagtgttgatgtatatcataatttggaattttctagagttacaccaaatccttgtgaactccattatgctaggacggcttattgcgtatccatgggtgggtgaaaaacatctatggaaccattgaacattcatcaatcatcgtaccttttcaatcatattcggatatcggaggctagaataggaaacagatgttatccaaggcttaatatttctcttacctcccggcctattgagtgacaagatttcatttcttatcatttaaagtctattattgtcaataattagtccacacatagctattaataccaagaaaaaaatatctgctagttcaaatttcgagtgaaattttaataaatagactaattgaaatgctattctacttccattttcaaaccaaaattttgaaataactttgaaattttaagttatatttaatttttgagtaaatttcataaaactacatatactttgataaaattataacaaaactacatatttaagaaggtgtatcaactacagatttagaaccaattttatcaaagaactacaattttaagatgaactatcaccaaactacatatatagttttaaaattatcacaaaactacatgttttacaccatgcatgttaagtgcaaaattacaacatttataactctaacataacactggtggtaaggattgaaattgtaaaatctatagtgttgtgataactatagtactaaatctatagttttgtgatatttggccttaaatatgtagttttgtgataaatcttgtgttaaatctatggtttgtgatacaacgtcttaaatctgtagttttacaaaatttggtcaaaattcatgtagtttcaatgggaaatttactcttaatttttctttcacatataacaatttgagacttgaaaatacaaccttgtttcaagttcatttttttttcaaatttagtttgaatagaattgaatttggactaaatttgttaacatttgaatataaattgacaaataggtcccccaatttctgaatgggcgtttctttcaccttttggcaagattaacattcttgattaaatttaattagaaggataaaaaaaagtatatataatcacttgttttttaggctgtaatttattaataaaatgtatacattaatggttagtatgatttttcgtagctcttatcatagaaaaacacagttaggtataatacagtgcagatatcatgttgttgcacaaatagcagccatagttcccatgaagtttgcagctgtagttgatccttaaattacatgctctgtagagcacgggggaaagaatctaatctaacagtatcgcatagccgaccatggaacacaaaacaatctcatcgatcactaggttgtagctagttgcatgggctacatgataaaatggatcagcgctccttgacagagacgtatcgatcatacatatatagatccacttgtgggtacaactggagcgtagaaaagaatcaaatcgcaatgatgcaatcgcatggtacatattacatgtacgcagcagacattgatgcataattatccttaacgagaccaagatcaggggccggaccatgtttggtacattctttctggtggatctgatccaactgacctacaggatagaccaggacacatgcaaggagctagctgtgcatgtaaattgtggatatttctgaacatgttaaataatatcttgttctgataataataaatatagtgagagatctctcttcctttctttggagctagtgtctttgctgccacaggaatctgcctcgagaaatgggcgtgcttagccaaaaatgagacaaataaccaccggtgctgtacatgtactgacttgtttctttccccatgatatgattttggttagttgccagggttgatctagcgttcagtaggaaggtacgtagttcagattcaggctcaacatgttaattcagtagtacaatttaatcagttcagatgccatgcatgtgccacatggaagagccacatgtaggtagtgtggtctgttacattagatttgctgctttagacacttgcaatctcgatcggtttgtgacccgaataaaaataactagaagagaaagagaatgggaggcgaaaacaaaaatgattcaaaaggagcaggtagacatatgaagggaaaactatatgttatgttgtttgtgaacgtctgcgtttgtattttaaaaaaaactataatgatgtacaaatattagagaagggcattagagtttctgtactacaagtacaaagctcccttctctgttcaacattctccccaatggcttaacagtgaattgttccagtaaagcaaattaacagccttgtatcagttcttccaagtcctatatgggagttaatatggtagaaacgagtacgataagaaaatagcttggtgaaacatcgatcatttctctggagtaggcaagactgaatttctctgcaggaatcatggaaggccaaagttcctccttcagtacttaggtgctggcggcatggcagctgagttgacgtctcgaatgcagtgcaggagattgagagcacagtgcacagaagaggagcgctgcctccacagaccacgagcgaggattcatgcaaggagaagcggcggtcgtcgcacgcgcgtagaggaggatgggcattgccgccgtagatcggttcgcacaaggaggggcgctggctgttgagcgcgtagggaggtggaggggcggcgccgccgtgcccgtggttacttgagccgcgaggaggagttgaggagagaggcgaaggtggacgtcagtcatcaggcggcggcggtcctgagaacggggagttgagcagaacgagatcagtcgtcttgcctcgcgtgggaggctagtaataaattatcaaaatatccttccaccttattagagtaaaactgaaaaacacattttacaatcaagggttggatttgatttttactacactactagtaccagtgggaggtactgtaaaagccctctaaaaaataggaccgtatatgtaaataccataatagcaaacaataatatatgcataactaacagtttgtgaacacaatgacttttgactttataattaaactagaaaaaatgcacgtgcgttacaacgggtgaaagcaatttgtgcattacaacgggtgaaggcaattttagctttattattgttatacgtttagttaaggtgaaatcagaactcgtttggattttttttaagaaaatcatgagctgcaattagcagtctaatcgtttcaagttagcatgtaagtttttttaagagatattgtagatgattcattatgtatttccaaaagcgaatgaacttcaaaactaactcaaatacggatatgtatttccaaaaacgaacaaacttaaaaaccgacaaatgcacggatgacgtactaaagtaccggcaaaaacatctttaatttttaaaatagtagagattatgcaaaagtacaggagaaaaatatgatacatctttctcgtcgaaacttgtgcacaacaaaacatcacttgcaactacagtgtgctaggcaaaacaaccatttttgttatacagtcccaatgaatacttaaaagactaatatgcccatgctaacactacatcgatatttagtaatgcgaattaaacaatcaaatgctaaaagatacatattttagcaaattaagttcaaatgtctcaaaacccaaaaaaccaaacaatgatatatagtatatcgttgtaatatatttggccccaaatataatttcatattcctaaattctcgtacatgtcatagtaacatggtaaatttcaatttaccaaaacctaggctaaacttttcaaacaacacctgctggttgtggtgattttcccttgatcaagcagagcaatttatgcaagcatgtagaaaacaaacagatcatcggagagggaaacagttgtatttacagcattcagaaaaggaaaggccaccctgacattagaaaacttgaaggagagatgttgatttagattagtttgatcctgtgttttctgcattttgatgaaggcttaacaagtaaaaccaaaactcaatattttcaagaaagtgaaattcatatgaactatatcaaattgaatgcacatcattcccttgtacttttattagcatatatcccctaaatttgaactaagttccattcttctatagttactgtacaatagcacaatagttactgtacaatagcacaatagcagaacttggtggaattcttcaactacttgcatacgcacaaaatgctgcacacgatattttccaactctttccttagtgcacaatgttgggttacgcgtaggctacgatagcataaatcaaaattttctatcgcgtaaaccaggaaccatgcaagtattagatcatagatcgttatcactcgacgcgctgcggaagaagacactgagaagtcgaaggaactctcgcgaagtagcacgtgtcgatgtagaggaagtagttgattgcaccggctcgaccttctcctccccgtgcgttcttctcgccgtactcccacgtcgatcagcactgcaaaccagcggcgcctctactggtatccacacgtacagggacggaacgccacgcacagatgtgctagcacccgcgcgtggctagggttttgctcggggagggaagtgacggctagggtttctcatgtgatgtaataccttcgtcggtcacacccctcacgaatatataggatccatcactcgagcctccaaggcccgtaggactcctattcggatccctatccgaattaagctcatattggatctccatccaatccccttattccggcccattaagcgtgcgaccctgtaggttcatgtacactcggctgtaacccgaaaactccttttctgtccacgtgtcaacaacggcccctagcagaacgtatttacccactgggcatacacaaagatcatatcggctgaacctctagtgtatacttgtatgaacccctttgcctcacgatatcgattaagctcaaggctagatatgtgccatcctctaatagctcaatcattcactcgaacctgttgatagattatataacttgtaattgtctcctcaatcacctttagcatggccatgcacttctataatctacaacaccgaggggcctagagatatctctccataggaggggcaaatcccatcttaattattcatatcccactacatgtttcatagcatacccgaaaactacttttataactacccaattacggagtagcgtttagcagtccttaagtaagctactacacatgttgggaaccatcataatctcaggtctaaggattcaacaccaacactaaataagatcactgatgacacaacacatacggcttttgcagtgtctcatgttgggtctatccaacaacatgttcactaacatgtgtccacattattaatttggtatctctataccatgatccatgagacatgatcatcaattaatacatatgctaatcatcatatttgttccacatatgatatttgatcagggatcctttagaaatagcaacacacaacataaagagtctcatgaaagaatcacatattcattaaccaataatgagtttatctatttcaaggaatgaagtcggataaatatgtaaacatagtgtgtgatacaattatctctatgattgcctctagggcatatcactaacacacaaaccatgcttaccagaataaaaagcttacatttttgcacagcaaaatggaagattatttccctcaaattcttttttttacatgaagttcttaattatcagcgtttcagtgaggttcctccaataattctggatgaatgttcagttgaaaatatcctattagacctcacctggaaacaaggaacttgactgtgtcctccacatccttcaccacgcttggttctacacaccgcatcatcactttcctcatcttccaaggaaagccatgcaaataccagtagtgcagagatatgttaacccaattgctacctaacaagatgttaagagtaacttggcataatttatgcaataaatattgtgttgctatgtcatgttcactgtaggttttatctgagtttgattattgaatattccacttataggaagctagcaaaaggttcatatatctggcaattcctctaaaatgtatgaaaaacaattggtaggcaattcatatagatgcatcaactttaatctaaagacggtatagcctgtatagtatttaacaattgttgaaccactgaataattaataacaaacagaataggccacaacattcttccaaaaaatgaagaaagagtattatatactccctttgttttacgttataagacgttttgattttggtcaaagttaaactactttaaatctgactaagtttatgcacaaatatagtaatatttataataccaaattagtttcattaaatcaataatagaatatattttcataataaatttgtgttgagttgaaaatattattattgttttctacaaacttggtcaaacttgaagcagttgaacgtcttataacctgaaacggagggagtaggataatgaagaacctgaattattcatactgcaattaattaaggtttctactcaagcattaaaaagtactttctttaatcctggattaaagggccattggagcatttcctcaaagatatgtgcaatttgatatgtcaattcacctcgcaaaaataactcgaaaggttacttgggatttctaaagaacaacactagccacgtagtcgcgcttgcgcaacttttgatcctgtttaagaacttttgtatatggtctattagtctaggtaagcttttaagaaggttttgacataataagttaatttgcaaagtattgatttccctaaccaactataaatttagttaagttgcaaagtactatatgatttcactatatatatatatatatatatatatatatatatatatatatatatatatatatatatatatatatatatatatatatat

SEQ ID NO: 41823 - DNA, 14143 bp, Oryza sativa
tttttctccttaaaacattcttttttctcttttctaggaaaataaaaaataaattgctaaattcaaagacttgaacccatgacctcatagttcaaagcacattcttctaaccaattcatctaatgatgctatttatttcaagaattttgtgggaaagtagtatgattatcaattctaatatctttctctaccatcgtaaaacaaaaaacaaagatatgttactacgaaactcgtaacatgtactatgctccagtagtaacattatcataaaagtatagtaacacgccacgttactgtagaacaaataggacgttcctgcagttctggcagtaacatcgtggtaaaattgtagtagaccaagaatcgaaacaaaaatatatgggttaaagcctcacatgctaaccatatagttgttactgcacaaaagtagaagtgttactgcataataggtgcatgttaccacttccaagtagctatgttactgcacaataattgtagttttattatgtcatttttacaagatgaagattgaataggtgggccataggtaaagtctgtagttggctttgagcgaggtctgattgatgtaggagtattttgaacaattttatacatttggtcaaaccatgttactgcatgtatatgcccctgttactgcatattacacattttgttactgcatgtggagggttaaagttcaaaataccaatatttgaaaagcaatatctcacaagatatgcattattttttaaaaccgtttccaccataatgctatagtgcaactgcatgtggagagttaaacttcaaaatgcatctacatactcccctcctcaagaaatcgttcttcctccttcttctcaagaaaaccggtctccaccctccaatatagtgtttctgcgtgcatgtatatgacgttactgcacttttgacagtaatattgtggtgaattgttgtaaacctggaattggaacaaaaatatatgggttcaaagtctcagatgctaaccatatacttgttactgcacaaaagtaaaagtgttactgcacagcagatacacgttaccacttgatagttacacattaccgcatgtttatgcaataacactatccaagaactgtagtaaaaaaactttattactgtagtacatatagagcgttactgcatcttaatttggcagtaacatcgtgatgaaattgtagtaaaccaggaataaaaaaatatatgggttaaaacaaacgagtaaaccgaaccaattccccatattcttgtagtgatgttatcaagtaattgcagtaacacactatgttactatgaaacttataatcattactacatcttgtagtaacgacatgatgtgattgcagtaacgcaaaacatgcactagtaacaccttttgatatactattactgctcgtggagagttaagtttttaagaacaaatctttgaagggcaatatctctcatatcatgtactacttttaaaaaccgtttgcaccatgatgttcgaaaaaaagtgcttatcaaaagtagatccatcatgactatattatgactgaattttaattttgttactgcaagtaaaacacggtgttactgcacgataaacaagacgttactacgttgttccgatacgagagctaagaagagagggggtggtgggggaagtcattggcgggtttgaccgagatttgaccgatgtgggggaccttggactagcctttgactgaggtaggaggtgggttttgagcccttagaaggagatgaggtgggttggagggaggggggtgtagaatagctattctataccccgggtgtagaatagtttatatatatgtatatatatatatatatatatatatatatgagcattgcagtttgcagctatttgtagctaaatccctataacgagaaagcatatgaattaaatagcaatctaggaaagtttcttgcaaattggatcttgaaacaacctaggcatatgagggggctggataaggatccatgtctaacatatatcagtagtgccgtactgccaccaccagatccaatcagatgaacatgggagagaatcaccactaaaaaatttcaggagcaaaaattggaacactctgttatgcacttatgcgctgtagcaaagcaagatttaaatccatggaggagggcaccacaagatcaacagataatagggatagagacttactgatgctgtggaggagggcgtacatgcattggcattgggcacaccggcatagtgcgataccaatttttggtgcggaagggatcgacagagctagggggctcagttgcaggtgacgaagaagtgtcacacagggtcaacatcgtcaacctcgtcttccaacctcctccgctctaccacagccaccaccgatcaccagcacctccacctgtggagattatgggtactctatacccacacggcatggttatccgactggttataggggataacttatatctatgaaatatgtaacggatcatgacttgggtattacattttcttatatattatggaacagcctaaagttttgatttgataatattgtaaagtagatttaggaaactgatactatattggttaaggtttctatcttgtaatcctgccccccgtcctatataaggtgggcaggagaccctctatggggcataattcacaaccagatcgtcggatctataatacacccggcggattcaaatccccaaataggagtagggtattacctctcatcgagagggcctgaacctgtctaaatccttgtctccgcatccatccacatttaggtctcgtgcgctacccccttttattattgacgaattcttgttttgacagttggcgcgccaggtaggggatggaataaaatacaggagtcgccaacaagcttcgcctctcagattcgggtctaatcggctagggaggatgacaaccactcggcggcgagtttcaagtccaatctgcaattccaagccgaacatgattgattgacgccaagctatacacgtgatcatcacccgttgagaggaccatatttccagttgtgtcccgtatctatttggctagcaagaaattggcgtgcatgcatacagagaagtcggcgacatgcatatgtatgcagtacaagtttaatggcaattaagtatatatgcacatcctcgtcagacatcctctccggttctattatttggttatatctttttgatctttaatctagtaacagaaacttattttcctctcaaatcgtggaatcatccacgaatccagcttctggcaagtttttggtgttttccttttcaatttaactttgtaagcttggtctagcctgaagattggtgctccctaaattttagtgctttccctctcttattacaaagtcttttgtgggctcgtgtgtgttttgcctatgtgcatcctagttatgcaaaggccggaagttttcttagtatggttctatcaacttgatgtagtcatctgagattagtaaaaagcttcctttatgtgatctttttttttctacttttgcatgtatcatcgatggctgagcccgatcaaaaaccaaggcttacacaaactatttgtttggtataattcctcctcggccacgatgagtcaaaagcagcactagccgactggtgcccttgcctccacggttggtttactccgccgtcatttttgatggagacgttgtcttcaccgccggccgccgtcattgcagccgactggtgccctcgctttcacggctgacctattaggccgtcattgatgggcgtcttcgctttcaccgtcaaccaccttggtcgccaccgactggtgttttcgcctatacggttggcggacatcgccaccgttgatgggcgtcttcactttcaccgcctgcctatccttgtcgccgccgactggtgtctccgccaacacggttggttggtcacaccaccgttgttggtgtccatgtcttcagcaaccggccaccttgtccgccaccgactggtgtctctgactacacggttggttggtgggcgtcttcactttcaccgcctgcctgtccttgtcgccgccgactagtgtctccgccaacacggttggttggtcacaccaccgttgttggtgtccatgtcttcagcaaccggccaccttgtccgccaccgactggtgtctctgactacacggttggttggtcacaccatcgttgttgggcgtcgatgtcttcaccgccggcttgccttcaccactgccgactagtgacctcgcctacatggctggttggtctacgttttcaccaccggctcgccttcgctgatgccgactggtgccctcgcctacacggttggatggtcacatcaccgttgatgtgcgtcatcatcttcaccgaccggccgccttgtccgctgctgactggtatctttgcctatacggttggatggtcacaccaccgttgttgggcatctacatcttcaccgccggcctgctttcatcgcagccgactggtgtcctcgtctatacggtttgatggtcacatcaccattgttgggcatcaacgtcttcactgtcggctgtcgtcatcaccgacgactggtgtttccacctatacggttggcggattccaccgccgttgatgggcgtcttcactttccctgacgactgccttcattgccgtcgattggatccttcgtctttatggttggatggtcacaccaccgttgatgggcgtcttcatcttcaccgctagttgcctcagctgccttcacggctggtgtttatattgctattgatggacgaatttgtttccacatcgtccacctctgccgtcaccaaggcgaagaccaaaaagctaagtcatcaatttttttatgatatttttcttttctctacctcactacatcaattggttctctattgagtagtgagttgggggctacagatgttatatcatattttttcaaaaaattttcataatatctatcttaattgcttgcgaaataaaccgagtaaaaatataaagtgcctatcaagttatggagttctatctttctatgcttcccgtttggtttgtcgatggttagttgcctttgggctgattcctaccgggggctcgttggatggaccgagtaatgcaagatgctaagtattactcggaagaaatcaaaagcacagaaataagataatttattttctgctctcaaccattgcaaaagtacccgcgtagtaaattctaatccgtgaaactttgttccattaatgacgaactcaagtcactcatatgcatgtctaggaagtgccttagctcattcccgatgcgtgggggctatgactagtcgggcaaagtgtttaaacgtaaggagtcatctgcttggggaaatcaaaattgacaagaggagaaatacatatttataaacattttaaaatacttgaatttttctcaagtattgtatttacatcagatactactcatcctatatgtttgttttgcaggatccagatccagatatgcataatatggattcatggcattaagcttatgtcctacgctttaggaatggatcagtcagaacatcaccgaccggcttgcctccgtcgctgccgattggttttgctcgccttcacggttggatggtcacaccaccattgttgggcatctatatcttcaccgctggcttgcctctgtcaccgccgactggtgtgtcttcgccttcacggttggttcgtcacaccaccgttaatgggcgtctatgtcttcacttccggctgctcccgtttgttgccgactgattatctcgccgccatggatgcacaactccgtcataactactgggcgcattcgtcttcattgctggccgccttgtttggcgttgactggtttcttcgcctccacggctgcacgtcttcgtcaccattgaatggcatcattgtcatcaccagcttgccttctccattgctgattggtgtctccgccttgatggctggcctattatactgctgctcatggatgtctctattttcaccatctgcttcttttgtcgccgactggtcttcgccaccggtttgcttttgttgccaccggcttgtgtctacgtcatcacggcaatgtaactctatcatcattatggggcaacttcatcttcattgtcttcagcaccggcaaattctattgcctctacttcgcaagattttctacttcaccaaccatgacgtctacaagagcctcaacatctcggcatgcgttaccaaatatgattccgtgttattatactacaaaagtggtgctccaattttcaagatttctactcggacatcttcaacacatatcttcactcaagcaatggctactcgacaacaagaagctacagttctcgactctatgtttagttatttctcaactaaccaaagagtcgggggctacacaaatacaagacccttaaaattcgaattcgactggtgttatatcaagatgaagcaatcaattaattagccaacgagtcaactccgggagtcattatcttcatcatcacttcagagcaagctttctacttcagcaactccaacattttgagtgactattctggctctcagctgatgccacggtctacttcaaatttctcaagtatcaagtttgagagataatctacatgtttgagagtttagggttatcaaccaatcagctcagtttcgacgagtttgacaacagcatctactttcctccaaatgaagcatctgcagcagctatgacaccaagttctactgccatctttataaatcaaggggcgttgcatcaatctttgttatacacacgctcgcatcaaggaaactactcgagcttcgatatcttctcagcagtttggtggattattgtcattgacatcatcaccagcacctctacttcatcggccctgacgtctccgccgttgctaatgggtgatcacatattcgcttctggttgcttccgtcattgccgacttgttatttcaccttcacagtttacctactacgcaaacactgatgagcatctttgccattatcattggctgctacaccgctattgactggatcaccgatatcgtcatcttcatcaacatcctgtcaagcctcttcaacatagcctattctactgctattgatgggaaacttcgtcatcatagttgatcatctctgttgttgctaatcgtcattaccatcggttgcgtttgccgtcgccgactattttcttcatcttcatgattggtgaatttcgccattgccactaataggcctcttcatcttcttcaccggctgcctcgtcaccgactgattgttccgccgccatggctatacaactctgtcgctattgctgggcgccttcatcttcactgttggctgacctgactgttgttgactggtttcttcgcctccgtagctgtgcgacttcgtcatctttgattggtgtcactgtctttactaccaccaatatatcttcatcatctctaatgggagatgtcatccccatgttggtcatctcgtttccatgccgactgcatatgctatcgtcaatggataatttcgactacgacaaaatgacaagctatatactcaggggcttaccagctcaaacacaagtatcataccttcaatttggacttgttctggatacatgcaacatgaattcatggtcatgagtcgatttcttatgctcaacgactggactattcattattctccatgagggctatcagccgagtacttgcgccagtcgggattcaacttcgcatctactttggtgcgtcccatgagggataactactcagatcataagctactcagatgagatgcattctatttacatcacccgggaaatttatcactcgagagcatattaataggcatgttatacacgtcacgcccaaaaatttagcccaaatttctagactattttgtgtattaaatccctatccaggaccagccagggtacacaaaacgacaagtaataaacagttccaaacgtaaataaagcgtaaaatacttacagaagaggcactttgtcctcacaccgaaacaaaagcagcagcagcggaaaaaggcgatcctagcggggcttcagctccactccacaggcaaaactcaactggggtctgagccttgatcctctaacttcgtcttcagctcagaagcactacacttctgaaaagggggaataatagcaaggctgagtacaaccaccgtactcagcaagccacaccaatgatgcagacgtgcaaggggaacaaaaggacggtttgtggctatttacataaaggcggttgtaaaacattttactgagcaaaatagtaaaactgttgagtaattaaagtaacattaaatctccactgatcaacgctacaccacgttgaacagtcccaaccaacccacctgaactacagtgcattgagtcgatttattaagtgtgagactaatcacggtgaatctggtcgaccgcccatcaccgcgggcacggctattcgaatagttttactctggccagaggtgtacaactgtacccacaagacacagccccacgacacatttccgtgcgccgacatgccaccacgacataccggatagaggccgcgacaggacccttcgcataaccccctctaaccaagcgcaccacacctcaggttttacccccactcctcgcaaggcagcaggcagtcccctctcatgcctaggtgaatccggaagccgcataggccgtcacagggcccatccaaactccatcacgcccacccttgcctggatgcgtcagctagaggaaagctacactacaagcccagccgttgcctacgctggcttgtggtaagtacgacaagttcttccagggcatccctcgaaccggtccttaattgccatgggtgcgactagcaaaaccatgcacccacagcccaccattcagtcgcattttagttagataattacgactatgaagcatggccagatgtctcgagcacgcagcttattctgatactaaaagggtctaatactgtcattatcccatcaactgagctagtggtaattaagcatggctaagcatataggtctagctaggtcacataagtaacatgagctagttgatttattacccaaggttgacaaaggacagatatcaagtaaacatggcacaagcgagcagataggtaatacccggatcccatgtaattagcaaaacatgcaattttatttgcaaacgataaaacatttgtaaattaggataaaaatgctcaaggggaatgtgtgacttgccttgcttcttcaaaagaatcttccgaactcttttcctcgcgatcgcggacttccgaaatgacggaatctactcgctggcacacaaaatgaggaaaaactctaataaaaaccaaggaaacagtacataaaaagtaaacaaacatgtagagctcaattttagatgaattttgcaagttgaacggctcaatttgaagttcgaatgaattagatatgaattttagaagttttgaaccatttaaatgaatttctataattattaacgaatttattgcgcaattaaaatcaattatgacgtcaccgaggggataggtggtgccggcaagcgggccccacctgtcggtgactcaaaggggcggtccaccgtggaccaagtccacggaggcacgagacgggtgcaccacgtggcgcacacgtgacgttgacggggcaccgacgtggcggccacgtgtgcggacacacgggtggcccagatcgacccgaggccgatcggacggctgaggggagagacggctgggcacggtatggccaagaccagcccagccggccatggtgcggcggcagcgcgcggtctctggtgacggcgaccggcgggcggcgcggggagcggcggcgcacatgggcggcaggcggcgcacgcgagagaacggcggcgcggcgcggctagtgcacgagcgcggcgcaaagccgagtcgaccgagcgatggcgcgcggcggcgcgaccaccggtgactagcggcggcataggacggcgcgaggagggcggcaaaagggagaggaggaggaggcagttctcaccgtgcccgcacaaatggcgagaaggagacgggaaggcggccggcggcgaggaacggcgacggcgggctcctcggatagacagctcggcggggcttcggcgactcccggcgaagaccgcggcgcggccgaggcccgacagggcctggggaaggtatagaagggagctagagtgagggaggtggcgcgggacgacggcaaaagacggccggagtccggcggaggaaaccgagctcaccttgagcagaggggagggagtttcttcggtgattcgcgaagatggagaagtggccgagcttgcccttgcaaccgcgaagccagtgatggcggtggcacagcctgaggtggacagggatggcggcagtaggcggccggaggtggcaaaacggcggcggcctcgggttaacagtgggggtggagtttcggtgaggggttagggaaatggagtagcggtcgggcttgccctcgagacggcgaagccggtggaggtcgtctcgtggtgcgccgacgactaggactgcggcgaggtgtggctggagtcggcggcggcggcggagagaggtggtgcgcgtggctgtggcacttcggaggtggagaggggaaatggagcggtggacggggtgcgcacggcggctgcggtaccggggaaggcgacggcgcagtgcggggtgaacgggagcggtggcgcggcgcggctggagttcgccggagagtggcggcacctgggctcggcgcggggagcgcgagggagggcgcgacgacttggggatttggggaaaaatgggagagggggccccggggatgctttttataggtccgggaggtggagatcgtggccgtggcgggcggcaacggccggcggatgaagttccggcgacgtgggtgagtggggctcgaacggcgctgatttttgggggaaaatgggggagaaagtggataaaggggaggacgtgcggtggaccgcgcccacacgcgcgcgggaaccgggaggcgcgctgggaggggcggcaacgtgggcggctcaggcggccatggcagttgccggcctgggctggaggttgggggtgaccccgacaggtggggcccacctgtcggcggctcggggagaggaggaaggaggagggaggcgaaacggacttgcgcgaaggagggggcaagccgggccaacggcccaaagagaagggaggaggggaaaaggaattttttttcggttttagatttttttaaaaaaatatttacagaaataatctatcggccaaaaaaattacaaaaatagaccctgccgcccacctctgaggcggcaagctgacgtggcaaacgggggaggaacgggcggtgacggagggagggttttttgcaggaaaacccttgccgccctctggtggggcggcaaggggcccgaatgcaaaaaagccagtcggggccagctattttgcaggcggccccttgccgccctctggccgggcggcaggcctcgctgcctataaaaggcctgctgcccagcccccagccctcattcttctctcctcaattccagtgaaaataaaagaagagaggggaggagaagagaagaaggggcgaagccctaccggattcagacgccaatttcaggtaatattcatagatcctatatgtgactattgagttaaatagtgtgtattctttaaaattttgtttgaataaatgcattatatttttagggttttagttgtactaatctagaagtgcgtattgtagatatcggtaactacgtagatctgctagtttggaatcaatacattaccgttgcattggcttacaaaagaagatattacgttgtagatgtttattgcatgaaagagtaatatgatctagttatttcgttgacagatatgtcgaacaaacaaatattccaagtttaccatggaccaggaaacgtccgttacgggccaactgaggtagatctgtcagattttattgtatcagaaaggggaattgatagaccggctgagaggagtgtaccttccataaaaggatggttaatgaagggcttgagatcacagacaagtgacataacaatcaatgttatagtaagtcgggcaactgagggtttttattgggaactaatgccagttcaaacctctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagttggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagtgatttatagtagagcagaagatatgaaggaggcggtaaaacattttgtagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgttcagaaataccacaggaacattacttgtgcatttgttgcatctgagatgtatgcgcatgtcatcgataatctcacatatgaaccaaggtcaataatccgacacatcgaagagacatacaagtatactattagctatggcaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctagcaagagtgtgctgcaaagggcgttcttagctctacatgcatgcaagatggcattcgtgaactgtcgtcctgttctccgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccccggtgtttgggaacatgtacagagtaggtggtgcatgcgtcatatgggagctaatttcttcaagcaattcaagaacaaagagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtgcaacattggttagaaaaactgaattggagattcggaaattttctcagtggattctgcatgaaccaaaagagaaatgggccaaggcgtatgacacaggtggtgctagatatggaattatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaatagcattttgtttggagctttcatgcagaaaaagctagaggagttgcgtaaaaaggccatgaaacatcgagctgtagtgcaaggtacccaacagcacaggtttgagatactatgtcaagataaggcaggcaggggtatctaccgcaagagagtgaagcaggagtgtgttctca

SEQ ID NO: 41824 - DNA, 4894 bp, Oryza sativa
ggatttgcttgtaattcgtttcgaacttatcaatgtgtttatgtttcgtcgtgtaatgtcagacttcggcatgtcatgtctttaggtctcgtgatgtaacgtcggactaaggcgcctaacgtctttaggtatgccgatgtatgtcggacttcgacacgtaatgttatgttatattattgaactctacatatatgttaaattgcacgtcatcgttatgtaccattagtaacgtttgctatatttaaatagcctgtaatcttgttgtacataattaatctcatgattttattactatttcataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggtctgtggacaggtccctcctagcaactttggtcgatcgatggaggccagagacgcacacttttcacttgccgtgcggtgaggtagcccctaccctacaggacgtatcgtatttgttggggctaccgctcgcgggagacgctgttgggccagtgaccacggctgtggattggcaggacgatctgacggcacgtttcgcactagtacagcgcgcaccgcacctcccgctcgagccgttggcacactaccgcaacaccggacctacgaagaggtggctgcttcagttcaccgtagtgtttttgtaccgaaatgacaatcgtattacatatttagtccgcagttaaggtgcctaacattttatcgaccgcttgcaagttgagcgagctacaggcggaggccgacgagtactcctacagccgatgtttggaggcgtacttgctctggctttttggctgggtgatgttctgtggcggtcacgggcacgccgtcgacaagggactcgtgcactacaccaggagcatcgccgacgccgcggtaggcgaggtgcctcagtggagctggggttccgcgttgttggcggctctgtaccatgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggaccctacagtgcagcggctacccaggctcgtgcgccgttgggtctgtccacactctacaccagggaccaggcgtactggatgactacggttccgatggtcttcgacatctgcgttgagcctcacgcccctttccgcgtgatacggcagttcggcttccgtcagccctttccagtaccgtttccgaccaccgtcccagctgttgttcaccggtaagatcttgcactatgcttttcgttgttgcattaaaatctgcctgttcacaataatttgtaacatctgtcgtttcacactaatattacacattaattcgcaggtactcgcgcaagggtcagcactcagctggcgattggcccgccaagttggcgacttttgttgagtactggttgctcgcaaccgaggaggtcatggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctctctcttcgtcaaattttacgaatatttacgaacaaattaaccatgtaggtcgacgacatcaaccaggtcgtcgttgacggttcaacgacgatccaacgtttaggcgcggggattccagtacccatagaggagcacctgacgacgtacatgcggatggtggagtcgatgcgctcgattctccgagtgctcacctgtcgtgcagacgacgttgctcgggcagacgcagctgtacagcggccacccgtaccgactggtccccatccagctgcgcacattcctaggccgactccccctccgcacggaggtaagtatttttattactatttctgtacatgcctcgcacatataagtgagccgtttcacctgccgattgcttcagggtttcgtgcaccgttcagcaccccgccttcctctgcaggccttctgttgtgccccccacaggtacttaaaaaaacaacattacttcgacaatcaatttacatacattttatgtcttagcttacaagggtcccgttgtcgatgtgtaggtttcgcccagttcgctattacgcaggccgcccacttctcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccgcttgctgccttccaccttgctcttcaacatcactgacttcgacttcgcttcaggctcgacagaggacgtcattggcccctcacaactgggaggcgcaccgccggtgtagacgcaggaccaggcgcaggccactcctccgcgggacactcgtgctacccgtgctgtgccaccggatcatttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgcgtgtgatacgagtatttgcccgccatttggcgcatacgaccaatgtaactttcagcgccgatcatgcatgtatctttcggcgccaatcaggcgtacccaccataccccaccacgttcacatgtcaggggtatcactcgattttttgcgcctatataagtcgccttaacgagtaaggcctcacaatctttcagaactcagtcacattcagtactctcttccccacttgcttcattacaaatccaaccggctttcgtcaatggctagacgccggggtgttgaggatccaaactggcgtagcgatccttgtgtatacctactaccaccttggtgccagcgtcctctctgcctatgcagtgatcgatgccaactaatggcttcgaggaatcctgatattcgaggaaggcgcttttttaggtgccctaactatgaccgtgaggtattttattatctgcatatgcttattcattctgtatgggcaatcgctttattcttcgtaatactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagtggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaaaaatattttgattacatgaatccttattttctcacaacatttactaactttgcttgctttacatctagtctttcctcccaggaaccaccaaggagatgtcaatacagagaatggatagacaccataagggttctaactccacctagccgtgttgtgcagcttgaactaccagagcaatacagggttactaaagcgcggtttcagagaggagagggatcctcacgtaggggttagctattatcggacaacttggcatattgaaatttctactgtcatgcttccttgtcccattactacatcgtcgttgtgttcaactattgcgctacctccctcctagttcgaatctaatatcatctatgtaaccgcaatgcaaatagtcgtatcatgttcaaattgtactactatttcttcatgttatataattctccttgtttaagtccatataatgtttctacgacccaaactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgg

SEQ ID NO: 41825 - DNA, 4037 bp, Oryza sativa
cccagatgaaaaagtacggccgcaagctctttatgggcggccaaaattgcaattagccccttgccaccctctgtatgggcggcaagggcctaatcgcaattttagccgacggcggcagacggcgcggtcgacccaccgtctgccacgtcagcttgccgcccaccattagggcggcaggggctatttctgcaatttttttggtcgatagattatttctgtaaatattaaaaaaaatctaaaaacgaaaaaaattcaggggaaaaggagggtggctggcccgggaggaaggagggggagttgggccgagcccaagagggaggagagggatttttatttggttttctttttatttaattgattagttgaattttgtgactttaagattacttcttgagctccgaacattcgcggaaaaatccggagagtattttagggcacaaagaatattacaaaatattctcggccaatgatttttaagggaaaattttaattcccccattaatttcacttgattgaattgatttaacttttatttaatttctagaaaatggattattaaatgatttttaatcccgaacgaaaatcggggcgttacacacatcgtattctaagggtatcagtaggcatattttgggtctaggcctaatatgtctgcagcccatattttcaggcgtggcctgtcacgttcttttagggacttagaaattttttggttaggcaaaagtgcgcgtgatcaagtgcccaatactttaaaaatccttttataccgctcttactcaactttttagtagttggtacaatgcattttaaaaggtaccaaacagtaaagctttatatagctgccttgctgacttttttatctaagtcagggcattgtttgggtttataaagcaattgattggatacaatatcgttgctttttgccacgtaagtgtgcattcttattgaccaatattatggcttaggttgactatatattttggtcgtttttcgggcgattagtaaatcctttatgagtttatttactcggattttacaccacatatgccatatatttctaggtatggtgaaaccatgtgtcttttagggacttaagcacatatgttaaagcagtgtgcgcatggtgtgtgcccaatactttagaaatttctttgttcacagcatactagcttttttatagttgttttgcaatgtgaattttcaatgatgtagtcaactttaggttgcacgcatcatattttataaagcagttggtatatcactcggatcatgttattcggggattcacaccgcatatgctatatattaatattaagtcacttggtttactacaattatcaaaaccactcggttggttggattatttactccttgactatatgttttgtttgttcaactaaccacatagtcgagggctatacctattaggtgcatctagtcgatgcacctacgtttataattaattaatttttagccctccacagtctttagatttggtaaaagtactcgggagaccatggcaaagatgattgatgcactcggctttggagtaatctggttcgagagaagattatcttttcgactgtgaaggtctcacgggctactgtggagattatgggtaccccatacccacacggcatggttatccgactggttataggggataacttatatctatgaaatatgtaaccgatcatgactttggtattacatttccttgtatattatagaacggcctaaagttctggtttgataatattgtaaagtatatttaggaaactgataccatattgattaaggtttctatcttgtaatcctgacccccccccccccaaatcctatataagatgggcaggaggccctctagggggcataattcacaaccagatcgtcagatctataatacacccggcggattcaaatccccaaaaaggagtagggtattacctctcatcgagagggcctgaacctgtctaaatccttgtctctgcatccatccacttttaggtctcatgcgctaccccttttattattgccgaattcttgtttcgacaccacctccccgggctgccaacatctaggtgaccgtgtcgtcaactgcatgcataagctgttgcggggatgccggggagatctatggtgacctgcaggcaggcggaggaggcaacgattcgacggcaggtagggcagggcgcgatggcgacggtcatcggcggcaagcgatgcagggtggagtgcgcggcggagtagtcccggggggcaagggttggtgaccacagcccgctggtggctgggcgactggcattggcgttaggcggagtgggtggcatagcggagaaaagggaggggggagttgtgtcgctatgggaggcgtcgctcgatgaaattgcggagagaagcgtatgtctgcctaattcgatttgatgatcgaatgatctacgtttcgtgtgtctgcctgcatcaggattcaagaccaccactatgtttttcttaagtagtacagattttatacccagaaataagagggtgggactaaactaagtctcgttcttttttccaacaaaagttgcatgaagattaagattttcgtggcacgctttttaaacaactaaacggtgcatttcgagcgaaaactttatatatgaaagttgctctaaaatatcatattaatatatttttcaagtttgaaataattaaaactcaatcaattatacgttaataccaccttaatcttacaccttaatcttataccatcttcatcttacaccatgtgtggaagaaatctttacaattttgtatgtcggtgtcacattttgttagtaaatgaagatttccaaccccttaggccttgttcggttggcccggaaatggcagggattgggccgcgatccctgtggatcactaagttcatctgaggtcccttaatttgtcaacgaatccgattttcgtccttcaacccgaaaaccagatacaacggtccctcaactatcaaaaccgtgcagatgaggtccctcggcggtttggatggtggttttggctgacgttgcgcttacgtggctaatttgactcggtcaccgtctgacatggcgcttacatggcaattcgaatcggaaaattaataaaccacgtggacccacatgttagtgtcacacccaaattaataaaaaattggtggggcccacgtgagccccgcatgtcattcccactcctcttcttcctcctctctccccatctcccctctcctctctccaggcacgacggagagtcagcggccggggggaatcagcaccaccaccaccacgcgatggcgagaagacagcggcgctggtattcccgtgcggctacgtcggcggcgatcccgacgagtagccagaccccggtcgacccgccgctgtcgtctgcagattgcacaagaccaaacaagaagcaaattggatcatcagcacggttttgatcagtggagacgaaggttagtacgtaccattgtggtagcggcctagcgggaggtcgttggcggccatggggatggacatgaacagctgtgtctcacgtccgagccccatccaggagcccttgctgctccttctcatgcggccactcgtcgaagaagtggccgagaggtttgaggtttctgcgtcgccgccgcatggtcgtggcccgccgaattctccagccggaggtcggcgcccaggaggaagcagtgctgctgctgccgcctctctttctcatcgtcattttctttggaaagatcaatggcgtacggcgacacagcggtgttgccataaccggcgcccgggaagagcggcgtggtgctctgcttgggctccatgccgagctgcttgaactgccactggccgtgtccggcggcggcgtggtggtgctccctctcggtgccgtcggagaagaaggcgtgctcaccgtgtgcacctccttggtggcgtgcccgtacgcgtactccttgtggtccatggagtagtaagacggcggcagccggcgggtgagggtgggtggtgtctaagtggacgtggaacgggctc

SEQ ID NO: 41826 - DNA, 14910 bp, Oryza sativa
atgggtctcatgtggattattattttcccacttcgtattgccatgtaagcgccacatcaatgctacgtcagatgaagacatagttaaattagccacgtaagcgacacgtcacgtcagttaaaaccgctatccaaaccgccgaggacctcatttgcattggttttgatagttgaggaacctattgtatctggtttttcggttgaaggaccaaattcggatttgttgacaagttaagggacctcagatgaacttattctccccggtgggtattaaatcccggcctacaagaaagtgtgcgttcggttaagcccagtttggattctgtcccggcccatcccggcctttccccctcaccccggtccgggaaaaaatcatcgacccaagaggcgtggaagaaaccctcgcgcacaggaggaaactatcaacgcataggggaaagcagcggcggtggcgcgggtgcggattgagagtcgacggcgcgacggcgacgcggcactctccccggaggcggcgctctcccctccgccgaccgtcccctccgctggccactttctcaccggtgagtctctcttccttcccctctcttctccctatccttcctagggtttggttcttggtccaaggttcttggttaaagatggtgtgcaattttgatgtagctagcggatctagaggactgatggttctcgttggaataagcctttcttaggttattaatcagtgtcttgattaaacctgattttctgcatattggatggactgagcagcatcacaatttaggttgctccttgctctgcactgcttgattttgtggaataaaatgaaattaatgtcaatttgaacatatcatatgctgacaaaatgcaaaaattaatgcaaatcaactatggtggctcacctttgctttcaaaactttctgactttcactgaaatactgattaggatgattgattccagtatcactgagacaccatgtgctgcctcgaaagtcatcgtgcaagctagctatgtatttcatatcttagatgattcaagcaaaccaagtttggaagaatgtttattaaaggtagaattgtgaggtgcagtacctggttactgctgtttgtcgagttttaagcagtcaccagttaacgtggcctcttttatctttatccaacaaattatgattagtatgatggttagagtacataccatagatgcacaacatggtaagttcctgacagattcaacgtcttttgctccttattgtatatctcatctggttatacatttatgaatatgattagtataggacaaaacagaagtcaagatttgatttttgcacaagcattttgatctacataattgtacctatccatgtccaatatgaacataattggaaattctcggtttgatctcaattgaaaattatttcaatttttattggtactagcacatatagggccttgcactttagaaatattttattttactaatgtaaattgtgtctgctttgtagattgcatgtccaccaattagagttggagaagaccagcctcctccttcttgggaccctatacccttggcctggtagtactggattgattttaagaccaattttcagtactgggttgatttctgaactttatgtatagtcatttcctaaagctccattttctagatgataaagcttgtcttcctgattctttttggaattgatccaatgctgttcgattttttttcagagatgggaacactggagctgggtgactgaagcgcatggtggcattagtgctaagcttaaacacttgcattcaatttgtagtttagctcttagctggctacttctatttattctaagaaaaacaactgaattgtacccattttgattaatctgtgaccttttcatgtccttcaaatttcatcatcttctgcatttgttgatctaatacggcccagccacctgttttttttttcattcatagtctgcatgatcatcgcgcttcaccctgagtgggatcgatcctgatctgccaggtaggcctctgttctcgtcgtcatcatggtgctttgcccgtgagcatcgcttgtcgttctttgttgagtcatcgtcaagctgttaacaccaaaatttgatacggttgtttagaggattcagttaaggaaagaagtcaatcaaccgatcaggacttatatcttttcttttatctttaggaaacttgtatcttgtccgattaggactaatatcaacctaagggtataaatatgtacacccgtagactttgtaatctatttccacatatcaatacattactttcggtacattgccaacttttattccggcgagttcttagttttgagcaggtttgcatttgttaagttcgatctcccacgaggaagtaagtttcgtcaacttcccgcgaggaaataatctcctcttcctatactatttaactttggctacaactttctcgtttaagtccaatattttattcaggttgacgcaagcattgtctatctgatatattgattatatctttaactgcattgctatttagagtggtatcggcttagttaggactttctcacttaggtccgatattttgactaagttgatgtttttctaatcgtattgccgttttagatagatcgatgtatcaatcatgtttgtatatatatctattggctaaatatttttttcttgttatcgtcaatcttaaaatatcttagttaggctcgatctgttagattgctactaataagtctatttctactaagccgataggttttcatgcaacgtttcatcggactgttagccgatgagttgtctttattgtgggttagctatcagatataatgattacttagttgatatacactttaatttatttactgttggcggatggcatgaggcccttcgaccaaatctgccgaaacccgtggcaaagactatggagcaagaacggcgcgagacgaggggtcgtgcgagtaccttgtcgagccagaggcgtcccaggcgaagggtgcaaggcgaagagtatctgccgaaggaagacgatttcgccatggcaagttcgcccccgcgagggccgaagaagcctttccggcccatcaagcctaggggctatagggccggcggtcgcccgacggcccatcaggggcccatgaacctccataacattatgtaccccctgtaaatgtccctttcgtaagggtaaccatgtaaattcccctgtataacctaaaccctagtagtaagaacctataatggggctataaatagtcccctagggccatgtaataaggggatcccgaagtaaaaaattctaaaattaatacacttcgtttctttccaaccactgttgagtaaccacgtctttcgacgtatgcggttgtcgtttcgacaacatttacattggatcttcagccaatggatgttttaaccatcctatttacatcacattatattattagttttgaccgattggttcaaattatattatctcatggcatcttctgagttacatcggcttatactcaaacttgtataatcatagttaaatctatatttatcaacttaaatcttatattttttcggtttgatcttatctatcaatattgcttttgacaaagaatgtgtttacactcaaatttggcacctagaggcgaaataggaaaaattgccaagatttgggaatctaccggtttcctccagaagggccgatctaaccgccatgtatggaccactcagactgtggccagagggccggtctgaccagcagagtccaagtcagactccgtttttgtcgggtctcgagattccttgctcagggggctatgttttgggttctttttttgttttctacccctagttagacatggaggagggcctgtagagggcaagaccaacccctatttaatggataaggtcggttcaaacaatgtatcacacaacgatcaatcaatcgaatcgctttttcaatatcgctttctgcttttcacttagctctactttaattcgtccatctttattgatttacgccgtaaatcattcgccttcattgcgagagtgcgaaatcctttgtaggtttgtcccgtaaaccttctgtttgcccacgagacatgtagttattcaccgttttatctaaatcggctccgctatccggtttaatctatcaaaacccaacttgatctagattttgctggtttggggtggttggcgactctacaaatcaccgcaagacgtttaggtgttgcgatcatgcttatctacttgaccaaaaaagttgccaacagaaagcagacgggaagaagaaggacaagcgcgcgagaagatagaagaggcgagccgagaaaacaaggagaatttctttaatttgtacggggaaatctctactattataaaaattgaagatattttcgcggtccgtcatccgtttttgagtcggttataaaaattgaagatgtttctgctgttcgtcattcgtatttgagtcggttttaaatttatgttttggttttaacctatatctctgtctctgctatttaaaaaataaagatgtttttgtcgatatttttatatgtcatctgtgtatgagtcggtttttaagtttacttgctttttttgaaaataaatatccgtatttaagtcggtttttaagatcattcacatgcattttttttatagtaatagtattataagtataaacacagtagttaagacggagccaaacacagcagagccgtcccgatctaatcgaccgagcccaaaactaaccctaaattccccagctccccaccacgccgccgccgccgcctccatgggccgcaaagatacttcctcgtcgtcctccgccgccggcggcaagaaggacaagccgatgtcggtctccgccattctggcctccatggacgcgccggcgtccaaggccaagccatccaaggcggcgtccaagcccaagccctccaaggcgcccgcgtcgtcttacatgggcgacatcgacctgcccccctccgatgaggaggaggacgacgccgacctcgttgccatggccacgaagcccaaggcggcccgcgccaccgtcgacctcaacgccatcgcgccctcgcagaaggacgcgaagaagaaggacaagcgcgaggcgatggcggccgcgcaagccgaggcggccaagcaggaggcgctccgcgacgaccgcgacgcattctctgtcgttattggcgcgcgcgtcgctggatccgccggggcctccgagggtgactccgccgccgccgatgacaacatcaaggatattgtgctcgagaacttctctgtttctgcccgcgggaaggagctactcaagaacgcctcgctccggatctcgcacggccggcgctatggcctcgtcgggcccaacggcatgggcaagtccacccttctgaagctgctgtcatggcggcaggtcccggtgccccggagcattgatgtcctgcttgtggagcaggaaattattggagacaatcgttcagcgctcgaggctgttgttgctgctgatgaagagctcgcagcgcttcgtgccgagcaggcaaagctcgaggcctctaacgatgctgatgacaatgagcggcttgctgaggtttatgagaagctcaacctccgggattctgatgctgcccgggctcgtgcatccaagatccttgctgggctggggtttgatcaggctatgcaggccaggtccactaaatcgttcagtggtggctggaggatgcgcatctcgcttgctcgtgcgctgttcatgcagccaacattgttgctgcttgatgaaccgactaatcatcttgacctccgagctgttctttggttggagcaatacttgtgctcacagtggaagaaaacactgattgttgtgtcccatgatcgcgacttcctgaacacagtttgcaatgagatcattcatttgcatgataagaatctgcatgtttatcgtggaaattttgacgactttgagagtgggtatgaacagaagaggaaggagatgaataggaagtttgaggtgtttgaaaagcagatgaaggcagcaaagaagactgggagcaaggcagcgcaagacaaggtcaaaggtcaggcactatcaaaggctaataaggaggctgccaagagcaaggggaagggaaagaatgtagcaaatgatgacgacgacatgaagccagctgatcttccacagaaatggcttgactacaaggttgagttccacttcccagagccaactttgctcacaccaccgctccttcagctcattgaggtgggcttcagctaccctaataggccagatttcaagctgtctggtgttgatgttggcattgacatgggaacacgtgttgcaattgttggtcccaatggggcaggaaaatctacacttcttaatttacttgctggtgatcttaccccaaccaaaggagaggtaaggaggagtcagaagctgaggattgggcgatactcacagcattttgttgacttactgacaatggaggaaaatgcagttcagtatttgctcaggctccatcctgatcaggagggaatgagcaaagcagaggctgtacgtgcgaagctcggaaaatttggtttaccagggcacaaccatctcactccaatagttaaattatctggtggacagaaggcccgtgttgtgttcacttcaatatcaatgtcacatccccacattctcctgctggatgagccaacaaatcacctagacatgcaaagtatcgatgcattggcagatgcactggatgaattcactggtggtgtggtcttggttagccatgactcgagattgatctctagagtgtgtgacgatgagcagaggagtgagatatgggttgtagaagatggcactgtgaacaaatttgatggaacatttgaggactacaaggatgaacttttggaagaaatcaaaaaggaagttgaagagtaatgtgtttttatagttgcaggatactgcttattctttatagactgggctggtaaacttaatgtactagtacttattttctttggtttgcagagtatttgtatggttgagtccgaaacacctattcgagctgttcttgctttttgcatgatctaagaggttccaggatgagtctgataaatatgttttctatgattttgctgccaattactctgtactaagacttccatgatatacatccataataattcagtatgatttcatgttattggctcatataattaatattatattatgctcagcggtactttatgttggtcagattaatccaaattattatcaaattcttggtcaattagttcaatatatggttgaatgcctatatgcttatggatggaatgctcactgaacaatcatatggaactgcagcactgaattgaaagcacactaaatgtgcgtactgaaaccatggtaattgaaggacaatgttacactgctgattattgaaactctacatcctgcagcttgatcctgaaggactttatctggttattatcaccgtatgccttactgaaaacatgctatatctaactactgaaatgttcagctattgattgtgtcacaagttgtactgctaattaactaagctacatgctatgaatggcgatttaatgccataccgatacggattgctctggatggtttgttacaagacctatgatttctgcttaatggttcaactagaagatctgcacgcctgttggcgtgccacctaatttagcatgtaatatggctcatctgtaatatatatagaaaatttgcctacctctcattttatattatttgtaactctagcaaaatttcacatcaaacaaggagatgtggcaaattacactgatatgcttattaactacattataatcgttttcaaaagcaatattaactttgattgacagttatacatggcatttaaaaggtgaagatagaagaccacgatctaaaaataataatttgaaatgtgagaatgaccagtaatattaaacatgcagagtaatatattattacatgagtaagtttaactctgaaaaaaattctttcaaatggacatgttaatggaatttaattttatgtttgtcttagaattatgagaaaaaccaaagtaagattgtaattaatgatgatcaataatttggcaaatagctagactctattagaaaatttaaagttatgtttcctcaaaattgttgtgatttcattaaccaaaaagtcgtacatatagtatcaatgataaagtgcatatttgaagaaatggttcttagtttatatttgaacaaattctcatccaatctctttcactttatatttgatatttagtttttcccgattattatttattttatataaatacaggatatcaatattttatgttttgaagattttttttacaaaattatttatacttttctctaccttcctttttcctacttttgtttggtcctgtttgtgttattactaattaattagcccgagaaggtaaagtgcaacgtgcaaatgctgtagcaacaacgctagatgaccaggcctagtgcagtcatgcatgactgggctgtacagcccatgacaggcgggatggtaattttgccaatgggttcgggtatccacggatacccgatccaatgggcacgggtgtgggtgtgattttttacctgtgggcacgcctacccgagacccgcagacatcgtgagcaacagccgagtttcattttttatctgtgggtaacccatgcccgacccaattcatatgtattagctaatttcgacttatctcttaattcttatacccctttctcttgattcatttgtgatactaactactaataataagttgtgacgtaattcaaattattgttgatagctgataatttgataaattgttgattttatttctctttgttaaattatatatttttcgagttattattcatgtgagatccattgggtacccgctgggcatacccgtgcccgcatgggtacgggtacagagttttgcctgctaaccctagtgggtagggtttgggcgggcgacgacgggcatggggtcgggcatggttttgctctacccgtgcccaacccgacccgttgccatccattgacagccagtgaatgaaccaatggcttttcttttctttttctttttctttttcacggtccagtgtccggactaatcgagagggctggacgaatgaaacatgccacgtggaccaatgaaacgctagaagaatggctagctttagattaatagaagagatgagacaattgcacaatcgacgctctagctgaatctcacgggacacgtggctggttttcaaaggagcaaaccctaaaatcttagggagccacgtggcccaatcatatgcttgattttttaccttgaattcggtatattagataagatttgattcttttaatgggacatgctgctatgtggtctttcaggcttaaatctgaactactgatgccacttgaactgctgctaatttcctgaggttaatttatcaaggtcacaaactaattctaactaggtcataaactaatgataactattcctgtataaggttcatcctgtagggtcttcattagaatcttacatcatatatactagcttatgttgtcacacatttgcgcgactcttgttacgtgatacgtgagtgtcaatcaatctgttgtttttcttgttgctagtaaaatataatcaatctgttgtttttcttgttgctagtaaaatattgggtcaggatgagtcatagtattatgttggtaaagtagatggcttaatatttattgtaaattttaataggtatgagacatatgtatcaccctttattcttcacttattttctattagtgcgtacccttttgtgactcattgtcatatattttgtaggtttttaaggattagtttaatttctatttttaaatttgtgtgaaaaatcattaagcctatattcaggtgaccatgactcattattggaaggaatatgcatgtctcagtagcaattttttttctcaaatacattaacaacaaattgctagaaacaaaaataatcacatgaacatacattttgaatatgccctgaatagctcaatcttgactaatgaatatttagttaagggaatgagggtgccttttttcttccttcatttctttctttccacttctagtagcttcatctcctgaagtctcttgaatgtgttcttttgccatcatttaatccaatggtctaagattcattcactcttttttgtcttgtagtaagttcaatggctaatatttaccaaataatgtggctcattctcagtccactttggatgtcacttttcactagttaagatataaatagctgtgatgggctatgagataatgagatgtgagacggcgaatggaatatggagggtttgcatagggattggggataagatctgggcccttggattgtgaacctatgattcaagatttggaagattagagatccaatttattgtgaaatttatatcctctatgttcccaaatataagcaaattttaggattcaaattttatacacaaattgtttttataggactatgattccaatacatgaaaataaacattttcaaccaaatattccgtttgtccaaaaaaaaagaagtatgattggatgtgacgtaatctagtcctcgagccccgacatgatggtcagggtgggagacggggattgatagagaaaataacgtggagctgagacgggtggtggaggggggaggtgtgaagttgtttaaataaaaatgaaggggtcgagtgggctgaagttgtttgtagcgcatctgtcatctgtctcgctcacaatacgggatgtgggtgttgggtggtgccgttcgcttgtcaccaaatcatgccatcatgatcagtgagaaggtagctttaaaatagggagtttataggtagttttgtctgaaatgatattatagtgataaacacaccatttgagaataatattttgataaaaacctaatatatcaaaggctaagggtgaatgcgtttggtagaggggagattttaggagggatctcctcttgacctggataatggtgagttggaaaggatttcatcctctaccctatctaaataaatcttagcactatatttttatttaaaaatacatagtctaaactcaatattatttctaccttctaccaaaaatacaagattaagattgaaaaataaattttcgtaacaatcatacgatcaatttcctcataaaaaactcccaatcctcgtctcaatttaccaaacaagcccatgcatcaaagcctccaaggcaggcgccaaccccagcccgggaacatcttctccggttctccctcaccgctcactggctctcgtctctcgccgccgccgccgccgccgccgccgccgtcttgccctcaagcatccgggttcgccgatcgccccacttctcccttcctccctccgccagcgccacctccgcgctactgcctcctccctcctttctcgcgcccgcgcctcctgaaactgggatcccccaatggcaatggattcaagtattcaactctctctctctctctctctctctctctctctctctctctctctctctctcggtgaacattggggccgccatttgccaaagatataagcccgagaggttcagcttctcgtagaagctaaggctgtgatgcgactgggcggatggatgctccggccactgaaccgcggcctcctcctccccaccttgtcctgcccagttgccccacaccgccgtgggttcgcagcctatgcagcagcgctacagtggctggaggacgagctcacctcgctcgcgatcctcccctccgtccccggggtggactccttcgcgtgcgccaggcagttgcagggctgcatcgctcgtggcgacgcccgcggcggccgcgccgtgcacggccatgtagtgcgccgcggaggggtggggcgcctggacctcttctgcgccaacgtcctgctcaatatgtacgggaagctcgggccccttgccagcgcgcgcaggctgttcgaccgaatgcctgagcggaacatggtgtccttcgtcacgctcgtccaggcccacgctcagcgcggtgattttgaggctgccgcggctctgttcaggaggctgcggtgggaggggcacgaggtgaaccagttcgtgctcaccaccatgttgaagctagctattgccatggatgcggcagggcttgccgggggtgtgcactcatgtgcgtggaagctgggccatgatcacaacgcctttgttggttcagggctgattgatgcctactccttatgcagtcttgtcagtgatgcggaacatgtgtttaatgggattgtgcgtaaggatgctgttgtctggactgcgatggtttcttgctattctgaaaatgattgcccagagaatgcctttcgggtcttttccaagatgagggtgtcgggttgtaagcctaacccttttgcactaaccagtgtgctcaaagctgcagtttgcttgccatcagttgtgctaggcaagggcatccatggttgcgccataaaaacccttaatgacacggagcctcatgtcggtggtgctttgcttgatatgtatgccaaatgtggggatattaaggatgcacgtttggcttttgagatgattccctatgatgatgtgatacttctgagttttatgatatcccggtatgcacagagcaatcagaatgaacaagcctttgaactgttcctccgattgatgcgttcttctgtgctgcccaatgaatatagcctttctagtgttctgcaagcatgtactaacatggttcagttggatttcggaaagcaaattcataaccatgctataaaaataggccatgagtctgatctttttgttggaaatgcactaatggatttctatgccaagtgcaacgacatggatagctcacttaagatcttctcatcattgcgagatgccaatgaggtgagctggaacacaattgttgttggcttcagtcagtctggtttgggagaagaagcattgagtgtattctgtgagatgcaagctgctcagatgccttgcactcaagttacatactcgagtgtgctccgggcttgtgcaagcacagcatcaataagacatgctggtcagattcattgttcaattgagaagtccacatttaataatgacaccgtaattggcaattcacttattgatacatatgctaagtgcggatacattagggatgctctcaaggtatttcaacatttaatggaacgcgatataatttcatggaatgcaataatctcaggatatgcgcttcatggacaagcggcagatgctctagaactttttgacaggatgaataaaagcaacgtggaatccaatgatatcacttttgttgctctgctatccgtctgcagtagcacaggattagtaaatcatggattatctctgttcgattctatgaggattgatcatggcatcaaaccaagtatggagcattatacatgcattgttaggcttctaggacgagctggccgtctgaatgatgctctacaattcattggagatattccttcggcaccatctgctatggtttggcgtgcattgcttagctcttgtataatccataagaatgtggctctgggaagattttctgcagaaaaaatacttgagattgaaccacaagatgagacaacctatgtcttactatcaaatatgtatgctgcagctggaagtttggatcaagttgcccttttgaggaaatcaatgaggaatattggtgtaaggaaggtacctggtcttagttgggttgagatcaagggtgaaattcatgccttttcagtgggatcagtggaccatccagatatgcgggtgataaatgcaatgctggaatggctcaatcttaaaactagtagggaaggttatattcctgacattaatgtagtgttgcacgacgtagacaaggaacaaaagactcgaatgctgtgggtgcatagtgagaggctggctttagcatatggccttgtgatgacacctcctgggcatccaataaggatattgaagaatttgcgttcctgtttggattgtcatactgcatttacggtgatatctaaaatagttaaacgagaaatcatcgtgagggatataaatcgcttccatcattttgaggatggaaagtgctcatgcggtgactattggtgatcttctgttgttccttgatgtgttaaaggaatccatacaagttatatgtgatataatgtgtttggcaaatggcaatcttctaggaaaccaagttatcatgcatgctctattgttttgggtaacatggttttgaacttgaactcgtgcaatttcatgctattttcaaggcactggagaagagatatcatatcagactgggctaccattccgaaaaaaaaaacccattcatttttaatgtttagtgttacctaagcacattttcgttattgacttgaatactagtgaatgtcatctcattagcaatagaaaaccttatggctgaactgaattggctgatatttttcgttctctatgatttcatcaagttggtagatagccttttgtttaagtatgttctagtgactgcattggaaaattgacacttgcaccggccttcgtattgatagtaattagcatagttcatgctatgacacaaacattaggccatgcaagtggttttcatgaaagagctttccattttctaacgtttatcttacatagttttgttagaattgtaggggggttttagttataataaaattggcagcgaacctacaattaaagcatcggttgattttcttgagtatagttaaagcagcaaacctataattagttatatactttgagttgtttaaataaatatcgtttgattttcttgtgccattgccttgacatcattgtgccgcattatcag

SEQ ID NO: 41827 - DNA, 11240 bp, Oryza sativa
gcttgcctactggcttattcttaggctatataaccttctactacctccttatggaagctgagggattgtttgtgccggatcatcctgtaattgctcatcttgtagagatgaagagtattgtagaaaaggtttgttttcttttctacaacaaccttgtttctttaatttgtatattttctggaaggagttaatgcagtaccaatttcaattaatactatgattttttatcattgagttgattgcaaatatttgaataatatctgatattaaacgtatcattaaacaggcccatatatcttccaagacaacaaggagacattaatgactgttgtacgcctggtagcagtaccatggatgtgctagacaagataatttttttggacaaggacaatttactagtacgggataagataaaaataggatctgttcttctttactttactataaagtacaaacatgataattgaagtattctggtaactcatcatgataatttttattcagcgtgcggaagttgctgaattgacaaagaatgaccattctaataaggcttagaatgaaattgacaaaagaaaggacaaggttgaactgaaacaacacttttgatatattttagcattttgtttcgaaaataatgcagatgcacaaaagctgaacaaatattaaaattctaggatgagcatatcagctcacaaagccttgaaatgttggaagtatgagcaacccttgaagaaaaagggctctataatttcacgcagttgaagcctgagaaggtttcaaacaccaggacaactcctcataggtgagtcattagttgtgccatctctttctcttttaaacgacacatttaatatatttggatggttttagcttttaaatgcctttttgttaataattatgagatacctgcaaatgttggatgattttgatgatgatgttctcagaaatagacaagtaaccaaacctagcaaggtcctggtagcagtggtaaaatccaataaaaataaggtctgtatacatttttttaatttttttccacctttctttaataattttatatttggttggcttctttcttagtttctacaatttcttaaatcttgtgataacatgtaagcttgaaatgatttaaagtgtgccaatctaaccgaagccttctattgagatgatggaaatacagagctacctccaaaactgtagaaacaaaagtacttatgccatgcatttttttagagttactgtagaatattgatgtataggtagtttactgcaatagaggttcaaatatcatacttctatcaagttacccaatttgacaaacatttttttttaaatgtgacagtagattttggtccctggccagtggtctcagatgagaaaactgctatttcatccgtcacaaaatgtaagcattttttaggtgggcacgggtattaaagaagtacttcctccgtttcatattataagactttctagcattacccacattcatatatatgtctagattcattaacatatatatgaatgtgggtaatgctagaaagtcttataatttgaaacggagggagtaggtgagaatgattcgaggaatattgtgattgattgagaagagaaagtagatgaagaaatcaaatgaagaaaaatggttgtgattggttgagagtagggtaggtggaaaaatagctttcattttgggataaggtattgtgctagaaatagctacatttcgggacagaggtaacaaaataaaatctttgacatcagtttgttcagaatgatctgagaagaaaactgcgagaaaacgttgcttgagtttgcaattaatgttgtatttctgaggcagtgagatatctaggtatacattgccaaagtgtagtaggacttcacaaattgacagaagagaactgaaattttgtataagacctggtcataattcgtgtccattcttgtgaatatttgaagatatctcatccttgaggaagcgtaataggaatggactctgctgcatttggtgccttttgtccttgaaaacttggtttagctatgtactagctagatctaataattagctttctcaaatatgcagtaccaaaatatattggatattttcttcttgtattatttcaagtcattcctctaatggttgtctcgctgctatgctgttcttgcagagctgatgtgctaatctgtcatattaactcaataacatctgcgtgtgcataaattgtgttcaatattctttagaacaaaaaaaaatgtagttattcttgcctggttagagatagtctgaaatatgtaattgggttacagttttttaaattgctggtgaagtggtgataccgtgatatttcttcatcagtggtagtgtctggttatcactgccatgctcttgcatacaagataaactcttctttggtgtatgttatttgtggttgtgacagttgcagctgtcagatactcttttctgctctttattatctgtttatgtatctccagttcgggtatagtctttttctttggaataaaaaatgtaggcacccttttctggttagaggtatgtctgaatatattaagtatcttatagctttttggcaaaagttgcagttttgaattttatggtggtgttaagaaaagtatcaggtctttgtgtctgattcacaccaggccactactattctcttgcataggagtacctatttagcacatgcactttggagttctggatgtcaaatgcctacgttaattgtggttacgacttatgacagttgtagacttgcaccagctgcttacctctttcttttttttaacctgctatgttttcaagtttgtccctggtgatgatgagcttccaaagcgagataatattggtgaaagacagtgaaaatacgaactacatgttcttgccagagtagaagctagtacacttgaagaagatgacttgcccaatgaagatgcccatactgaagggaagcttaacattttcaatccaaaacaacaggaacagaaacatttccatactgaagtgaagaagatgacaatgatgatgacattggaccatcagagtacaaggacattaaaaagcatgactgaaaaactcgagcaaagaacagaaatactcaccgtaagttccattgataaaaacttatgaagattgattgtttccgatcaaggttcttttggcaaggggatggacacaaaaggaaatatagactagcaaggtgggacatcatatgtcgtcctaaagaccaaggggggttaggaattcaagatcttgaaattaagaacaaggctctccttagcaagtggttgcataaactactcactacagatggtgtgtggcaacaaatgctaaggaacaaatatttggggtcacagcctttgtctcaagctcagtggaaagcaagagactcacacttttgggctagtctaatgaaggccaagcttaattttcttaggtttggctccttcaacatcaaagatggctctcaagttcggttttgggaagataaatggttggggaatgcctgtttaagggaacaatatccttgtctctataacgttgttaggcataaacatacaactatttcagaaattttccaaaccagtcctctaagcttttcttggcgcagggaccttactggctttaagttagtggcatggaatcaccttctctcacgcatcgctaatattatattatctcacgaccaagatgagtttaaatggaatctaaccactgatggcagattctcggttaaatatctttatcttgcgttggtgcagaccgatgttcccaatataaacaaaagaatctggaaaatcaaagcccccctaaagattaagatcttcttatggtacttacgtcgtggagtagtcttaacaaaagataatcttattaaaaggaattagagaggaaacaagtcttgttctttctgccacaaagatgaaactattaatcatttgttctttgattgtcgttttgcctgcacagtttggtctataattcaattttgcttcgaatattagtttacctaatagtacaactcatatgtttgggcattggataagaagacaaccacgcaatttgagatctttggtcttattaggggcaactaccactatttggtctatttggctttgcagaaattatgtggtttttgaaagaaaaaacatatcttctcctttgcaggttatctttttgattacacattggctccgcttatgggctatccttcagaaggtcaatttgcggggtactatcattgcggcttgttaacaattggagctagtggccatggagttttctaccccggtgcatgggtggtgttctagactacggttagagggctcctgaagttctttttgtccctgctatttggatgatgagtttatcttttgtttctttcttgttggctgtgtgcactctttgggtgcagaagccggaggtgctcgcagaataattatatcacttgatagagttttactaagattaataaagcttccattatctaaaaaaaatacttattcgttgactgtattacagaaaccccattactcaaccgctggaggaagaagctgaaggaaattggcaagaggaagatctcataccaggttaatcctccactagtgtacggtacaacctttcacaatttttattttttttatatgtgtggctaattaaatctaaactcctccagatagagaagaaaggttaacctgcacaagaacaaaagcttaagaatccatggaagatagggtaagtaataacataatatatgagacagccgagctatgtgagcaagtcattcagatgcactcgcttgtgtgtatgatcgttcaagctaagcatcaaaccaagcttgtttagcggggaggtaagtgcgtggcgtcaaccgtggggtgaatgtccggcatcaatccaaatgttagccatagtgttaggtttaaaggttgatggatcctgcatgatgaattgattatggtctaacatgatatttctttgatggtacgtagttttcttgttaagaattttttgagagatcgcacacatgatatttggaggttcaacgtcatgcattaaaaaattgtgttatgtgctatggatgcttagttctcactggtggagaaacctcaattgtcccagtttacaaccccctatatcccgggttgcaaaccgggacccccaaattctagactaaagatggtatctttagttccggatcaaatttgatcaagtttatagacaaattagttttattaaatttataattgaatattttttcataatatatttgttttggattgaaaatgttaatatttttttctacaaacttggtagcagtttgactttgaccaaaggcaaaacgacttataatctaaaacggagagagtagtttatatgggtttctcattgttttgataccctaccgatggagtagtgcaagtgtagaaatttatggagttaccgaaatttggtagtggtaaggttgtgatagttgcaggagaaaattaacaaaatcgaaaagatacgtagtagataaactcaaaagataggttcgtattacacccattacacccatcaaaagataggttcttttttttttaaaaaaaaacaccttaactatggaactggacattttaaatctcaaccattcaaaccaaccaaattaccttcctaagaataaagtggcattcataattttggcatccaaatgtattagtttttctacttagatttaactactttttatatcttttctaactaagtgccatataagtacgaaaaatatactcgctctgttccaaaataaaataaatggattcctagaatcccaacaaaactttagtagggaggaaatgaccatgcacctggtggtaggtagcaagggataaagtttttttatttgcagatcgggggtatgtaagaaggtaaaaatcaatttattttgggacaaaatttttaaactttaggaactaatttattttcggcttgtttgataacttgagggaaagagattgggagtttacatgagggaattgatgatgagattaagatgggaatttgatttttaatcccaatattttgtttggtagaggtgatggaaattgatagggagtttagttggagattaggtcattaataaaaacggatggctgagatttgcttagacaaagtaaaggaggaattccctcccaattacctgcccctacccaggtattgaaaatgaggtattgaaaaggagggggttccttcctcaattccccatccccatcccaccaaaattcccatgtctcccaccaaataaaacacttaatagcctcatttttctatattcccaatccctcctaaaaactccctccaaccaaacggaccgtttgggatggagtcgaaaacggtcggaaacgatcggaatcggcagcatcttttcagaaacgatgctcgaccggccggtaattgaccatatttatcatttaaactactcagtattgacattaatacggtgtagaaagaattgtgaaaaaacaacatttaaaaatagccaaaaacggtatggtcagaaacggtacctcttatatggaaacgacgctcagtcgatcgggaatttccatgaccgttttcacccctagatagagtataatatttggatcttaaaaccatgaaaccgctgttaaaattgggttttgttgccatttgtgtgtgtgcgcgctcatactttcggaaaaaattttaaaaaataatttgttggctatattgttggtactatgaaacagaggatcgaaatcaaaggtacttgctatactatcaggttctctcatcaagtatcaattaggtttttttctatattttagtaataaaaagttaataaataacaagaagacctctcttttagaaactcaattatattatgtttcatgatttaataatcaatgatatgatattatttaaaaaaatgtaggctagttttttaaaaaaaacaaaattgtaaagtagtagtaaaatcttgagattggtctatattacacccttaaactactggttttgtttttaacaacgaaactagacattttacacccctcaaccaccaaaatcatccaaaataccctcccaaaagtaattttagttttgatagtgtttcttacaattttactaccgattcaacttttctactatatagccaagcccagccaaaagattattatacacacccatataaaatcatgagtaaattgcatattgggctcagtattattaccaaagttttactttgggcaagggtatagcctgcattttcactttggactagagtttctttcctttggttgcacgttgggccacctttctcgtcggccggccaggcactgcgtgcatcccaccattgctggcagtggcaggctccaagggcagccattattgttgctgctgcaaggtgtgaggatctcctgcacatgtgtaggaagaggagaagctccgggggacagccatcagggtggtgaggcagaggagctcgtgcacagcggctgggatggcagcaccggcgacgctcgagcttgtggtggagcaaacggagtttaactaaccttgagggcgagggacacgattccttttgcatcatccggtcaggtccattggggattggaggggattatcgcaatagatgtagaattaatcctctccaaatccccctcaatccacttgtgggagggggccttagagggaagcaacagcaggttgcattctcatgcatggaggagtaggagcaagggggcggaccgcagctagaatgatatggagatgaggagctcaagcaggaagccatgggaggctcgtgggagttttgagttccttggccatgaagcgcgagctcgagctagcccagtatctcttcttcgtatcaccaggggacacccggcttggcattctaccccttgtgcaatgctgagcagagcagtgatgtgctcaagcatcgtccctcacttcctccccaagcagtcattggatctagaccacgggcgaggagaacggcagggattggcggcggtggtgatgaattggaagcagagaatgcacggctggagagattgagacatggggtggcctaaattgcaacaaaggcgatatttcctagtataaagtgaaaacattggctcttctcttgtccaaagtgaaatcttggtaataataactggcccaagatgcaattcactctaaaatcattgtcataactaatactaggtgacacctcatgctttgctacaaaatgtatggataaatatgttaaatattatacaaatgatttatgttgaaataatatgaaaataatgtgagaaagatgatttgaaatattgtatgttgagttccataatattatattctagatgatgtgttatttttgcatgagatttaagatttctagtagaatagtaatagctagtggatgatgaagtgacatacttgcatgtaataattgctagtgagtaccaactatatatagaaggtatagatttgttgatgaacaattgaatttgcaaatgacttatttaatggaaattggtttgaaaatatttgtcgatattggtgtaagtatgtgtgattaacacaaatcggattgcgatatctataactagaaacaatttgtgtgcagatgattaaggatatttttggtcaattgcggtgatcgggactagcatggataaaatgtcatatgacaagattgaactaaagtcatgagacctcatggtcaatctcggttaacagcgggatgatgactacgctcagagaaaccgaggtttagatcagtcaaggatactaggtgataattttggacataagatgacatgagggtggacacatgcgggggaggagtctgacacagtacgggtcggtctagattttctatctatggctgcctttccggagagagggttttgaatttgggaaattgtaaaaattttggataccaagggattgagttatagtgtaaataggagttttcccttaaaagaagtgtaaataggagcttttgtgatggaattactagttatagatagacgagaggtttaactcaacacatggataagcatctagagttagagagaaaagttagggttaggattaaaaggggggcgattgcatttttgaccttgttttgaattcaaactactaatttgactctacttttttaagtttgctcatttgaccctcttttttgaaaatgaaaatcagatctgaccctcttttgtgaatgcaatgtaacggtgttaacttaggtaaaaaaagacgtttacgcccatgcttatttgaccatattttttctcaaagtttttgtttatttgacccagttttctactcattatatatgatgaatttgaactaggtatgacatatttggcttagttttcatttgtttgacttagatttgaaagcattttaagaaatttgacttagatttgatatatttttgacccatttgaattagtttgatatatttttgatagatttgacttagatttgaaaaaaaaagtgaacatacaaaaaaattgacagcatttatttatacgcatacatccgtcccgattaaatcatttctgtaatatttaacatatatttatccatacatttcgtagcaaagcatgaggtatcacctagcgacaatgattttatacgagtgtctataagcttttggctgggcttggctatagtagaaaagttgaatcggtagcgaaattgtaagaaacactatcaaaactaaaattacttttgggaggtattttggatggttttggtgattgaggggtgtgaaatgtctaatttcgttgttaaaaacaaaaccagtagtttaagggtgtaatatagaccaatctcaagattttctactactttacaattttgtttttttaagaaactagcctacatttttttaaacaatatcatatcatcgattattaaatcatgaaaaacattataattgagtttctaaaagagaggtcttcttgttatttattaaattttattactaaaatatagaaaaaacctaattgatacttgatgagacaacctgatagtatagcaagtacctttgatttcgatcctctgtttcatagtaccaaaaaattattttttaaaaaattttctgaaagtatgaatacacacacacaattggcatcaaaacccaactttaacagtggtttcatggtttttagatccaaatagtatactccatcccaaaataatgtagttcctaaagtttaaaaattttgtcccaaaataaattgatttctatcttattcctatccgctatcctattcctatcttgggccttcttttcatctgcctacgtctcaacactcaggccttcagtttcttttcttcttttttgccccatccctttttaaatgaacaaaaaatttaatgtttatattaaaacataatatagattaataatacgaatctttctaaatatttgtaaatattttgcaaaataaaaacgatttgaaaatgactagcacacgtcgctggttatttaaaaagacaggtgattcctcgcgctttgctgcgggaattactaagcaattctcaatatattttttcgacaatcaagttaggagtaaaaaggaaaaaataatgaaacatcagggcttatcagtacttattaaaaaaacaaatgatactcgtactttaatgtgaaacatattaataagtatacattaaatattataaatttattagaatattatgcaaatgatgtgagggatgattgttggatatgcttgcatgaggttaaatatgtaattattgctagtgggtgatgatgtggcatggttgtatcttgagttttagacttagtgggctataactttatataaagtatagatagggagtatttgttattatttattagttacccatacattagaacattaaatttaaaaggaattgtgcgacaattctaggttatgagtggtaatgctcgtttctagggcaagacaatctcaacgatccacttccgaaagtatgttttgctctccgttgatttttcggattttctgaagatggctctcaaaaattccgaaatcacaaaaattcaaaattcggtactgatgtgttttcagatatgttcaaaatgaaattttgtaatttctgaaattcattttagccctgtttttggagatttatatattttcaaaaatgatttttggaatttttgaaaaatggaatctttggttccaacgggtagatctaaggt

SEQ ID NO: 41828 - DNA, 1195 bp, Oryza sativa
tgttctatgaggattcttttggaagatgcggatatgggattatgtgtataattgcttactaataaaggagacctagggtctcgtgtcagaggaactatattctaacctcgagttaataaccaacctgttgatggaaaagaaaaccaattaaactgtgttggattaaaaagccaatgagacagtagttggggataagagtttggatacgccttttacggatcaagataaggattgttggatgaaacccataagggtacctcccatgcctctacattgataagttcggatatacctgcaaacagttaagaagatctaggagacatcaatatttgagaacatagtagtcgatggttggtaattagtctatcaggtatcagaaaaggttcaaaggtgatatggcagaagaacaatttggatgctccccatctcgaggaagcactaaagatgatcatcggcaattaaaccctagtggcatagatacagatagcaagcgatgtatttccctgaaggtagtcagtgcagctttttgacgaaccacttcaaggtttcactgaaaggcagcaggccaaaggacctcagttctctagccggaaagaagtaggccgaaaggtgattgataaaggataatcagaagcatgctttgcatcactcgaggaagacccctgatcaccctgcaatagtcaccttgtcattgaggtagaaaaaaaaatttcatgagtaagcaagatgacctaggtaaaagtgtttgtttgaaggcaaggaatgaaatctttaactcggtatcagatgctacacggagtgaaaagtgcaggcaccggttaccaggcaatgccatgtcttggaagatgatccaatgggaatgaacccttcaaggtcgaaggtgtaaaggaatacgttggatgctaaataatgacaacatgaagataatagtgggataagttggttctgttgagaaacataattcaaaggcgaaattatcgacccttgcatcgaatagcagaagtagctagcacccggagaccaggaaagctaatatgaggcagttggtggcaagttagaagtaaatgacaaacatgatattctcatgatgacaagcatggtatcctagtaatgacaagctgatgtcgacgcataacgtgaagtgggtaacttgtatgaggttgatgccaaagatatgaattataagacgttctgg

SEQ ID NO: 41829 - DNA, 1458 bp, Oryza sativa
  unsure (1)..(1458): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgcaaaactagattatgtcttcggatgaatgcctgaatgatcagttagcctattatactatttttttccaacatggatttttcagtgatttagctttatgtgaacttgttaaactgcatgttacagcttgttggcgttgtgagctcactatgtgtcgaagcctgaagaaataccatctgaatgttgtttgtttaccttgtaccataggatttttgggaagttgtcttaagtagatgcaatatgctatgttttgaccattgatgcagcttatcatatagtctccatggttcttagtactgatgagttaccttttttttttttttgcctggcagttataggcatgcttgtttttcctaatatcaggaaaccctcacctcggattgtgaattattgaaaacaatgagcctaacgattgaaatgttttttgagaacttgaattgaaaagaggagttgggttggcagggctggcctcttaagttcctagtgctgcctaggtactccaagagattagcaacatattacatgctaaacaatatagcactaaaatagtaacacaagagcactctagccgcctattgcaccatctaattgctaaacacggtggctacctggcgcctgctaacttttagaacactgagtcgctgacagcattcactctttttgcctttcgtgagggaaatgcaagtaggccttcttttcaatccaaggatggaggaacatggtggagtgtgtatactgctggttcacgttgtaaacaattgatgacttccttttgtgtttctttgtgtgcagtaacactgtttccttgacattgatgactatcagttttcttgacagcatcacaaacaatataacctggtctattttgatggctatgcaggtacgcaatgtactacaaggagcaggagaagctatcccacagatactaaatgtgaagcatgcagagattgccacaacttttggaatttttatgatctaaaattatccaagaatgatataacatttttggttcagttatagttgtccatgtactgttttccatcgttccatgcatctccagtatgtatgacttgcaaacttatttttgcggcttgctacatatggtggcattccctgtcactgaagcaattgtttaataaagcaaattaactgtttatccggatgtttgactcatctgttaggtgcacaacatatctgcctgcatctcattatcaaagttaggaaaagttatatatcgctatgtcaggaaatagctttctatgaagaacaat

SEQ ID NO: 41830 - DNA, 31928 bp, Oryza sativa
ccacgtaggtgccacgtcagccaaaacagcctttaaaaccgccgagggacctaatctgcaccggttttgatagttgagggacctgttgtatctagttttgcggttgaaggacgaaaatcggattcgttgacaagttaagagaccttagatgaacttattccttctcttggccctcacgataatgggccgatttggcaggccctgctggcatggtacaatctctgggcctggcccattttcagagtcagacggcccatctgggctgtcgtttttctacttggacccctgaagaaatcattttttaacctttgcaacctacaacctcctcacatctcaactgaattagtaatagtagatctctcgccgtcgccgcctccgcctccgccgccggaatccccagcaacaacccgccgccgcgatgtctcgccggtacgacagccgcacgacgatcttctcgccggaggggcggctctaccaggtggagtacgcgatggaggcgatcgggaacgcagggtcggccctgggcgtcctggcggccgacggcgtggtcctcgtcggcgagaagaaggtcacctccaagctcctccagacctcgcgctccgccgagaagatgtacaagatcgactcccacctcgcctgcgccgtcgccgggatcatgtcggacgccaacatcctcctcaacacggcgcgcctccacgcccagcgctacgccctctcctaccaggagcccatccccgtcgagcagctcgtccaatccctctgcgacaccaagcaggggtacacccagttcggcggcctccgccccttcggcgtctccttcctcttcgccggctgggacaagcaccatggcttccagctctacatgagcgacccctccggcaactacagcggctggaaggccgccgccgtcggggccaacagccaggcggcgcagtccatgctcaagcaggactaccgcgacgggatgacacgggaggaggccgtcgccctcgccctcaaggtgcttagcaagaccatggattcgaccagcttgaccgccgagaagctggagctcgccgaggtgttcttgcagcccggcaccggggaggtgcagtaccaggtgtgctcgcctgaggcgatggggaagctgctcgccaaggccggcctctcgcagccggcgcctgaggcttgatctactgagatggtttgcttcttgttctcgcaattcggttggtgtttaatccatgtgatggtaaacagttgatgaatttagtataaattttcttttaagagttgccatcagctatggtttgaaatcaatccagattgttgtgtgttatcgtcctatttcttatcagcaagaacccttcttagtgattatatggttatattgagtatatttatagagcccaaataccttggacatatccaattcagtatgcagcttttgacagaaacacaaatggctaatctttgtgtattgggatatggtgtatttctctatccctagaatttattggttcgagttgtgatcctgatagagttcaccattatagtttggcagaattgctgacagtggtttccaaccatggttcaatttgagaatcaacccaaattgccgtgtaatttttctatctagtattagcaagataacctgcaactgttatacagtggaagtgtcgaactaccattgatatatcatattcagcatttagattacctagaaaaagatgattgttgttttgtagaattgtctatatcacaataggctgaagatttataggtttgaattgactggccaaattgttgggcttactgtattagctgccactggttttccatccggtaacccagtgaatcaagaacactattatggagagatgagaaggtggtgagctgctgaaatagcaagcaatcttccagcaccatctatctagttcttcagattagcaaagtcagccttgtcaatactgtgaatctgggtatcatagttaggctagaaggctagaaccgtcatgtcctatttcacagcataagatgaccacacaatccctccgagaacagatgtttgggggatcggatgagaaggcaaaaagactggaacttgcagatttcaggacaagaggagtttccccttgtgtttgatggaatttcctgatttcaataccttttatacattatatgtgctgttactgtggtttgcgctaaccatccttggctcctttctgatttggtacattccctacaatgataactgaagacatttgcatttggtataggagatgcttactgatgaacctcttttgagccgtgttacattctgtcaagttcaacataatcttgtgtttttgtacatcttatactcttttatctactccctcttatatttctaccagtaagggggttaccaatatggtttgtggaagttttcagacacttcgtggtcaaaatgatttacaggagtataccaagtttttttcttctgaactctgagatgtgaaagccaagaaacatgttaagaactagttaatgaagttgtattcagtaaaaatggagtgctaatgcaactgataattctagacctatattttttcatggcatttttactttggttactgatcatgagattgttagtgactgttcagcctaaggttgagcctcctgagccagacagagtgcaggatcatgtggaacatgtcgagcctctccggcggctggtgcagcatgaaatggcgcttcaccagccgcacgccgtcgcggaggcgctccacctccggtgccgggatccgctccagcagctccctcagcctcggcacatcggcgaccgccaccgccaccgagaacgcctcccaccgcagcacgtcggcgaacggcggcgcgtacccgtcggcgactaccaccggcacgcacccggcgtggatcgcctccaccacccgcgggctcgccacctcgtgcccgctcgggcacaggcagaacctgctccgccgcatgtaccagtagtacgggttgccgccctcgccgccggcgtcggtgtcgccgtcgccggagacggagacggggatggaggggaggtcgtactcgtagacggggaagacggccgggtcgcggcctttccagtggcggaggaggaggtcgcggacgtggccgtgccggccgccggcgaagaatgccaggaacggccgtggcggcggcggcgccggggacaggagctccggcggcatgtcgccgtcgtagaggttgatctccgggatgctgacgtccttgtccggccggaatccctccgacgtgttggcgttgcacagcgcgcggatggcgttcgcgtacagctccgggtgccccctcgacgcgtgcggaccctacgcacgcacgtgcaacataaaattcggtttgaaaatttcgaaattcggagaattttgtgcccccgatatgacattatttcgagggaagttcttttatttttgaacttggcagatctttttttcaaatttgaaatgttcacggatgaaaatttccagaatttcggatctttcgatgccccctcatttcattctatttttctttccacactactccctccgttcgaaaaaaactcaatttttgggtttccatgtctaacgtttgaccgtccgttttatttaaaaaaatattaaaaaattaaaaagataagtcatgaataaaatattattcatgttttattatctaacaataataaaaatactaataaaaaaatttcatataaaacggacgatcaaacgttggacgcggaaagtcggaaacccagaaattgagtctcgttgaacggagggagtatgtactgaatttattatttgcactcgtttcgaaatttgtatggaaatcatttggtgttgggaaaatatttttctctgaaaaaataagggaaaaaaatgatttgtacttgcccagtcgtggcaggagagcatgaagtggtcggcgccggcggatcggttccagaagcggtggcgggaggcgacgacggcgacgtagtcggcgacgatggcgcggagcggcgagaggtcgtacgacagcggccggtacgcgagctgcaccatctgcgacacgctcagcggcaggaataaggcgtgcgcgcgcgccgggtcccacgtccgtacgccgccgagcggcggcgccatgagctcgagctcctcgatgaagcggccctcgacggcgtagatgttcttgcacgggccctcgtgcgcgatcggcggctcgccttcctcgtacacgtacaccttgaaccgcctctccatctccacgtagctcctgcttccccctcaccggagagaacacggcggcgtacatgtcagcgagtcgccgtcgccggcgtacggacagatttcagttatgtactacctgtagaacgccgccgggttgcggtagacgcgctccaggcgagcgtggtccgcgtcgccgaagaagctcagccacttcgccgagctgacgttgctgctgcttcgtccctcgccgccggcgagatcaccatgtcgacgccgccgcgccgcccggcgtatcgctgctcgcgccgcgtcgagctcccgctccacggtcggcgacgccgccctcgccatcgccatccgggccctctcctgatgacacacgaaaaaaaaaagacaagcacaaagctcatcacactaacgtactctccaccatggcgtacacgaaaaccacacgcaccgcggcgagaccattcgacagccgacgcgccggagaagaggaggaagaacggccgcgacccgcgccggcgacggacaagaagccggcgatggccgcggcggcggcgagggcgaggatgatcaggcacttcttcacgctgagccgaggcgccatctccgtcgatcgccgccgaggatgcacggcgccggcggcgccgcggcggagctcgacaaggataccggatcaaggcggcgtgcatagcatatgcggttcagcaagcgggatgaagttagcagggaagcaggtgactcacaggatgttgggtttaagttgcaagtaactagattgttcacccaattctttcacccaaaccttgcctaaaaaagacacaaatattagagaatgacataatatcaaataattagaaggggtgaagcttcgaacccaagtcgtctagcccaccacacctcgtggagctagccgaaagacccctgggagtttctccacccaaaccttgcctaacaaattcactaccaaattttgatatgttaacaaactaaccatcaccttaccaattccatcgtactaaaatatggtagttctgaaactttcctcaaacaaaaacactaacaaaatttggaagacatcaagctaaatacatccagctactaaaatttagcaatgtaaaacttaccaaaatttgatattgtcaaaatttggtaatgttagaattggtaacaaaataaacaagctctctacattgatggcccttgataagttaccatgagacaaaaaggtgagtagaagtaaagtacacgagtgaatcaacaaaaaattagtatttgagatcacgaatcatcgtcagtagatcaggagcattcttagtatttcaaacatttttcttctataaaatatgatccgtaaaacgcaaccttgattgttggtattatttgctcagctccaaaataaaacacagttactcccagtgaccaggagaccaatctacacttatcctgggcttctaatctatctatcggtttctggtcacgaaatccaaatcaacgggaagaaaaatctaccattagatcttatgccttcatttttctcttcatctttctcttggctttggtcttgccgctgctgcttctcttgctcttgtaatctggaggcttgtactccggcacatcacgaagtcccagttttgacaaaacaaggcagtatgaatcccagtcggttctgcgcaagtatttgaggtatttcttcctcctttgcaccatctcttgaagtccctttctggaatgcttgtcctgaattacacgtcaagttcacatattactttcacttcaccagaagaaaatcaggcgagcccggcaattctatggcaaggtaaaccgtgatgctgtatgaaaatggtcatgtaagatcaccttcttatgcagagtagttgacaaatgcttgatttttgtggtaagttgtgccactgcaaaacatagacgggcatcaattgcagatatacaagcctaaaatatgtacttacaagccagaaaggtggaagggaagaggaaattttacataaagtcataaacatgcatggagataaaagctcatctaaagccttgctgacagagtttccctttttctgaaaccaattacaacaaaggaagtttttctgggtaaaaaagagaaggaatgtgaaatcttaaagagatgcaattgtcctagtgtgttgctttggtcgtatgcctgaacttttcaagccaatgtaaacacctcaaagtcacatgcaattaccgagcaaatctatctattatggaagcatcataaaaaatcatgaacctgaactttctttgaatcaagaaaaactatattacagattgggagctaaaaagaagcttggaaaagagaacttcaaatttagaggacaagattagctagtttggatataaagccaaatcttaactaaactcgtaataactaaaccactgggttcagggttttaaaacgtgacgtgcatattacatagcttattcacacactcaacactcaacataacatacccaagcgtggaacatgacttagatggtgactaaataaatggcagcagaagtttgcaacaaaaagttcaaaaattgtcaaacagaaatggcctaaatatcagtattaacaaataactcttattgcacgacatcttcaatacacaaaattgagccttaaaactacccctactgtaaaagtatacaccacgttgtcatttctcatggggaacaaatacacgtcaaaagaaacttactcataaacttgcagcagtcaacacatatgagtgcaatacatgtcaaaagaaacttactcataaatttgcaccagttaacacatatcagtgctttaccgtgtaccttttaagtaatgaattttaatagatagcaagtgagtgtttgatatgagaacaaattctcacgtaagaccataaagacctgaacatgatcacatataaagctcctcataactaagatgtcagtttctcacaactctatggttacagaagaaacaaaaaataccttgaacccgtgcagaaccacagtcattctcagacattttgaactcatcccttacactctggagctcctgcttcatcttctccgctgatgacatatgatcgggatggaagtactgcaaagatccaactgacaattctcaacaccacatcatccaatctaaacaacaaaatgcatcaaatgcacaacacttccagctcaccctctccaccaactcctgttgcggtttccccagcaagtacgccggtgtggcctgagagccaaaggccatcaaagccgacatactctgtgctgcagccactagcaaaccaaatgtaaccacagcatcatcagtaacaaaaaggttatccatcagtttcatcaggcattcaccaatggcgactaaacaagaacagcaaaatcacgatgtatcattacagttgttcgtcttcagatctttggtctgcagcgtcacgatcgcatcccgcagcacgtcggtgcccagcccggactgcagagccctttcctccctgtccatctctcgcagcttcttgagtcgccggctcagctcctccacggagaaccactccttcccatccttacccaccggtggccgcagttcactgagcttcttgccgagctcattgtcgctgtacaaccggatgaactgctgctcctccactttgccgtcacggcctctcctcgcctcccccctcgtttccctcccgaacaccgactccggcagcggcttcccgtcgtgtctctgccgcgaggagaggatggagctccagtccggcgaactggcggtggcgccggggaggggcaccgccgacgccgtggggctcgttcccaggttcttgttcaagctctcgcggagcgcgctgaagggaaaggcgtccgctccggtggcgcggctggtcggaggggcgggcctggcgcggaagacgtcggcgaaggaggggctggggttcgcggcggcggcggaggtcgcgccggatgagggatgggggttgcggaagaggtggaggctgcggcggacatcgtcgggcggcggtgattcggggatgcggcgcggcggggaggagggaggggtggcgttgaggtggccgcggatttcggcgaagtgggaggagagcttggtggtgcgctgatcggcggatgcggggtcggacgtcggaggcgggaacataccctcgccggaggaagaggagaaggcgcgcgggaggagggttttgtggccgcggtggatgcggcggcggaggaggaggagcgccattgccggcggcgaggtcgagtgaactgagaaggtgacggaaaactcgcgggcttcgtgtggttggtttcgtagggcattcggcgagttgggcctcaacgggctagcccaaacggcgcaggcttcggcttaattcggcccaaattagcgaacagcgtagaattttgacaataagtctattttgtccttttgactacaaaaccggatataacatctattccatctaaaccagtgcaagtcgattcttttgcggataagtctatttttgtctgataacgtctctcccatcttcgaaaaccagtgcaaattgactattttgggggtttaggaagtggtttatgttgatgtgcaccggcttttgaagcggagacattatacccggttttgcggttgaggagggtgattcactcaaaagcatgacagggagacaaattagacttactccaattttctctgatttcggcccaattttgcgtatggcgtgggatttggggctgaattcggcccgtttttatctccttcgcaaaaatggagttgaatttgggccgaattcgtcgtcttcttgtcggcctacgagtggtggaggcgagctgcagtgtgtccgaagcttttcttctctaccagcggcagcggcggctggtagggaggaggagatcgccaccagatcgccatggagacgctggcgagcgccatgcggcgggagaaccgccgcttcaagcccccctcctcctcctccgcctccgcctccgccgccctctcctcggggagggtccccctcgtcatggccttcctctcctgcctcgcgtggctctacgtcgccggccggtacgtacgcgcgcccgcgcgctcagatccggggggaatttccgtggagttttctgattgtttcgttgattggattttttttttgcaggctgtggcaggacgcgcagacgcggatgatcctgtctggtctcctcgagaagagctccggcaatgtgcggatctctccccctctccacccacttctcgttttttttttccgcttgatttgtcagttcgtgtgatggtatcgcctaaattgcagcttccgaaggtgctgtcggtggaggacaagctgaggaatctaggatgcatgtaattcccccctctctctctctgaagaggaattcagaattcagaattttagttgctgatttgaaatgggttgtttggtggcagtggaattgggaggaagattgcggaggcagaaatggaccttacaaaggcgaagagcgaggggtatctgtgggggaatggaactgctactggtagttctgacaagaagaagctccttgctgttattggagtttacactggttttggttcccggctcaagaggaacaccttccgtggctcatggatgccgagaggttcgctgttcttgctcttttagtttccagtttacggcgataaaatgtgtgcgccctgataacatttggttggaatgcagcttcatttttttttctaatagctattgctgatgcaaactatgttacttataaggtttcaactacaggagtataattgttcttttacctcactgtaaatttcaggtgatgctctgaagaagcttgaggagaagggtgtggtcattcgttttgtcattggtcggaggttttattctggatccatatctcttatatgtagcatctctagcaccttagacaatcattcgccccatatcattctcaggcttttcttcatgtttagttttcctactgaaattgttctgtttggtccttcagtgcaaatcgaggtgatagcttggaccgcaacatcgatgatgaaaatcgtcggacgaaagatttcttgattcttgtaaggatctaataacatttaatatcatttttccaatttgtccttcacaaaaaattagtactgtagtacatgcagaagacttttggctttgcttggttgttttctggcatggaagactatcttacattctcgtccgtattgggccttcaattcagtacctattttaagttatctcactgtcctgattcatctaaatgtcggtttttaatttgacatttggatatacagcttagatcaaaaccatttttgtgacattgtcaaatcttgaacaaactgcttgcactttatggagaacagaatgtgacataaatagtcaataaattgtcacacaggaaagtcatgaggaagctgcagaggagttaccaagcaaagttaagtttttcttcagtgcagcaattgaagcttgggacgcagagttctatgtgaaagtcgatgacaacattaaccttgacctgggtaattccttttctgttgaaacattacacctatggcttatttcggcttaatgttttgactcattacaatctatatattagctggattaattgagatgcttgaagcccgtcgaggtagccaaggactgtacatgggttgcatgaaatcaggaggtgttgtaagtgaagagtatgtgctttcattcccatcatcagtaggtttttatttatttagattttagacaacatgcatggcatatgttaacaccaactagaccatccatttcataagaggtaccatttgttttccttgcggatccatttagcagtgatgcttccatgctgacatccttccatctttgaaagctatgtaaatgtagtggaatgcattgagcatctgaaacgtttggtccaatcaaggaatcatagcttttgaattgcttagtcccattatttaccttaggtgctaccattgcttgatatcgagaaaacatgtaccttgcacactcttaattgcattgcatcatttatatattcagggataatatttcattcagtacattggattgctttgccctttgttaacccgtcattgaagccacttgataccaacttcaatttcaggggtcaacaatggtatgaacctgaatggtggaagtttggagattcaaaaacgtgagtaaactaacatattcaaggtccttgccatttgtctattatcctaatattcatcttagtgttgggtgattagcaataattctgtgtctagtggtgttcttacatgttttatgggcattattaatgaagcaccgatctcatgttctttcttagtatttggatttctgagtctaatgctacattgaggctacaaacatttcaacctcctgatagtgagtttcagccttcaatgcaaacctaagaatgattttttttttcatattaccaactactcgtataaccttgcatggcttgcagcggatgatgtcattataactactttttcatgctaatagcggtttctccttgattcacaaatggtttacgagtcttaaagatctggtgaagcccatctgttttatatttagacttaatttgcattgtgcttgtaatttctatttgtttggtgaaggaatacgcctagtttaaatagatgtgtttcctgggtgatactagtatctatgagaagtgttctctgctgtttcttcagcgttttcattctctggctccttcaactttctagtatatcactttttttccgttcactgtgatttttaattctcaggtattttcgccatgcttccggtgctttgtttatcctctctaacaatttggcacgctacattaacataaacaggtaagtggtgcgcatccacctgttttatctttgagtcatgctaagctaaaccagttttggtgaccaaccaggcccctctgagcaattgcagtgcatcagttcaattaatacagaataaatgttgcaattaggatgatgttttcttggtggtcaaacgacaaattagttttttgttacatgagtcttctcctgtatatgtgatttacagaaaacaggctatattcgctggatttcatataagttactaatactgtctttagcatttatgaattaataaccggccactgaaatgctgttctgactaactgatatataaatgttagccatctgccatctatttgatggtcttgatgatgcaggaacactgtccagatgttctttgtcaataatcaataatacaacagtaaccaattgatatctctagtcaatataggagtatatgcagtcaaaatttgaccgaaatttgagcaatttgtttctcttcgatatgcagtgcatcgctacagagctatgcccatgatgacatatcagtaggttcatggatgatggggctgaatactacttatgttgatgacgaccgtttgtgctgcggcagttctagacaaggtaaaagctcgcctcctgaatccattatcctaccctggacaattcatggcggtacttctatgctaatgctgtaattctgctgccgtatgcagagaaagtatgttcccacgcatgagttagcagcacgcatggttatgacggtggtgtcctgatgaagaggtgacgctgtatattttgccattttgtatacaccaagcggcttctggaatgaaaaatagatacatcatttcaaacgctgctttatccgatcagtatacttaaatacaagtgtaggggaactagttgacaaaaactataaaagcgctgagcttatttttggtggagcttcctgtttgacatatttgtcgaaagtcgaaaccaaattcagggtgatagatgaacttctgttcgaagtttaggggatatactggccttctcttctccaactttttttctcattaacatcttcaaatccagccctgagttgaggcctccatttcaccatttgtcacttcaacccataagtttaatgcatgtcatcttagattcttgggcagtggcaaacaaatggagggcaggctgcgtctgctgcagccaaagtagatgctttactgtccctgaaatacaatcccagcatgtgcaacctttccattgaaatgatttaagacgatcactatcgatacagatcatggcagatcgcccagcaaattttttagactagaaaatgacggaaacaatttgcagggtaaacaagtcgcctgaaatgggataataaaactttttagaatatccttccggttaaaaatatgacagttgaagacctccgggtctttctcaatgcaacatcgttccatcgtcaaaaactatccattgaagtggagtctcacagtaagcttgtccaacagatccattcctaacctacatgtgtttaacaagttgatcatcagtcctacttaattaccaggccacactcaacctttttaacaagctaatctcatcgtaccatattaaagaaagaaatcaacgtgagcggtgcaggccataaacaaattgacaaatccgcgagatccaatgaagcacatttacatatggattccaaatctaataaatccaaatggattccaccttgttgaaactataaaaatggagcttatttgtcggtgaagctcatggttaatttgatgtatttgttaaaactaaagttcggggttgtagatgaactcccgaagttcaagtatatccccgaatccatcctgatttgaagcccaaagtagactgacgattcagtcactacaatgcgatcctgggcacatgtttcctttgctccattgaaattattcaagacgatcacgatcagaatagatcatggcacggatcacctagcaattattctacactagaaaatagctgaaacaatctgcatgatcaccaagttgacgggtgatgaactgatgataagcttttttcctaacaaaatatcatatggttccacactcgattttataaaagatacagtgtggtgttgtccaatgtctacaccgcatgttaacgattgcgtcaaataaaaaaaatctatactccctccagaatataagcatttctagcaatgaatatggatatataactatctagattcatagctagaagtttatattttgtaacggaggtagtttatattttgtgacggaggtagtataacggagttaaatccagactatttaaatacttaatgagtagaggctactgacagtgaagcaaacacacacacagtcacagaccatggtgcacccagctcagggccagatggtgcaagacctcgccgccggcggcgagctcggggcgccgccgagcaggtacgtgctgcgggagaaggaccgcccggtggcggcggccggcgccgtgcaggcggcgcagcgggagctcgccgccatccccaccatagacgtgagccgactggccgccgagagcggtgacgacgtcgtcgacgacggcggcgaggcggccaagctccggtcggcgctccagtcgtgggggctcttcgcggtgaccggccacggcatgccggagccgttcctcgacgagatcctcgccgcgacgcgggagttcttccacctcccgccggaggagaaggagaggtacagcaacgtggtcgccgccgccgacgccgacggcgtcggcgccggcggcgagaggttccagcccgagggctacggcatcgaccgcgtggacaccgacgagcagatcctcgactggtgcgaccggctctacctccaggtgcagccggaggaggagcggcggctggagttctggccggagcacccggcggcgctccggggactcctcgaggagtacacgcggcggagcgagcaggtgttccggcgggtgctcgccgccacggcgaggtcgctggggttcggggaggagttcttcggcgacaaggtcggcgagaaggtgacgacgtacgcgcggttcacctactacccgccatgcccgcggccggagctcgtgtacggcctcaagccccacacggacaactccgtcctcaccgtcctcctcctcgacaagcacgtcggcggcctccagctgctcaaggacggccgctggctcgacattccggtgctcaccaacgagctcctcgtcgtcgccggcgacgagattgaggtaatagttataaaaagttggtaagatagattatgataataataatacataagagtgatacttcggtgctttctattggtggtattataccatcagtattataaaggataattagtaatttactattataatgattaaaagttactttgttatttatgttttccttgtctaaatagatatatgatcattcattgattgtgttggcatcgcttatatttcatcgaaaaagaaaaaaaaagagaagaaaaaaaaggtttagtcattgctaaataacgtttatgccctcgcatctattttttctaatactcctccacgtttctaccaccgctaactaggctggtagtataaatagatctgagctcttcaatcaaatgaaattaacactttaaattgatttctactaccagtagatagccctacagtgaggctccatgcgtaaacatggaagtttaaattcgatctacatttactagctgattttattgtttctcttttctagttctagattaaatttagtctttctataaatttatgtcatcccatttgatattactattttcttaattttttatagctatttgagtaaaaaaatagatctgcttgaataaaaatttaagttgtttgcattgcttggtgttgcagatcatgagcaagtgttcatggcgccggtgcacagggtggtgacgagcgagagggagaggatgtcggtggtgatgttctaccagccggagccgcacaaggagctggcgccgtcggaggagctcgtcggcgaggagcggccggcgatgtactagaagctcaaggccaaggccttcggcgacggcttctgggacgcattcgccgccggcgagcgcaccatcgacttcctcaaggtcaaggtcgagcaccagcagcagcagccggaggcggcggcggcggcggccgtctcgaccagcgcgtgatgtgatggaggaatctagctaattaatcgcgtggcctgcatgcttaaactaaaaaaatatgtggaataatagatagaatgatagatgttcacgttggtgtttactaggttggttgagacgtattacgtgagtctaataatctactactccctccgttttacaatgtaagtcatctagcatttctcatattcatattgatgctaataaatctaaacatatatacttatttagattcattagcatcaatataaatgtggaaaatgttagaatgacttacattgtgaaacggatgaattatcaataatgtgttgtatcgactgtgtcatgaactgtgttgatgatgaaaaataaagttcactttggtgtgaagaaatagatcgatcttttactctccacatgaaggggaaatcaatttacaaccaaagtagtactccctccgttttaaaatgtttgacaccgttaactttttagcacatgtttgaccattcgtcttattaaaaaaattatgaaatatgtaaaactatgtatgtacgtgaaagtaaatttaacaatgaatcaaatgatatgaaaaaaaataaataattacttaaattttttgaataagacgaatggtcaaacatgtactaaaaagtcagcggtgtcaaatattttgaaatggagggagtatatatatatatttttgctttgcatatatatcatcaaaatgtttctaaacatatgttataatatgcaatatttgaaaacctgaagtcataaatttggttatagtactatttgtaactgaatttgtcctcctgttttttctcgttgtgtgtagatcaactgtatcaatgttgtactgtaatatcttttcggattttttttataattaattgagtggtgtttgaggagccaaaagcaaatatcgcacgcgcacttgagtcctcaaaaataatttaaaaaattcgagctccaatcatgcatgccgtttgggctaaagctaaattccgcatttgatgtgaaaaccatatcttttgttcttatatatgattattaatattttctccgtattttaatatatgacgtcatttatttttaccaacgtttgactattcgtcttatttaaaatatatattattattattatttttattatgacttgagttatcatcaaatgtttttaagtattatataaatagttttatatttacacataattttaaaataagacgaatgtttaaatgttggttaaaaagtcaacaacatcatacattaaaatacaaaatacggaaggagtttaaaatataagagaatcgtgccgagccagcctagcttgcagatgagcaggggctccaatactgacgcgtcgccggcgtacgtcctcgtccggcgagccgccgtgtccgtccatcagtgcgccgccgccgccactctttgttgtgatggatcacaagctatgcatcgctatcgatctctctcgatctcccttatatgcatcatagccgggatatagatattaagatatatcgttgtggattggatgcgtacaaacgcctcattattgatgctgcaacttctcctgtttgtccctttgcagagcagagaaatcaatcaatcaaaattcaaaatatcaaatggtgatgaaaatcttactcgagatggaaaatttcaggtttggttggatcaaagctcaccggagccggtgaagaacgggagagatcgaactgaaaagtgaaaaaggcctagttttgatcatgggccacacgttccaaggccgccactgatggtccggcccggcccatctaagcccaccacttattgggctctcgcgggctcgccgcggcggcagttgggccgcgcgatggcaatgaggagcttcgtcggagatggaggtcgggtcggggggcttcggcggcggcggcaggtggtggccgtgtgggactatggaggcggcggcggcggcggcggcgagcaaccgattccatttcgcggcaatggcggcggtgaccggaggaggaggcgcgacgaggctacttcctgcgggttgcctcgatcccatcttcttacgcagatagggaatcggggcggataggtttgtgccaaagcagcttcggttaaattttttgttctttgaaaagtttgggggaaatttatttgggattagtactgtgcgaatgtgcaatgttttcaggattgattttgtgcaatccaaaaaacaggaagaaaaatcccgtaggaacaagaatcgttcgtttttttttaaaaaaaaaacagcacacggtattagggttccttgcatagaatttgatatgaagcatgccactttcaaagtagtagaagatgaacaagattgccatgaactataccactttcaaataaaaaagaaacaatattgtcatgaagtacaccactttcaaattaaaaagaaacaagatgtcatagaatttgatgtgaaatacgccacttccaaataaaaaagaagcgatattgccaggttcagttaatatgctccttcaagatgttaagttattctggaaaggacgttatcacaagcttaaatttaagggcctgtgctgtgcatcatcggttgctcaacctctcaagttgaagttggcatgttgtatgttgtgtaacacatggagtggttttctgattcacatggtatattgaatctttattcttctaggtgcttatatttttcattgtccggcaaaagtatgccgcccaaattaagaccaaggagaggttacaagtaataaataaacaaacaaggttgctgtgccaccagaaattagcccaactacctaaggatagaacaaacagcctgccaactccaggctagtacacagctgcgctctaggtgcttatattgaagttagggaatcagatgttgagcttgaatttaaatcttaattgtcagccactattgggcagttcctaactctgctccataaatgtcaaattgccttttttttttggttaattcagcaatttggttgcaacttacagcatttttttataccaggtataaattgttttcattacatgaccacttgtgcaacaatggcagtatttttactcttttttcgtacatggtctcagactcatatatagtaacttctccgtatcaactcaacagcattgaacaacctaagtcctgagacagtacctgagctacatccgtatggaagggagcatggaggatgtgagatcaacactacttgtgcaggagcttgccggcatgagaagcaaatctgtgccaagacagtacattgtgcaacaagaagaccaaccgaccattgcagccactgcatcattccccattgttgaccttggtcgcctgtcccaaccagatggtgatgccaatgaggcggtgaaactccggcaggcgatggagtcttggggccttttcatggtaataagtagtcagtgtacctttgatagatttttgttgaactgccttggcttctttaaataacatgatgtcgtggcttatattctatatctgcaattgtgttctcaggtaactaaccatggcatagaagatgctctgatggataacgtgatgaatgtgtcaagagagttttttcaacagcatcttggagagaagcaaaaatacaccaacttgattgacggcaagcatttccagctagaagggtatggaaatgaccaggtgaaatctgatacccaaatcctggattggttggatcgattgtatctgaaagtagatccagcagacgagagaaatctttccgtttggcccaagcatcctgaatctttcaggtaatatcacaaacacagtgtcagagatgttttacgatttgtttacggcgatggtaaacaacttataaggcctagtttatggttgcaacgtgtcacaaaaatttagtactccctctgtcccaaaatttatagttcaaattatgtcaataaaacactttcgccagtaccaatccattatgcgaattgactcttatgtagggatgttctggatgagtttctcataaaatgtgatggagttaaaaacagtctccttccatcaatggcaaagctcttgaaactcaacgaggattacttgtcagacaattctctgacaggcctaccactattgctcgattcaactactaccctcagtgtccaaggcctgatcttgtctatggcatgaagcctcattctgatgcaaccattcttacaattcttatggttgataacgacgttggtgggctacaagttcttaaagatggtgtctggtatgatgtcccaactaaacctcacaccttgctgatcaacttaggagatcacatggaggtaaatatatctgtccacgaatgctgtttttcttgtcaccattgcatcatgctatcttagctcttgctaaaactcactgtctcactgtgagcttcccccttttttgtgtgtgggtgaacttactgtgagcggaagaggggagttaaaaagcaaaaaagccccccgcgtcgctttcgcgtcgggtggctcgggggcgaaaaaccctagccgcccgcgccttctctccctccctccccccacctcgctgtcgctggagcccgccggcggcgaagccggcagcgggcagggaaggcggtagcgaggccttcttctcttcgtagcgtctccctcctcggcgcgaaggacgaagacgacgaagctctccaccggcgtggtccgtggcagctacggcggcgaggtggggaggagacagcggattcggagcccccatggccggatccggccctcccttgcctggatctgcgcggcggcggcgcgaggaggcctggggcggcgcgacggcatgcggtcgtgatggcggccagcggcaaggcggcgaggtggcggccggctacggctaggccggcccagcacgggcgcggaggcggtggacggctgaggctcggcgtggaggcgcgcggaggcggctcgtcagcggcgggcgcgcgcggcggatggctgcggctcgtcgtggccggcccggtcgcggaggcggcgggcagcgcagcctgcccggagcggcagcggcgcccccgctcactcgctcggcctggccgctcggcgccagcccatggcgcggtgggtcgtccaggcctcggtggcggctcagcttggtggccgggcagccgggatgccgccgcggtggccaggtgaggcgcggcggccggacttcgggggcgccggcgggtggtgccggtccggagcagcagcaccaccggcggccagatggcagtgcaaagggagctggcggcggtgggtcgtcttcctcgttgccggtcggcaccctcggccttcatggagctcctccctttctttgcggggagtttatagtttggattgaggcggtagcttgtcagtgggggaagctcaggctgccgaagcaatgccacctagtcccgggttctccttcggccaaatctggcgaggcggccggcgggtggtggaacggaggagtcctgggccagctctcaggggtggtggttcgttgaagtcggccgatggaggggcgtcggtgcggtgtggtggatgccacgtgctgccatttgtctgtgtggtggttctgagttggtggacggcgatctgcagtcaaggttgtagggtcccaagcgaaagcctagtccggtggttcaccgggccgacagcggctacgtcttcgggcgtcgtaatttccttggagcgttgtcgagggttaccctctccctttcttggcgagcttctctgggtgaaaaccacatctttttagatgggcgatggcggcatcctggatgtcgtgaccaccatggtggcatcgttttcggagcctcgtctctgtggtgttgccgtaggcctagcggcgttcggccacatttagcgggggtcgtttggtgctaggtttcaccctcagcggtttgtgcttgggtggtagtgtgtggtgtgtggcaatgcaccttggtgcattttgatgttttttctcttgtaacttttattccttcttaatatactcggttggcctccttcggccttcccggcaaaaaaaaaaacttactgtgagcttgtctctaccagtatgttcaagttgtgccatgatgcatctccaagttcttgattcactgaactacacattcttttttgtacagataatgagcaatgggatttttaagagctcggtgcatagggttatgacaaatcctgaaaaggagagaatatcagtggtgttgttttattttatgaatcttgagaaagagattgagccagcacttgagctgatcgatgaaaggcacccggcaagatacaagagggtgaagattatggactaccttgcagggctctttgaacatttcttgcaagggacaagagtgattgacacagtgaagatctgagtcactatgccagttaaaataaatagtgattgtgatatgtactctgtaaagtttatcagaaaaaaagaactattgtagagtatgagtcacatggtcgcatactcatgtaattatgccatccagatctgtagcgtttatcagaaaagaaaaatattattgtgaggtttcattttgtgtttgctgaggatgaatgatgagttttgtacttgtactactccaaacagtttgatgagctctgcatgctaggttaaaattctaaccttgtggaagataactcattgaagtacagttggtcagtgttatgggttgtgactaatcaactaactttttttctttgcttgtttctagatccttggaaagaaactgagccagacacaagactgctagtacttgatatttgagaagcatccaccactttgcaaggcagcaagaaagtgaaggcaagaatcatttagctgagccttgtgaattctagtacttcagttggaccatctaaaaggcaagcataatcatttgacagcttcagagtttttcaatttttcccttgatctacacatcttgatcttttttttttcttttagaaaataatacatctttatcttcttttattatgtttgatcttcttttgttcgataggaattgtgttctgtctattgatatgagtgactaattgactttgtgttgatttcgagcagaatagcagctctctccaggttactactcctgttactaaccattgatagaaaccgagagatagttgatctggtgcagatcttgtgtcaccatattacaccagttgaaatatctagaaggagataagaaaaggtaagcaatggaacttgttttcccccattcaggcattcagaactcaggagtcaggactagctcacttccacaatgtcaaactacttgaaataccagtccctttcttctgcccaattccacaatgttaaacagtttgaataccttcggtttaatttcaaaaaatgaatttgaaggttccctttcttgtgctcgattccacgatgtcaaacagtttgaatacctatccctttattcagctcaatctacatctacatcttatctacaacgtgtcttttatttccaccatgtacattgtgcatcctttcttctactgttgaatagtagctgagaagcagattccattcacgtgcctaatttgtcaatccattttcatccaagtatatccaattcaacatatttgcaggctataaatgagttgaaagatctcctttttcttttcaggcaagaagaaaattaagcaaagaaagatccaagaacaagaacactaatggctgacgagtcatggaggacgccggcgatagtgcaagagctggcggcggccggcgtcgaggagccaccgagtcggtacgtgcttggggagaaagaccgttctgacgagctggtcgccgccgagctgccggagcccatccccgtcgttgatctcagccggctagccggcgccgacgaggctgccaagctcagggcggctctgcagaattggggcttcttcctggtcagctactaacgcagtgatcctactttgcttaataaaaaacttgctactttgtatcaatttctccaattttcctggctgtgtgtgatccagcttaccaaccatggagtagaaacctctctgatggatgatgtgttgaacttggcaagagagttcttcaaccaaccgatcgaacggaagcgaaaattcagcaacttgatcgacggcaagaacttccaggtggaagggtatggaactgaccgggtggtaacccaagatcagatcctggactggtctgatcggctgtttctcagagttgaacccaaggaggagcgaaatcttgccttctggcctgaccatcctgaatctttcaggtcacctactcaccttacagtgatcgatgttttactttccagtttacacacgtctgaatttcttcctactctttttttttggtgcaaaagatggtgtttttattgttcatgtattactaacaaagtaacaagaattgttgtctgaattcagaaagaataacttgacgatgtatcgagaaatggttttactgagctattagagagccttttcttctgcagggatgttctgaacgagtacgcatcaagaaccaaaagaataagagacgatatcgttcaggctatgtccaagcttcttgggcttgatgaggattacttcttcgaccgactcaacaaagctcctgcacttgcaagattcaactactaccctccctgtccaaggcctgaccttgtgttcggcgtcaggcctcactccgacggctccctctttacgattcttctcgtcgacgaagatgtcggtggcctgcaaattcagagggatggcaagtggtacaatgttcaggtcactcccaacacattgctgatcaacttaggtgacaccatggaggtaattggcatctagcatccaaaacactttctctctgaatctgcagagacatctgtaatatgatgataaacccaggtttctgaatcctgatgcatatttggatgcaaaatttatgtgcaggtattgtgcaatggcatcttcaggagcccagtgcacagggtggtgacaaacgccgagagggagaggatctcactggccatgttttacagtgtgaatgatgagaaagatattgggccggcggctggtttgctggatgagaatcggcctgcaagatacaggaaagtgagcgtcggagagttcagggctgggatcattggaaaattctctcgacgagagagatacatcgactccctgaagatctgatttgtactagtagcatgattgttgcaagctcagcagctttcagtagcaagtattcctgggaaaataaatatgtttttttccttgagggaattgctaaaagcatgtcgcaagttttttttaacaaaaaactttcaaatgtaactataatattattaatggtattgtaattagacattattaatattatagtgttattatattgtaattattgtataattgtaatgtaattacactattaactacattggatatgttttttttcctacttttatcgatatagccatattagtaccagtactctcacaagaaaattttaatgcttgctttaagaaagataattagaatgtaaataatgagggtagcaatgtattttgccgtgattcctagtttagctttgagtttttgttgtaatgtttgatcattcgtcttattcaaaaaaattatggaattattatttattttgtttgtgacttgctttattatcaaaagtactttaatgacttatcatgttttacatttgcactaatttttcaaataagacgaatagtcaaacgttgcaaaaaaaaaagttaaagcgactactaatttaggacggaggtagtaagtaaaataaaattgggaggggggagtaattgttgcatgtctctgcaaaatctccccgctgataatgggtgtgttcgaaagagatttttataatgggtgtgttcgaaagagattttttggcagcagctacggctgcacgcagcacgctacagcgattttcaactgctgcagccacagcagctgcagcaaaactggctgccgaacaaggccaatgggctcggcagacaaacatttgacagtgatgtaaagctcaacgacccataccatattactgccggagtgtctttttcttatgcttatgcttatgcttattagccaaattttaaatttttcaatcttaaattggagttgattttgaggttttttattgaagtttatttttcaacctttgcttttattttagattgttaaaaatacatatataaaagttttattcacaaattactattcgtttgcaaatataccgtttcgcttattcgatgggtccgttcctgtgtctatcatgacaaggaccgtgtgtttgatcctctctgactaatgagtggcactaccatgtcttcccacatccctgacctaccaacttgtttacataaaatctttcatcttgactaaaccctgaccaatttcactctgtcatcatccatggccacaaaacaatgccgaaataagataaaaaccggctggctaggaatcacctgactgaacagaagcactgcgcgttcagacaaccatggctgacggccaccactggaacattgtcaagataccgccgattgtgcaggagctcgccgccggcgtccatgagccgccgagccagtacatggtcggcgagaaagaccgccctgccatcgccggctccgacatgcctgagcccatccccgtcgtcgacctcagccggctgtctgcctccaatggtgaagacagcgccggcgagcttgccaagctacgctccgccttagaggactggggcctcttcctggtaaataaaagtaccactgcattcgtttcatattataagttattttgactttagttaaagtcaaactgttccaaatttgattaaatttatagacaattttggtaatattataacatcaaattattttcattaaatctataattgaatatatttttataatatagttatcttgtgttgaatatattactatttttttctacaaatttagtttaatttggagtacgtttttctttaaccaaagtcaaaatgacttataatctgaaacggattgagtattactttttttttttgggtacctatggtactataaggtgcagggttatttggtactataatggaggggagcattctcagtgagatgatcaatgtgacaagaggattctacaagctcccactggaagagaagcagaagtactccaacctggtgaacggcaaggatttcaggatcgaagggtacggcaacgacatggtcgtgtcagagaaacagatcctgaactggtgcgaccggttctaccacatcgttgagcctgagtcccggatagcccatagcctctggccaacacagcctccttctttcaggcactgaatcttcctaaccttgattaatccattgttcactctgcaatctacacgcatgattaagaacttaaaatctgtcaagttctgccagtacatttgtctgaaatttcctgtttcttttatacagagatgttctgcatgagtacactatgaggtgcagggagatcaccagccttgtgctcgccagattggccaggctgctcggcctgcgagagggctacttcgtcgacatgttcgacgaggacgccacgacgtacgcgaggttcaactactaccctcgctgcctgaggccggaggatgtgttgggcctgaagccacactccgacggctcggtgatcaccgtcgtctccgtcgacgacaccgtcagtgggcttcaggtgctgaggcaaggcgtctggtacgatgtgcccgtcgtccccaatgctctgctcatcaacatgggggatggaatggaggtatatatacatttactccatccgtttcacaatgtaaaactttctagcattgcgcacatatatctagacatatgtatgtatttagattcattaacatctatatgtatgtgggcaatgctagaaagtcttacattgtgaaacggagggagtacttgttagtggttgtttatccaaggatactgcacccatgtaacccaaaccaaaatattacggtgttccaaaagtattctaccatgattcctaaagtatatcatgattccttttatcttctcctgaagaaatctttggagggatcagagatttgggagatctgaacaacaatctgaattgcacgtaaagtagacctgtaaagcttcaattttgagtacatcatcatttacacgtctgattatatttgatcttttagggaattagtccgactaagtagcagaggtcggagatgtaaatcatttccattatctaaaaagatatgactaacagacacctattctgggatgcagataatgagcaatgggttgttaaagagcccggtgcatagggtggtgacgaacgccgagagggagcgagtgtcggtggtgatgttctacgcgctggatccggagaaggagctggagccggcgccggagctggtggacgatgagaagaggccgaggcagtatgccaagatgaagatcaaggactacttaagtggcttctacgagacttttgcaagagggacacgagtcatcgacactgtcaagatgtcagaatgagattgttgtcgtaacggtgttggatcggtggaatatagctttctaataactagatgaaaccccgagcttcgttgcgggcacatttgagaacatatgtaaatatgcatattagtatgaacaattagattgtattgtttgaacctaaaaacaaaatacataccgagcaagttaagctgcttctcgctatgtcaggacagctatatagcaatcctttgtatcattcctaattgttcaaataaattaaagtgatatgacatataagtattggctgcaagcatgatgaatcttttcttaagaaactaagacaacagtaaatgtataggatagtgattctttcttcaagtttagagaaaccaattgacaaaactttcatagtgctcctgcttggttcaaattaatcataatgtatactcaaatagaatccggtcaaaataactgttaaattcaggcttaccaaataaaatcgaacgtatgatgaaaagattcatgcaaaggggaagagacttggttatagtggggattgtaaaggggcttattaaaaggtttggaagagaatcgcaagaggcacatgaatcgtattaaccatcgcacctcatgtcccaattgatttggcggtttctgctgtaaattaatgcatgtgattaagggaggggaaggggaaggagcaaggtgattaccatgcatgctgggcaaaaagatgagggatccaatggtgtaaatctgatttacatattgatcgaacagctaatataatgttgatgatgtggcgaattgaggaggcagctttgggttttaactttatagaaagaaggggtaatggaacttggtatgtttaaacatgttttgatttggaatatagttttttaaggatctgtttggcacagctccaattccagctccacctctcttagagttggagcccaaccaaacggtttcaacaccaccaaaaaagatatggagctggctagagcgctctcacaaaatgaacttgagaggtataaatgagtttagagttaaatttaggtgttatagctttaccaaatgggctactctttctttcggagggaagcggaagcctagttttcgcttaaaaaatgtgtaaaattctaggcccaaaacctattaggccgaaaagaatcagcttgaatgggccaaaacattagttgatttttttaatcttaaaacattaactactccctccgttttttaagaggcaatgttgttgacttttggatacatgtttgacaattcgtcttatttaaaaaaaatacgtaattataatttatttttttagttgttttaccactcaaaatactttaagcatgatttatatcttatacatttacataaattttttaaataagacgaatggttaaacatgtataagttaatggtgtcacttattaaaaaaacagaaggagtaattaataagtgtgtgcgtgactaggagtcaaaaacgggatcttgaggtggactccacacacaccactaggagtcaagcgtagctccaaaaaattttgcaaacggtttgccttttcttttgcatgtctttctgagaaattttttcagttgaatttatcccttttttcccttaattcgtgtatcaaattctgatgtgaaattttacggagtaatgactagcgaatgtcttccgtggtactagatattttctataatgttttataactatattttgatgtcattttattggttgaaacgaaaattcagagtgttacgatatgaataaaaaccaaaaaaaaaagccattgcatccaaaatatgttgacctttaaaggattcgtcaaagaatatattttctcatcatgtgcatttgtcttttactatattttctgttagtgcaggtggttggtagctggtctattcatagatgatcatgtacacaatgacgaaacaatcccatctatacatatatatacacttcaaaatctagctgtttcaatctatccatcttgcctagtgcaagcgtgcaaagccaaaattcaagaaatcacctcgctccatcaagtgagcaagcaaaaccgatcgaacaagttccaatggctgacgagccatggaggctgccaaacatagtgcaagaactggccgccggcgtgcaggagccaccgagccggtacctgcaagacctcgccggcggtgaccagctcgccggcgccgagataccggagcccatcccgaccatcgatctcggccggctgtcaggatcggacggtgccgacgaggctgccaagctgcggtcggctctgcagaactggggcctcttcctggtgagcttctcatctttcattctaaggctgtgtttagatccaaagtttggatccaaacttcagtcctttttcatcacatcaacctgtcatacatacataacttttcagtcatatcatctctaattttaaccaaaattcaaactttacgctgaactaaacacagcctaaacctatttttttgtcggagtatatgatgattttgaactagtgatgggttaaaaaaaacttgcacttgcaccttagggctcattcggtttagaatattttcataagattattgtaggaatcgaatccttagaaatttttttccctatattcatctttcgttttataggaatggattctaccatattcctaaggattgtagtcttacaagttaattccatggaatttttagcatgaggtgagatctcgagaaaaaattcctaaggaatggagtgcatgtgacatcttattcaaaatcctataaacggaataagctcttattctttttgtgacgagtaattaacagtctcttccatcttaatatactctgtcggctgtttgccgacccggcgaaaaaaagtaattaacagtctgtgtgattaggtttctaaccatggcgttgagacctcactgatcgatgctgtgatcgaggctgcgagggaattttttcggcagccagttgaagagaagaagaaactgagcaacctgattgatggcaagcgttttcagatagaagggtatggaaatgatcctgtgcaaaccaaagatcagatcctggattggtctgatcggctgcatctcaaggttgagccagagtgtgacagaaatctagccttttggcccacacatcccaaatcttttaggtaaatcatctcgagtat

SEQ ID NO: 41831 - DNA, 1095 bp, Oryza sativa
atgagaaattttatgatcctcggaaaagtacctcgagattttttttttacctagagataccaaattttatactagaaggtataatacatcccggaatttttttaaggatgataaaattacccatattacatacatgaacacctaagcaaaattctcactttgcatttttgatgaaaaaaagatgtgtgatgtggtcaaatatgttcatggttaatttgtgtttgcccattgtttttgttgcagataatgaccaatgggaccttcagggctccattgcatagggtggtgacaaatgcagagagggagagaatgtcggtggccatgttctacgctgtggatggcgagaaggagatagagccggtggctgagctgctggggctgaagcaacaatcagcacggtacaggggaatcaagggcaaggacttgttgattggacactatgaacatttctctcgtggtggtagagttgtcgattcattgaagatctaacgaagggtaaccgcaaagagtgctattagtactactgtactctctacatagataatattatactacttgtaaaaactatatgagccatcgatttagtaggctataatggtactttttcgtctatacgaattatgctattttgtaagattgacgttatttcaaaccataccattttttaaaaaagttgctaaatatatgcatccatttagtttcttaccaaactaataagaaatcctgccaaaacttgacaatattgctaaattgggtttattttagctacaatctgaacagattgttttacgtgcgtaaacttaatttggaactgggggacatatccagttgcatttagtagctcatcgagtcgcgtccgcaccgcacggtgagtcggtgacaggccgtagttcgccgaaactagcaggtccaattgctatccgttctcggcccggaggagctccttcgctgggccagcgagaaagtgccagagcatcgtaccgggcctgccaaaccggcccatccccaccacgcctgccgcgctacgcctgcaatttttacattttggtcctttttgaaaacttattttacaaatagacccctgaaaaaacttaa

SEQ ID NO: 41832 - DNA, 1345 bp, Oryza sativa
ccaccgtacgatggtgaagaatttgttgctgacccaaatttgaagattaaaacaagagggaagaggagatcgaaatggactcgggtctgggtggttctggaaggaaaccaccttcatgcgttcaacttgatgctgcgccggtacaaaatagatgctcgttgtgtcaccaggagggtcacaagaaaactaatgtcctaagcgtccaaaaaagaagaagtccaaaaaaaatataagtgttagggaggtaaatattttgttttcctactcatgttctcgcattcattttctgttaatatgtcacattggtaactaacggtgaatttattactttttcatgtaggatggccgaggagagacaaccgccgacttacccagccttggaggcgtactacgaggcccgtcatcgcggggctgcgatcgaggcggggagggtatgaatcggcattgattcacttgtgcataagtatctgtagcgtgtatttgacattatattaactaattgatttacaattgctaatgcaggtacttcaaccgctccgagtcagagctcatgcccccccagtgttcgacgataggtacatcccatacctaagggcagccgggttgctcggggtggccttggtcgtgagcagaggaatgccagtgttcaacgctcctgcgttgacagcaattgtggacagatggaggccggagacacacagcttccacctccctagtggtgagatgaccatcactctacaggatgtggctatgatcttggccctcccattacgggggcatgccgtgacgggcaggacagagactcctggatggcgtgcacaagtggagcagctgtttggcattccactgaacattgagcaggggcaaggggggaagaagaagcagaatggaatacccctgtcttggctgagtcagaacttctcacatcttgacgacgacgctgagccatggcgtgttgagtgttatgcccgtgcatacatcttgcacttgttaggaggggttctgtttcctgatgctgggggtgacattgcttcggcgatatggattcctttggtcaccaaccttggtgatctaggccgtttcagttggtgctcagcagtgttggcgtggacatgtagacagctctgtgaggcctgttgtcgtcaggcaccatcatccaacatgagtggttgtgtgctattgattcagctgtggatatggttaagactaccggttggaaggcctaagtggaggcaaagcttcattccttggccctacaatgagccagacatggagaagacagtggcctacctttttgagagtactgccactgcacatgctcaccgggatgtggcatacaagcatt

SEQ ID NO: 41833 - DNA, 20649 bp, Oryza sativa
aataatatattaaacaactattgtatgaattagctattatattggctatagatgaattggagctattagtgggctatactattaaacttgctcttactgaattatttttttttcacctcttcccttctctccttggagccttggaggtgtgaacccgacctgcctgcggaatataccctgcccctgcgtcaacagatggtagcaactctagagtgcgtgcatccggcactgctgctgttgggcagtttcaccagtgatgataaatacacgtccgtgacggccatatgggtactggtaatgtcgctgtctcgctcagagccccctttgcaaccagccgccggaacggaaaagaaacgacacggcaaaaaagaaggggaaaaaggataaaaggcaagtgcatgcgtgcctccaacgtcagtgacgccaacaaacacaaacctatgcaattattcagcaatgagttccctccgttccaaaaaaaaaagataaaccctaggttttcgtgccaacgtttgactgtccgtcttatatgataaaacatgattaatattttatgcgtgacttatttttttaatttttttcataatttttcaaataagacggacggtcaaacgttggacacggaatagggtttgtcttttttttgagacggagggagtacgtattaaggacgggtaaaagaaataccaaaaggaaaaaaaaaagaaacggcaggatccaagaatttttccaaggcttggatggacacaaacacactagtctatggcagtgtttataaaatcgtacaattatagtggttattatcacatgaggtaactttttcagtttttaaaataatgatatatcatgcgataatattttcagtttctagaaccacgatataccaaaatcatggggtggcagcaacctcactccaaacgattttataaacatcgtctatggtcgatcatcaacgtcgtaaaacaccggtgattggttatgcaacattagtacatgactttatactagcatgacattgacgaggctgcaaatgcaccgggagacagcacctctgctctgcaaaattttatatgtcaattatgggataggtcgggacaaattgcagcaaagctttgaacatggagggagcagtgaggttactggatctagccatccatcttactactagtactactactatatccttgctcctactatggtggatctagctgtagtgcaggagagagatctgaattctgatggagcagagagtgattacatactgattttatgcgagggaagaacagatcatgtgcagatgacacctccaccacaagagttttaatcaacgggccgggaaccataaaccataaactagctaggtattacggcatttgtttatgctcccatccgtgacattgtgggaaacgcatgccatgacagcttatctaatcaaacgatgtgttactaatccgtaccttttaagaaagttgcttctaatcactactagtagtactagtacccataaataggatccatgtgactgggacttcggctgtatttagttcagcgcaaagtttgaattttggttaaattgaagatgatgtgattgaaaagttgtgtatgtatggcatgttgatgtgatgaaaaaggactgaagtttggattcaaactttaaatctaaacacagtcttctacggttgttaagagtttgttcagaaatacatcatcatacgctcactcactagtcactagtgctactcagcactactctgcatgcctgcaactactggagcctgaacaaacgaaattcgtctccccatttttggcattttttttccttggctctcatcatcttcatggctagacgtccaaaccaagaacacatcccatgatccatctacctatcgtcaatcgtcatggctggacatgttggacagcagcagaaaaaaacagagttggtatacgtgcagataggtgtagcttctgcaagttggcagcgatgtctgtgttggcgcttgcgaaatgcaagcctgtgaacccgtggagcccgcttataagcaaaaattagtgagtaacctacggattgactcatggattacatactaatttgatctataaaattatggatcaacctccttaaatccctagatacgataagttggatcatggcacgaaaatccacgggttattacttatttgacctatacaagtaagttcatgaatcggtccgttttcatctcgagaaaaacccagaggtcttccgactagtttcacaaggtggtgggctagacgatctgggttcgaagccccatcccttcttattgtttgatatttagatccttccctaatatccgcgtttcttttttgtcagttctcatccctacctgtgacaattttgggcctgttcactttgatgtcattttcaaccttaccaaattttggtaaagttaccaaaaaagtagctacatttagtttgctgccaaatttgggtaactatataaaaaattctgccaaaattttgacaactataccgaaattttggtttagagttagatttttttggcatcaaagtgaacaggccctttaccacaaccccacacggtcaggcggtggtcaggctgagagcaaaaaaggcttgaatgcccatgccgtgttggggtggggagcgtgccggccgcgggcgtcacggcgcggatgcagctgcagtatttcgtcgcctctcccaacgggagattttacacgaatttgattggccggccgatctctgttgaaaattgttggtgaacctacacctaacagtagtgcttgaatgaatgatagtagtagtactagtacattattaattcgtggcatgttgggattaattacatttcagtttcgtagctaggctggtagtattgtacacccacgaattaggtccatgaagtttagcaatttcgaatcaagcatgtgcgcgctctttgcttcagcaaattcaggcagcctcgaggtagttggccgcgccacattctcccgctgcttgcgaagtggtgagtgagtggctggcaacttggcaaagtcagctacttgatcgatcgactcacgtagtcacgtaataacacgtctaatcctactcctttcagtttcataattcttaacgttttgcagcgagacataacctctaataccaacaccaatggcaggactgtagattctcctagcgaatttggatggagatagattaaaagatagtcgggcctacaccttaaccttcaaaattaggacaattgcacctccgtcgaagagtggtggtacatgcttacgcacagtatgcaaaatccgattaaggtcataaagaccctagtgattctcatctcctaggagctgtggtgcaaacggaacgtaagaatctttcggagcaagatgcaaccactaacgaccgttctcgccaaaattaaagaagaagtggccacttggatgactacaggggcgactagcctaagagagcttaccgctttgggaggaattccgtaaagtcttttccgggcctcattttgattatgcctggtaaatactaatttatatttattttttccctgctctatcaatatatacgaggtaaagattgtctttttttaaaaaaaacaccaatggacggatgacaccgtgcagttgaacagagtactacgggagtagtttcactgtttcagtgtttcacttcccgttcggaaaaatggccggatcacacatgccccgcccggcgtgcgcctgcctgccaaccgcgtggcgtgcaagcatgcaaccgggccaccaatcatgtggtgtctcgtgatctcgtttcgtctcgtctcgtcctcgtctcggcggccgatagctcacatgtggcgtcaaaaaccccacgcgaattatacggcatccattcgccggcgaccgaccgcatgatcgatcagatgctgtgctctgccgctgcaaagtgtcggtcgcttcgctctccttgcattggttctttgcagtcggtgatctactgacctgacaatttttttcccatctcccgtgttgctgtagagatttcttcttccgattcccacaagttgtgtgtgtgtgtgtgacagccaggtgtgacgaggctgcaatggctttcgacccaagaactaatgaaaaatcccaaaattattgtgataccgatcgatcacgcgatgcagctattcctacttccgtgagttgggatatgatggaaacgctggactgaattttggtgccaacatatacatgagatccgatccgttgcagattcaagagaggtgatggagattaaggttgttgagacgtgattagtaagcacgtactgctttcagccttttaacttggaaattaaggcatccaaaaaggaaaaaaggactagctaattaatgagtgctcatcttggatgtccatgaaatatcttatcttcatactatgatggccttataaaggatagtaacaggacagtatatttaacctggttggttatcctttatgaatccattaaaaattaaaagtaattaaagaagaagctcattgttgttgagaggtcattgaataggatctactcttgttttttttcttttgtttttggttttttatagaagaatgagtgtaccataactgagaagattttctgaacaaaatgcatagacaatgcagttctagaataatgagtagaatatgactaattaaccaactttttttttctcaaacaatataatacaaattcaaagagccaaaaaaaaaggcatttcatgcaacaaccactgaattatatcacccaacagtggtgaggtgggtaggataggagatccccatcaaagcaattagatcagtgcaccgaaaagcccagctataaaagaaagcaatccttaaactaaccagcgtggcaacactctctgacgtgtactccctaacctccaaatacgctactgttaatttactactaggatagctacatggcttcagagaaaggaacaaaacgagaatttgatccaggttacttaattcatagtactgcgctgtcccagttgtttgtgtcaggttttaacctttaaccatcaagatcaattaacattgtctgaatttgaaaggattacacattttgctgtaaattacggttcaaggtgacaacatatgtaaagccaagagctgttagttttttctcaaggtgataatgttgggtaatcatatacaattaattgcagatttgtacatgtggtgtcagtgggctaatcgtggagagaaatggaaggggatggtcatgctgctgctgctgttagtgtgggggatcgatcgttagttggaccgaacgcccctggccccaattcaagttgagacgaatcggatttgtctccgcgtccacgcgttagctgtgaccgagctacgcgcgatttcctttcgaatcgagtgagaggggctctgaacttcactgttgagatttgagaatgtactgtttgtaattcagggggatttacagtagtttgtatgaatttggtggaaaaatagtactgaccatccagagtcttattggattttgatttggtcgttgataagttggatcgtcagttaagttaaaccgtaagctaactgatacaaggaacaatagagtggggtgtagacaattttgttgccaatattacattaatggtctagtttttttaaatctgactgaacaatatattatatgattttgtgacaatatttccgggtacaaacgaatatattaatattaactattataaagttgaaaagttattttaaaatgttatctaagaaacatatattactatattttttagggcttaagtaatatactcgtcataatatataatatataacagaaaagaatgaggcccagcgcaaaattaagggctggtttggtttgtgacataaattagccttaccaatttttatcaatgccaaattttggcaagctttggcatagctaattttggcaatgtaaagttgtgtttggattgaagtcaaaatagcctaaattaactattgaaatggcctattttcttaggtataccaaaatttagtttcaaaccaaatagacactaaacactattgaaattgccaaatattggtaagaccaatttaagcctcaaaccaaaccggccataattatacatgataaaccatagatttgtacatttcgcacacatttcttcctgccacaagcattcacaatttcaccggcaatgttcaacagcaattttgtactacactccattttaagggcaaacatgccactactagtagatctgaaaattcttctagtctttcccatatcagtgaaaaagaaagatattttattccgggccccacttgcatcctccagggaccccaagaaaagcgcacaaattccaccccacctcaccagcaaaattacaaaagtacagtgatgcaaaccttacacttcacaccctactattctccaataattaattccaactccccgcactgggaaaagatatgccatttttatgtgactttgataaaatagcacacttgataatgcaattgataaaatactagcactattcgctatgttgacattcttatggtcaaagggttgaagtttttcaaatcctacaaaattcctatggaatggcttattgtatatagactttggagaaaatttagcaagaggtccaacctcttggtaaaaatcctttgagtctatctcgctcatccgattcatgtggtccaatcaaacgatcatttctgtattttgcaatcctctgttttacacttacattcctatcagaatcttatgtttttcctattcatccttttttcattcctacgattcaaaggggcccttaaatttgagggacatttagccatttgctattcttacatttgacgtttaatcatttatcacttacgtatatatcaataacatgtagatcctcatacatctatgacatgtagattcagatgataaatgattaattgtcacatctaaaaagtagtaaatagttaagtattcccaaaattgtgggtttatcaagaatgacaatgtagtgtatatcaagagtattctaagcaaccctataatttatactagaaactttagaaacttggaagattttaatcacacaagataatttcctacgaaggtatttgaaataaaggattaaattttatctttttattttaaaattcctatggaatggatggtcttatagagatttaggagaaaagttaacaagagttctaactccttagtaatttccactttaaacctatctcttatctgatacctacgacttttcctacaatctaattaaatgatcattcttgtatttattttataattctttatttcattcatattcctatcaaaatcatatgacttttttttcctattccttcgttttaaaatccacatttcaaagaagcgcgtgttggcattttcatcgaatccacgcgtaaagagtggcatctcatagcgaagtgagcacaactcaattggttaggttacttgtggtgaaaccaatccacccgggtttaaatcttattctttcaatggtagttgacatacctgtcgatagcgaggtacctatcatgacttcgtcagtctcatatttcaagatatgctgacctagtttgttcggagatacaataggttatacgtgtgtgttcataacaatgagcgtacggatgttatgaacgtctgcgcgtttagggcccctttgaatcacaaggttaaaaaaatggaggaataggaaaaacacatgattctgataggaattgaagtgtaaaacagaggattgtaaaacacaggaaaaacacacaaaaggccgtttgattggagcgcaggaaaaacgcatgaatatagactcaaagaaaattttccaagaggttggagctcttgttatatttcctccaaaattcacatgcaatgtgacattccataggaattttataggatttgaaaagcttcaatcctttgaatcaaaggactaaatagaaaaaatttctataggatttgaatcctatgaaattcctacataaatcctttaattcaaagaggcccatgtgttttttaaaaaagagtgacatctctcatcaattttctccccacacaaggcatggtgaggcaatattacatataaccccttataatacctcccaaatcaaatccagctcccctttctctctcctcgcatcgccacctcacctcacctcacctcactcgcgccgctatataataacgcgactcccgagctcacaggagagtgtgcagagcgagagacgcgtcacctcctccccgccgccgccgccgccgcctcgcctccgttgcaaccgtagtagggttagggttttcgtggtgggcgccgccgccatggcgatcctctcggcgctcgggaccgaggtgttcatccccgtcgcggccgccgtcggcgtcgcgttcgccgtcgcgcagtggctgctcgtcgcgcgggtgaaggtcaacccggcgcacgcggcggcggccgcggcgtcgggggggagcaagaacggcgggtacggggactacctcatcgaggaggaggaggggctcaacgaccacaacgtcgtcgtcaagtgccacgagatccagaccgccatctccgaaggtgaatctctctctccctctcagatctggccgcgtcgcctggttcggctagatctgatcgttcccgtggccgtttcggccgagacgatgcggctttcgcgcgttcttcgtggggattacttatattattaaatcattcttaagtcatttcgtatctgggcgtatgattttgtcgatgagcgcgacattgcaggggcaaaatggttcgttttttggttctattctcccttgattagttagtttcaataacgacgatctgatgggaaaacttccaaaagctcctcaaaaaagatggctttgtgaatgaagaagaatcatgaaaaatccgagatgaaccgctgaagtgatgttaaagattggaggttttaggcgatggaagccaaatcttctcgttggggcttttggtttctttgtgggggctgccaaatagtgctactttgtccaaatatgtgctttcctgatattttagtctctcctggtttgccccaaatctgtattttttctagtgggggctcctcctgtgttgatatgttttctttttttgttttcgttagaattcacttttgtctatgccactgagtgggggctggcaaatatttttctttgccccaagacggtagatctgcacattagttgggctaaatcgagggttcagtaatgagttcttttaatgcttgaagcggtgctcttaccctgtgtcggttttgtaggaaagatgtagctttcagtagtagtacaaattctgcagtggaaggcgcgtgagggatctgtctgtcccaacttaacaagttgatctagtcagtattaggctgacttaagttttacattaatgtaaacctgggctccaatcttctggtgcccggtagatctagtctggaaacgtaaggataccaagccatatgtcaccaacgtgtcagcttagcacatgacctatgaatttgctgtcttcatcagtatggatggcttaatgctcttcagatgcgtgtcccattagtgcggtttgtttatgtatgtcaccaatcttggctcatgccttctttctttgattgtgatggggacacaggaagagctacttctggaatatctgctaggatttggacatggggcttgtcacttgctctcgggtggtttacggcttatttttttctagtatatatgtgcacatgctcttcttccattttttgctgatgtcagaagataaaatccgaccaaagcttattatggtgttcagtgtcatgtcatgtgcattggtttgacaaatcaatattctgtattatttttcatagtttgtatgggaattgcaatgtaatttagcaaaactttgcttatactgacactaagtcgtgttgaatgatatgattttttttgtaacaattgccttctttttatgagcaggagcaacatcatttctcttcacggagtaccaatatgttggtatcttcatgtcaatcttcgctgtcgtgatcttcctcttccttggttcagtcgagggattcagtacaaagagccagccttgcacatacagcaaggacaagtactgcaagcctgcccttttcaacgcgctctttagcactgcatctttcttgctgggagcgatcacctctttggtctctggttaccttggaatgaagatcgccacatttgccaatgccagaactaccctggaagcaaggaagggtgttgggaaggcatttatcattgctttccgctctggtgctgttatgggcttcttgctggcatcaagtggtcttgtggttctttacatcgccattaatgtatttaagttgtattatggtgatgactgggaaggtctttttgagtctatcactggttatggtcttggtggatcttccatggctctcttcggaagggttggtggaggtatttacactaaggctgctgatgtgggtgctgatcttgttggcaaggttgagaggaacatccctgaagatgatcccaggaacccagctgtgagttttctcatctctttgtcaggctattaattttattttagggaagttaaggggataatcgtatcagtcccgcagtattgtagtgactattatagttcatgatcttccctctctgaacttcctcttcttgttttgcaggtgattgctgacaatgtcggtgacaatgttggtgatattgctggaatgggatcagatctctttgggtcatacgccgaatcatcctgtgctgctcttgttgttgcatctatctcatcttttggaatcaaccatgatttcactgggatgtgctacccactgcttgtcagctctgttggcatcattgtttgtttgatcaccacactctttgcaactgatttctttgagatcaaggcagtgaaagaaattgaacctgctctgaagaagcagctcatcatctccactgctttgatgactgttggtattgcaataatcagctggttggcccttccagcaaagttcaccatcttcaattttggtgctcagaaggaagttaccaactggtaaactacttgtctaactttctttgtttgtgaaatgttgtctagttttgttatttgtttgtgaaatgtattctttctgattaatttgctgtggtttcacaggggcttgttcttctgcgttgcaattggtctgtgggctggtctgatcattggttttgtgacagagtactacactagcaatgcatacaggtaagaaacctattagtttccaattatgatgtctttcaccattgttacattacatgttttaatccctactgcttctttttggcagccctgtgcaagatgttgcagattcctgcagaactggtgctgccactaatgtcatatttggtcttgctctgggatacaaatcagttatcatcccaatttttgctattgctgtcagcatatatgttagtttctctattgctgcaatgtacggcatagccgttgccgctcttggcatgctaagcaccattgcaacaggccttgccattgatgcttatggtcctatcagtgacaatgctggtggtattgccgagatggctggtatgagccacagaatccgtgagagaactgatgcccttgatgctgctggcaacacaactgctgctattgggaaggtacaatcatgtgcttactcttgatgagcattcccaagctattattagttaattaagcattagaattagtgggtgcttaggaagaactgttatgttggttctgtgatttgatccttttatattcttttgtagggttttgccattggatcagctgctctggtgtcccttgcactttttggtgccttcgtcagcagagctggagtgaaggttgttgatgtcctgtctccaaaggtcttcatcggtttgattgttggagccatgctcccgtactggttctctgccatgaccatgaagagtgttggaagtgccgccctcaagatggttgaggaggttcggaggcaattcaactccattcctgggctaatggagggaactggcaagcctgactatgccacctgcgtcaagatctccactgatgcttccatcaaggagatgattccccctggtgctttggtgatgctcacccccctcatcgtcggaactctctttggtgtggagaccctgtctggtgttctggctggtgctcttgtttccggagttcaggttggcattatgttctctctccctcattatgtgcttgtgcgagtttgctagttcaatggatctataatcttcctcttctccagatcgccatctcggcctccaacactggtggcgcatgggataacgcaaagaagtacattgaggtaaatgttcagaaaatcctgattgatcatgttttgcaactcattatccttcgcgagacttaactttacatcaacttgctccctgttttatttcaggctggtgccagtgagcatgctcggacccttggtcccaagggatcagactgccacaaggccgccgtgatcggtgacaccattggagaccccctcaaggacacatcaggcccgtcgctcaacatcctcatcaagctcatggccgtcgagtcccttgtgtttgcgcctttcttcgccacacacggtggtctgctgttcaagtggttctaagaacataataccattggcagcagcgctgaaatcttcgacggacatcacgaataacgactgccagtgtacgttgtgcttgggaatcgcccgcaccgtttctttttgggtctcatgttgtttcaggattgctgttgtcttatctttggcctcttgggagttgttaccttagccttactgttagcttcacttagaagagaccagagtccagatgttctcccatctctggtgcgtgtctggcaaattttcctcgtcccatgatgacgacgataatgtttgaactcttgaacaatgagatgatgattgttgcatgttagttactggtggtaaatctcttcatctgatcaaaatctggtttgcaataatgtactccctccgtttcatactataagactttctagcattgcccacgtacatataaatgccattttctccaattgggtggctagaatcttaccctttaaaacttggaacttgcaagttcacatggctggggcaaacgaattatcctactcagtggcagccatgaaattctacattctcaattttgagtcgattgcctactcagtagcagccatgaaattctacattctcaaattggagtcgattacctagaattctcattctattgatagtttgatactgtcttacataatttctcatttgtcttttcatgctctttctatccaaacaaaagtgaaagattgcatctcagggaaaataaaagttgaaagattgcatctcagaaaaacaaggggtgaaaaaggttgtatctcagaaagatcttcaatgggaaagagcttttccctttccttttcttcatcatatcatttttttcccaatcttacacaattgaacaaccccaaaaaaaaaaaatcacaaacttttcagccttgcagctttacttcatcttgagatgggcaagcttagctacccatcctaacttcacctttcctataacaacaataacaatcacaccaaatcacccaaaaataaaaacaatcttgccctaatctaactacatgcaggggcagggaaattgtgtatgtgagcaaacacaatggagtaaggagccacagctattggctgtgctgcatccactttgacaggctccagcctagggatttccccattttcatcagcaaccaatgccctgccattcagcagcatcacttggctctgcaagctgccatctttggcagtaagatggtattcttctctcattgatccagctgcaagatgcctggtctttctgctatgcttcttcacagtgtttgcatgagcaccttcacttgtcactgaaacttggcttgtggtgttgccactgaggttgatcagcagtagtgttattcctggctgaacttgcaaggaagagattgagcatagattcagttagtagatgagttttttttttcattgttctgatgaaaatgcattgggttttctggattgcttacagaatcttttgcgcaatgcgcataagtgcgaatcatgttggtgccattgaatgttgcagatagaactttggttcccatgaggcgatgccatagtagagcgctgcaggggaataaaagtaaggggaaatgtcatgaaagcaacaagtttggcacttgattctgcaagattatatgcaatggaaccaattcttatcttggccattaagtagctacttctagtttccaagtgtaaggataattctaaacttttgctagaggcatcaaaatctttgtttgcactatcatacaaaggaaattgttcatatgaaagttgccttttacctactgaagaacagcccaagaatatcagttacctgtaatagtcaggatttggttggaatgtttctttgtttagcaggccatagttgccaccaatcaaactttgtctgcagtaactcttcgtgtcatactttgctgacatcccaagctgatccaaaaacctgaaaaccacacaaattcagaacaacctctttggtgatatctacaatttttgcacttcagaagcttttggtttaccagaaactgaacacaaatgaatcggtaacaagatggcggccgctgttgtacgcgcctccggactctccgacccatgcgacagccgaagtcccggcagatttcagtatcccctgaagattgctgaatgtgctcaccattccatcaagataagatggattcaggatcttctcaatcagatgtgtgtccactcctgcggcgaccaaattatcagaactttcagccaggaataatccatcgcgtttgttcagaactttcacactccaattcatgtaccaaattatcagcagttcatggtgagcatacctggccctaagttgtagatgtgatgggtgaccacattcagtaggtttggcctggttttgactataacttcagtaaaccagcctgcatcaaagaaacctccaggagcaagaacaagtggctttgatggattgccttggtagatagtgtcaactagtgatttcagtgcaatcacatctgcagcatattggtcagccccaacttttgttccaactccactgccactgagttcatttcctgcaaggacagtacaaatcttccccaaaatcaacttggttgaattgcatgaagaatttttgtacttctaactaataaagattcttttgctaaaagaaagcagaaatggaagggcaggtagaacaagaattctcatcctgttctttatttggtaggtttggtaacctgaacattaaactaaacagatgttgacagcatgcgtcagaactgagaaatcagctttgtttctgaccaaaaagcacccagagatagcacatttcgaggcacggtcgattcgatttgcaagatgatttgaacttaccaagctcccatccatgaattttgtaacccttgctcgcggtgtaacgaatcagcgatgcagcattggtgtaatcccatggccctcccatcgacccatccggcaacggaacccggccgttgagagcgttcagcccgaacacgattctcgcgctgcgaatttgagcaaatttcgtcgaattctcgtgctaaaaaaaaaaaagatacagtacaacttccttttcagattcagaggctagacaatttgggattacccggatttttggaagaaggcgttgagctcgtcccaccggtggagaggcaggcatccctgcgtgaagccgaacatctccgacgtgttcttgacgaacggcgcgcacggccctccgccgtcgccggtgccgtacaccagcttgtcctgcagcgacccgcccagccgcagcttcaacggcgagaaggctgccaaaaaaaaaaaaaacaaggtaaactccgatcacgtcgccggagaagaagcacgagcacgagagctactgctgcacactacctcgaatggcattgagcaagattttgttggagagatcctgcaaatgcaaagctcgtgtgagtttggattaatttcaccggaggaggaggaggagagaaaaatttggagagaatttggagcgagaaattctcgaccaggttgaggagggaggcgaggccccagctgcaggtgccgtagtcgcacttgtccggcggccaccagtccatcgtcgcgcacacgaagtcctcgtcggtggcggcaatggcgcgccgcccgtcaacgccggcgaccccgaccacggcctccgcggcgccgcccagccgcagcagagccaagaagcatagcccaccaagaaaccgcctcatctccatcccggcaaagcaagcaagcagcaacaatggcggaatgcctcgccgacgacgagcctaccctaccctaccctacccggctagacctgaggtgggcaggtgggcaatggcgctttctgccggccacctccacctccacctacaccatggctgcctaaatactaaatgggaaaacgccaagggcgacgcatcgagtcagagcagcagcagcaggaggaggaagaagataagggcggtggtggtggggagtagaatgcttcagcttctttaatttctcctccatttttcttttcccttttcaccgccattcttgatctcgagctccatcaccttccatgcacgatgacgcggtaagcccgggcaaaagaaagatagaaaaaagaacagttcgttttctgttcgctagcagttagagcggttaattttggtcaggttttgaccggggagaggttaaatttcggcaagcagtaacactgtactcccttcgtcccacatagactctatttttcggtttctgtctcaaacgtttgaccgttcgtcttatttaaaaaaattacaaaaattgttttacaaaatagtcatgcataaattactattcatgctttatcatctaacaataataaaaatattaatcataaaaagtttttaaataagacgaatagtcgtatcaaaaattgaaaaatagattctttgtgggacggagggagtgattaacagtgcagtgcagtactgagcagtggaagacaaaggggagcatgcaatggtactaaaaacaccaaaaaggttttctaggaatccaacgtgctgtctagcctggtacatttgcattcttggatgattgatcgatcattcatacttgccggctgcagtggttcggtctgattggagatttctgatctctaggagaaaatcgacaagaggacggttttggttttggatgcattcttatttgtaataagtgggtgtgtaaattacaatacgagtagtgggtgttagaagtacaaatatgttagttagagataaaagtcaaatacaaatataaatatagagataagatatattctagagatagaatcctagagatagtatgctagagataaatctactcttatacttgtattgtactccaagtctttgtcccctatttacttctatgtataccttatgagagtgtaatagattagaaaacaattagaatacaacaattagatttttccacagtgggacgagtcatggttgaaaccttaaactcactctagaccggtaagttggtaaaagaaattctgagcataaaatttagggattctaaaggataacttggttttggttatgggtttatcgagaagcgttaagtacatcatgcaagtaagattttaaaacccacgtaaaccatgttggaacggagatttccgtcatgaatttaacttgagaggaaaagtacagatcccctcaaaatatttgggatcctaagtttgtcttgcaattaattttgctccatgcatagtggagactggagaatttgtcccagcaatgtgcttgtcacttgtcaggctactactggccatggatggtgaatctgattggtttagacagagaaaaaggattgaccacgagtcaatttgttggccatctgctacacctgcctttcaaaatttggacaagatcatgcatgatccaagaaaagttagtagcacaccactctcaactctcgatctcaactggtcctgccgatccagaaacgacccaatctagctgcatggggctttacagctcttttgctttccttgtgggcacaaattggctcaatcatagtgggtgtgacaagggctttgttggctgaactgtggccattggtgggggctgattgggagaaaggacatgggggctctcacatcttgaattgaactcatcttggataagattgtgaaaaaatatcttgatttgaatgatcaaggtttgtacgcaatttcgccttgcattgcaccgccacttctattgataccttactagaaaaaggataagcttgtttcgcggaaaaggctccgttgtttaatgcttttttctttatggatgattggattgattacgaacaattccttataggaaaattaaatatcgtggatattgagttgcaaaacatgatcaatcaggtttatgagacactaactggagtacattgaggtaaatgttcagaaatcctgattggactacataatgttctttttttcttgcttttatttttctgtattaactgaacttttccataccccttcctcactttaatagaaaattagcagatcttctggtattcctacaaaaatacaatatttttttggttcggtaatgagaaagaaataagacagcatacgtttctgagcttctgaaagaaatgtacatgtcctatcatccaagttagataaaccaaatctaagccgggacgaccgagtgtacagctatttgaaaaaggtaagctctagaatttccaaatattcctgtttgatcttttggattctacaagaattttttaacatactagttggtgaaggcaagtgaaaccagggagaagaggccaacaggttacaggattttgcaactgctaccgtccaaatacatatcttgaagtcctgaattttgatcagaataatctatatgggatagctgggtccaatgtggattgatcaagaattattgccacgggaactgtattaatcaagatttctttgacaaatacgtgcacttaaagaggcaattatcctgcgttttcagaccaccaaattgcaattgtttgtctatgtcaatggttttgtaaaattgttttcgagacatagtgatagctagatagatgactgatacaaatgctgaatgtgacatggtcattcaattggaataacgtcaaatattagcacatctagccgtttgtatcagatcaatagttcgtttttaaaaattcagataagaaacagccttttgtcatatcagttgttcttggaacctgaaagtttctgcaaagaatgtacgatgcttctactagtttcccaacactgaatataagtctgtttctccttctctacaagatgcatcgatctttgccggctaatacactgccatatctcattgccatttcaatgaggccattgccggctaaggtataaactcagttcttttggaggcaatgtgcatggcttggttcagaacttcatagaaatgcatatcctaattcgtatcgcaatttggtactttggtagcacgtatgatagagagtttttgtgtcatttctaccaagtttgttcttcttggtttatctgttccccggaatctgtcatatttgacaaattgctgggtatatgaatttttttgttctatttggtaatggtcaaattgagaatgtctcatatctgctgagcaatccaaaggatagtgtatgcatttagttctcttgtgttttttttttgttatttgcatttgattttagtccaaggtacaggccctcatcttttcgcttatacttatacttattagccaaaatttaaatttttaaccttaaatttgaagctgattttgaggtttttttcatcgaagtttatttttcagcctttgcttttagatcgctaagaacacgtatataaaaattttattcacaaattacttttcgtttgcagatataccgttttgcttattccgcgaataagcgaaatgatggttctgacaattctttttgtcttttctccaagaaatggcatgtacattacaatgtagcgagaacagatcctacttgcgtagctaaaaaacatcacaaaataaatagtacatacatagaagatcgcaggtttattcccttttaaaatttcctgtcaaatttatgctcaagtgcgctcctgagaaccacactgatgggccgaacataatgggcccacacgtcagctgccaccccgttccgttcccaactaaacggggccacccatcatcccataagcccatcccatataattaacatgggcccaccacacaaaatttcacgggaacaattaacataggcccgcacgccagccagccacgatcatgttccggcccaataataaaatgggcccacacgccagccgagccgcaatccccctccggcccatccaaaacccccgccgaggcgatcgcgtcgcggcgaaatccgcgcgacgcgctccgcgtccacacgctctcccgcgccgcgccccaccgctcctccacctacctcgtcacgcgcgccaaccaccgtctcccc

SEQ ID NO: 41834 - DNA, 4363 bp, Oryza sativa
ggaacggcggcaggaagatggcgctgctgaggcacctcagcaagcccatgctcaccaaccactccagcggcggcggcggcggcgggaagaggacgaggacgacaaacggcgcggcgacgacctacaaggccgccgcccccgccgccgcgtcggcggcggcggcggcgataaccggctgcttcgccgcaaaccccgacgcctacagctacagcgacgacgaattcgatctatacgacgacggcgaggacatgcgatgggagtccatgttccaagatctcaagcccacataaacagagctagcttagctgcatgcgtagtgtcgtccattcatggcgagctccaagcatgcaacaatggctgctcgatcgatctgtgtccggaggaagaagaagaagacaaggtgcgtacatgtaaatccacatccactgtggtcactggctcactgtcactactccactacttactgtttgtatgctctgtattttgtaactgtacatgtgtagagatcgagagaagatgaagcttttatgtgtgttttgtaaccgtttttaccatgttctttctttgtctgtggagctggaaattataattgattctggtaacattttcttcttcgtcttgtttggttcatgcattgtttggtacattcaggcccagcgacaaccaatcaaaccatgtctttttcagcagtgcatcttcattttcaggttcggattatacgtatagccatgcacacatcactgttcactgtattattgttttgtgcatgtgccatgatatgacatgagttcagaactaataaataccgtataaaatttagtatctcaaacaattaagtgcagctagatactaaggacaaagcttacttttgagggccttggcagtcgtagcacatgctgacagtttcacaattcagatcagaaacgaaacaagctagggtgatagtagcatatgccaaagttgttttttttttccagatccgaactgctagtgtgacattgttgtgagtggtaggaataacagcctcttcggccattcaaaaaggcaggagaggacgtttttgtgcagggtttagatctgtcggctttcagtgcagtgtagctggccaaccttggcgctgctcaaatctgaactgccatctgcctgttgaaaattcagcctgctgatgaggcttcaggaggattcttgctgcctgccatgtcatggaatcttgatccacacaaagtaaacagaaatttgttattacaaattacagcagagtcagatagtgacatgccgacatgcatttgattggtggtagtaattggtaaattggccacatgggcacatggtttgggttcagtgttcacagttcagaactgagaggcagataaattatggagattaaggtacaggaggttgtagttacctcgtttgatgccacgttcagtgctgggacaatgtcaaaatggacaagtagctagctagcttcagtaaccatacctctgaagaaatggccaataggttagtctgttgagatgctcaatgcatgaaatattttctttatcagaacatgagaacacctgaatatcacacagcttgtgtgcctaagtataatcataaatttctattatacaaaagcagcaatttctgttattacattctcgttttcttgctttagctcatcagcctaatactagcagcaccagcatcgcattacaaactcaacaaaaagcacctctctcattcctgaacctcatagctgaaataacagtgtagagcaccaatactcataactgaatacagtggatccaagaatatcatcaaacaagatctcgatctcatgctacatcaatgtgaattccggaaaagcctttctcagtgagcagagctcctcggctggctgaaggatccaccagcatagagcatctgatatactggtcggattctcactgtcaaaacaatgctcagcaatgtacccaagctagccactccagctagaacgcaaaatgtaagtctgaaacaattagggccatggcatgcaatgtcagtgtccattgttgtggcatgctgtctctccacttcctggtcgtaaacataccccgcgagactgttaaacaagagtgcgccaagtgggttccccaaggagatgaaattgaaaatctttccgaagtgcttcaatccaaacaactcagatgaagttgacaccatcactgagaactgggcaccataacaaataccaagtaaagcaacagagacatgaagtgtggcatggtggcccaatgcaaagagcaggtatataattatcatcatgacttgggtgcatgtaatcaatgttgtccgtggaagggtccttgacctgcgaaagaagatcagtgaactaactcagaatggtcatttagaaaatttagaacttaaaaacaagcacttcagtgatgaacccaaaagaaaatattttgatacagcatttatacaatggtaatggggaccatacctactgtttcttctattaaaaaaggagagaaattacggtcggttcattatctaattactgaaaaattaaaactggattgggggcttgatggttagatcaggaaatagatgaccaatgaacaatggtagagtataacatgcttgctcccctaaaagtaaaatctatgggttggctagctaccaggtcctaaacagtagccacaatctccaagaaacttgacaggatgactaactagtacttggagactagttgatgaaactatcctattgaaattctcatttcaaaacaaacacaattatgcaggacaagaaattccattacctgacaagatactcagaaacagcaccacctcctaaacggccaaagaaattgccgaaactgaagagggcgagtgatatggttgtatccgcaacacctgctgcaattccaacttgtgctagattattaagaacagtgactccagatccaaccccaataaaatacactgcaaataaaagccagaaatcagccttcagcagtgcttcacgaaatctaaagtcctctcccctttttggtcttcttctcttctgctttatagccccttctccctcagctaagagaatatcaatatccatggaatcatcatcttctatattaccaagatttgatgctgatgaagaaggaagtaatgattctgtatgatcatgatcagcagaagaagaagagcactctgatgaatcggattgcccttttcttcggttgcttggaaacaatgtcattttcaagggtactgtaagtggaacaaagaggacaaggaccatgatgacaagcagaacatagttcacagcatcagtaagagttacgaaatggtccaatatcgtggctgcaacaagataaacccctagaagaacactggagagttgtgtgaacagaaaatgcacttgctccgaagagttctccacaagggagggttcacaaggccgcacgaagtacattgtcacaaggcacacaacaggaactcccagggtgacaaaaagcagaaagtttgaagctgaatcatgaagtactccggtgtatattacagtgtacacagcagcacttaaaccagcgtaccctttaaggatgccagcgacggcacctctactgagtgggaaattcctcatattggttaccaaaacagcggtccccaaccatgcaccactgtttgcagcaaggcataaggcaaaccatatctgaaatacaacagtacggtcactagtcagtttaagctgtcctacgaaattaaatctcggcgtctcaccatcagaagaagctagcagcctagcaaagtaagctaaccccagaaacctgccccagaacaagcttccagtaaaaatccccaatatgtgcatcttgctggcgtgtgaagccaaatgtcgcatttttttccaacccaaatgtgaatgtgacccatacttgttcgctagttagtgtttggtacaacaattcttattttgtagtttactttttgttgctgggatctttgaaaatgactccttttgttcccgggaacaggttccttgctatatctaactcaaaaagtcgttacttgcaccgcccaaaagtggccacttggcgtaaaagaagcgcactaccaatacactagagcaattcgactccaatttcacaacctaacgaaaatgcaccactaatgcgcatccaaatgcaattttctaaaactaaaattacaagaaaaaaaatacagtgcgaatcgatctcagaagtggacacctagcaacaacagatccaagaaaagaaaaaaggtaaaaaaaaaaaaggaaattacagagcagagagaagggtagagagagatgaccagccagtaggggagcgcggggccggaggcggagacggcgagccaggtggagccgt

SEQ ID NO: 41835 - DNA, 27327 bp, Oryza sativa
  unsure (1)..(27327): unsure at all n locations
ggggtggaggcggttgcataggacgcccgggaggaggccgaggttctccctgacgtcgcaggcgaccccgagcagcgcgaggcggcgctggtcggcggcgagcgcgaccttgagggcgtgggagtagagcgcgaaggtggagctggctccgcccgccacctgcacccacaccgccgcccctagccccacccacggcggcctgctccccgccttcaccgccaccgcccccctcatcctcccctcctccttccctggtcggatcgagaagcggggtttgatcagcagcagcgaagcgtggtgggagcgagagcaggttgggttgggggatgaggtgttaaaaagggagagcggattgggacctgtccgacggacggggactgtgccggggcggccacggtggccacggggttggagtagtagaccagtaatccctccggtttcattttaattaacattttggacaatgatacgatatattttttaaaaaatatttgaccgttcgtcttatttaaaaaatttaagtaattattaattctttttctatcatttgatttattgttaaatatacttttatgtatacatatagttttacacatttcacaaaaaattttgaataagacgaacggtcaaatatattttaaaaagtcaacggtgtcaaacatttagggaaggaaggagtacaagatatatctttgatcttatttttttattataatatatataataaataaatgcatgtttatttttattataatgctttaaaaaactaaatatttttaaagttattaatggtcaaagttataaaagtttgatctcaactttattcaaaacgtcaattaatatggaacagagggaggagggtagtacctggatttggtgcgggaaaagcggaaaagcgatggattctccactgggacaggcgcgacgcggtgggctgggccggaaggaacagaggaggaggaggagggggaataaactccgattaggtccctcatccttaacgtcgaatatgaatctcgtctttgaattgaaccgttatcctatatacttcaagtcattctagcattttacacattcatattgatactatatatatctagattcattagcatcaatataaatatgagaaatgctagaatgacttacattgtaaaacggagggagtagtacttagggaaagtactataagccccttcatgttgcctctaaatttaccacataagattaggtgatgagttggaggagagaagttaggagagaaagaatgagccacccctcatacaagaggcaacatccatacaatctccaataaaaatataagatgagaatgagccacccctcatgcaagtggcaatctcccacacaatctccaataaaaatataagatgatgtgggagtaaactaatattggggtttgtgtactagaggtgacatgttgtacttgttacctcttaattaatgagaagataacatggtttaaattagatgtggcactcacctccactataaaacttgcccttatatagttcatcgccactaagtgtagttaatgctatttctctcttctctcattaagccacatcaccctaattatttctagcctttaaatgatagatctatggttcaaattgtcacttctttattctctcataaaaccatgcaatctcaattatttttagactcaaaattgtactatcaatttgttttagttttgataatcatattatatcttatttgtacatattatgcaacttaattttccgcagcaacgcggcggggtattcatctagtatcaggtataacacgtccctcgatctacaccatcggtgtactcgtggttatagacaatatagtcattggttttggctgatgtgacggctaaggctctgttcttttggttgagttgggaacccatccctccggtacggaaaacgaagcagtccattagcacgtgattaattaattatttgctatttttttttcaaaaatggatcaatataattttttaagcaactttcgtatataaactttttgcaaaaaacacaccgtttagcagtttgaaaaacgtgcgcacggaaaatgagatgggggagttgggaactccaggaaacgaacagagcctaagtcatcatgacctcacatgtcaacttcctcctcttctctctctcatctcccaactttcttcttcattctccgtcccaccgccgtgccgggcatagcccggatcctactccctctccgcctcctccctgacatgacaacccatcctccgcgccagtagcccaacatcgccaaggctcgacctctcctaccccaggcacctctccgtctcgcgaaagtgccgccttgggcctacctcgccaccttctactctatcccaagacaatgcaacgccgggctcgccccgtcacctcctacttcatcccacgacaacgctgtgttgggcccgtcccaccacctcttcggcggattggtatgcgaggttttgagattggtggtgcttgtctggtcatgcatcaaaagctgccgccgcggcgtgacaaggagcgggatggcttgctgggatgagagatgagcaggacgaaggttattaccattagcaatctagatccgatggaggagttcccgctggtgacaccgacgctcagtttttgggagttctagcatcttggcacgttccggggagtgagccccttctccccgctgttcgacaccgatagcagcgtcactaccttcactccccctcgcgcctgccgacgaggacaacatagatggggtggagatgcccaatcgtggcggtggcctcgagttgagccccatgcaccgcgactagtgcacctctctccctgtatcccattggcccgccgcccaggaggctgagaagagaggagagggggaaagaggaaaagaaagctaggaggggagagagaggggagaggaggatgatgctaacatgtggggcccacgatgatttagccagcatgttagccagcctatgacctcgggtacatcgttattgtaagttgagagacatgctatatttggtattgcagtttaaagatgaaattcaaattcgaggttaagacgagggacctaaagagaacttatttcgtgggagggctggaagtgaagaagactcgtgtggatgatgggctgatgggccggccaaatggatggaacatttgggtaggggggcattttcgttcaaagtttatatttgtaaaagaaaaacctctagtccctcgaaggggtgaaaaatggaaaataaatccagtttatgagtttaatccatttccatatgagaaatgaaaaggacaaattcagacatgaatagtagcaatactattcatttgctgatcttttttaagtagtttacgtatatgctatgaatgttgtcaatttttttagaatttttaacaactatttggatgaacagtgttatctttaaatgatgagggaaatataggttaactttctccattgcagtgttgaccacaggtactatttcactgctaatgttaggtggcatgacagcatcagaagggacttgaataatggcatgatcattgcgaatgaccatccaaccctaatttcttggaccaaaaaaacagctaatttagcgcccacatgtagataaacaaaagcttaaccgggccacaaactactcactgccaacgctcatgctgcacgcttaatgtattatagccatgcgaagaagtttcagtcgatcagaaacactcaagtgggcatattcagattcttcagcaatccatctgtaaattcattcaaaaaaccaaatcaatgtcctttccagtctggtcttgtgtttgaattaatgtcatgctctgatcatatcatgcaaccccatatatggatggatcgatcgggagctcgtagtaatcatgcgtgatctgatgaatattttatggatgcaatgcataatttgccgttttgttcagcaacagtgtcacactgtcactgtccttggctagatccagactccagcgttgcttgctgcaagctgctcctcttgaatgtgagagtgagagttcgtcagaagatgacagaattcggggttaatttcagttggtttttactgacgacgtgctacggccgagtttagttccaaaatttttcttcaaacttccaacttttccatcacatcaaaactttcctacacacacaaacttctaacttttccattgtgtcgttccaatttcaactaaacttctaattttggcatgaactaaacacaccaattgatctaccaatgctgattcttagtacagttcagtgttaatcatgtgcaaagtaaaggaatttggccaattttgttccgtgtttgaaacatttttctgatcaatctgcatctctctggggctggtgagcatgcgaaaaacgaagagacatgcatggcccagagtgacagaacaagtttcaactttgcgaaccaaactaattttccttttctttttgagcaattctaaaccttttctttttaatttccacgttcttatcgccatcgactctaccttattagttcaattatgcatggaaaatcatggctgcacttaaaatggaacggagggagtactttattagttcaatttttaattgaatttacacaccatttaatctattcatgaatcatgataggtttcactatatattactgccaaagtggatcagactgacaagcaacaagcagctgcagcttaactcgcacgtgtggaattagggagctagctagagctcgagctgatcggcaatggcgggctccgaccaccaccccggcggccgggacggcgcgccgctggtgttcgacgagctccggtgggtgatccagatccggcgctccctccaggaggacggcggcgacgacgacgacgacaacggcatcccggtgtccgtgttcaacgtgcccaagcagctgcaggcgcacaagccggaggcgtacgtgccgcagttcatcgcgctggggccgtaccaccattggcggccggagctgtacgagatggagcgatacaagctcgccgccgcgcggcgcgcccagaggcacctccgcgagggcgtcaagctcgagcacctcgtcgaacagttcgcgcgcgcggagcgcaaggtcagggcgcactaccaccgctacctcgacttcagcggcgagacgctggcgtggatgatggtcgtcgacggcgcgttcctgctcgagttcttgcagatcttcgccgccgcggaggccgccgccagcggcggcggagggaagccggagctgaggagggtgtcgtcgaggatggcgcacctggtggacttcgccgggaggaagtcggcgcacaacctcatcctccgcgacatgctcatgctcgagaaccagatcccgctcttcctcctccgcaagctcctcgagccgcagtgctcgtcggcggaggaggccagcgagctgctcgggcggatggtcaccggcctcatgaaggagctctgccccttcaagatgatggacaacttcccggccatcgacgtcgccaagcacgcccacctcctcgagctcctctaccacctgctcgtcccgaagccatccgacgacgccgccgccgccgccgacggccacgacgagggctacgacatcgaggagcagccggtggacggcggcggcggcggcggcgaggagaagcagcaatccgccgggtgcgagtacgtgaagcagctgctcgccgcggtgtggggcatcgtgtcgagcctcaagagcgggccgatgcagtacgtggcgaagccgatctcgttcgccgtcaaggcgccatggaagatgctcaccgtggtcccgggcttctcggcgatgaagcacccagtggagtccttcttcatgtccggcggcggcggcgacccgtcgtcgtcgtcgacggcggcggggcaggaccaccaccacgcgatcagccggccaccgctgatcgaggagatcatgatcccgtcagtcaccgagctcgccgccgccggcgtccagttcgcgccgacgaacggcgacgccaccacggtctcgttcgacgccaagacggcgacgctgcacctccccgtggtgacgcttgacggcagcacgacggaggtggtgctccgcaacctggtcgcctacgaggcgtcggcggcgacggggccgctggtgctcgcccggtacacggagctgatgaacggcatcatcgacaccggcgaggacgtggcggcgctgcggcggcgaggggtggtgctgaaccggatgaagagcgacggcgaggcggcgaggctgtggaacgggatgagcaggtcggtgaggctgacgaaggtggcggccatggacgcggcggtggagggggtgaaccggtaccacggcgcgcggtggcgggtgaaggcgaggcggttcatgcggcgctacgtgttcggctcgtggcagctgctcaccttcctcgccgccgtcctcatgctgctgctcaccacgctgcaggccttctgctcggtctacacctgctcgcggtggttcggcgccgtcgccgtcgcgccgccgccgtagcgcggcggcgactgcgagcgatcgacgtggttggttggtttgttttttttggatttgattgcatgcgtttgggttttgggattttgctgctatacaagtgtacatgtgcgatttggattttgtgtgtatttaatgattttttttgttttgttttggggattaatttatacttgtatatttgtactttggttgtacttggatagatacaatgcaagtttggtgagaagtaattttgtgattaattccgcacctatagaaaatcatgatatagggaaggtttttgtccaattatttcatggtggcatcctaaattttatttctaacaattagggcccctttgaatcgcagggtagaaaaaatggaggaataggaaaaacataggattctgacaggaattgaagtgtaaaacagaggattgcaaaacacaggaatggtcgtttgattggagcgcaggaaaaacgcaggaatcagatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcttatgaaattcctacataaatcctttgattcaaaggggcccttagtagcaaggaggaactcacctatgtacgtattcactatatccaaaacttcagttaaagaaaaactatatccaaaaccaaactagtgatggaaaggggttaatccaaaaataatacctccgtcggtccgtcccataataattgtatttctaatattcaaatttgtcctaaaatagttgtcacaatatagtaccaattgttccattaatcacttttgatttgaattcctctctattctatcctcaaccaccaccacacacttacctatacactatttaatgagaagcacaatagtctttattctcaaatcttaatatatactaaacaatctagaattacaattattttgggacagagatattactctttttcacagcacaagtggaactgacacatccacacacaccacacttgtgctcacacatacaaaaccatgtggatgtgtcctggcacattttaagttaaagagattggaggcaagtactattattttaagtattatctactgagattaaatcacaaggaaatgtgaacacatatcttaagtccgaaacttaaaacttagggccccttttaatcgcaagaatggaaaaaaaggaggaatagaaaaaatacaagattctgataggaatgcaagtgtaaaacagaggattggaaaatataggaaaaacacaggaatgaccgtttgattggaccacaggaaaaacacaggaaccggatgagagagatagactcaaatgaattttaaaggataggatatgattcaatcctttgtttcaaagactttcgtaggattgaaatcatccaaagttcctacacttttcctacaaatcaaagtattgacgtagtacgcttctcaaatcctacgggaataaaaaaatacaggaaaaacaataagaattatttgatagtgccatgggaaaaataaagggaagtttacaaagagatcatacctcttgctagttttcctatgtaatgtgaagcataggaatacaatcatatggaaagtttcatttctttcttctgaatcaaaaggatatatgggaaaaaattcataggaatttgaatcctataaaaatcctttaccaatcctatgaatcaaaggggctaatcttactagccgagttatgctcaattcattacccaaagatgctctttgttcactttagctcaacctaaacggtctaaaatttcacctacgagttgggctgtgggcgccataaccaaaatcacatctatagcttgagtcaactgcagtttagtctttatttattgttaataatactataatgtccctcagctagtttacttataactaggatcaatgtcacaatcactttttatgaggagtatcactataacgtgttaatgaagataatctgcgtaagattatgaattcattttctttattaatagttacatgattacgatcgatatatatatagacaaattgatccagcaactgttgacttatcatttatcaatttaaatttccatcctacattctattgtctccgattaggccagggaagatatggcaattaaacaacaattcattttgttttttttaaatgttcgagttgctcaaccgaatttgcagtaaacaataatgtcctgatcagttagcatggaattttcgcttgcccatacttcagtccatagttcatgaataaaatatgataaaagaaggcaatacaatgacatgacatgaacttgtctgatccaagtggaagacattttacttgcaatattttgaagctaaaatataagaaaatcctttacacgctagcaatccatcatgacatggacatttgattatgaagaaaaaaatgttgcagctgtcatacccccttctgccccacatggactgcaacttaattggctaacataattctttcttcatgggctcatggcctatgctcccaaggggaaaaaacatccactacataaagaagcagcagaaaaaatcacaaattcctactaataatggcgctgagcaatcaaatgcaatgactattccctctagtttttttagataatgccctctagttgtaaatgctaaagtattggtatgtttcctacacattttatacttaaaagattaaattagctactccatcattattagcttagaaaaattattgaccttgtcttctgtcaaactatttgatgacataaataagaaaaccaggagaagagaactgctgcacatcaggagatgctcaaccatacgtgagactgacacctaaagctgaggatgatatgttggattaggcacacacacactgacacacagctaagcattctgcatccattttgtgagtttcttgattgaaactttgtttttaaaaaaacaacatttagaagcgtaccgattcacgaagttgcattttcttgattgaaaatctgaaatgctgtcatcaagtttcagtttcttgattgaaatgttgtcaagaagttagtacatcaatggtgtttctcaccctcttcaacagggggggaagaagatgaagaagggaaaaataaatgaaattagaaattacaccttggatcttgctatagcagggttgccttctcaagtgtgtgtgtctcactagttgagcacagattatctaaagaaagaatgaaacatagaagaagaagaagaagaagaagaagaagaagaagaagaagaagaagaagaagaaaaaatgttcagtgatgtctagggttatggccccttggaccatagtaatctacatggatctcaggcagctcatgtcctactctgctcttctcttcagaaatggctttctccatttcaccagatggctcaccatcagtctttgctactactactgctactacgttatcgccagatgtctgcaaaccaagaatgagcatcagttagcaacttggaatcaacatatacattcattgatcaatctttatcagaaaacttaaatgacagtgataaaacacttacgttattgacagtctgtttgctgaatgctgaatgactctctgcatccaaccgaatgctctgaactgttgcagccatcaggaacagagccaggacagcagcaaccaatggcaaggaggtcttcatttcgatcttctgtgtaagtaagaatcctgagaaaagttcagagactggaatactagcacttcagctcagatggaacagtgaggagctatgaagttaggttgctgcaaccctttgacccagagatgatatatatacatcatttgcttcagaagcaaagccatggtcccatctagtgattgctgcactcatgtctgcaatggaggtgtaatctgaagtacagatgcaaaatttgggcataatttatgttatctctgctacactttagagaagtatgtctgcccaaagtatgggccatgtttaggccattggtccctggattaggtgccaatgccacacttggaagtaccaaatgtaattaagaattttgtcaagtactgtatttggtctcaagtgtgatatacatctgctcctagaaagttgcatccatgtctctgaaggaatgtacagagttgcgtatatttgcttgtgcattcctccaggaaaagtgtacaaacttgattagttaattgggttgaatactggcgtacgagaaagctttgattttttaatggaagattaggactaatcagacgaaaatgatcagtgcccgtgcaatttggcatgcatcattcctgcactttgaaggcattattttggtcttttgtgtttgtctccgtgttttttgtatcaagaaaccaaacaactgaaaaaacatgagacaaaaccatggaaaagatgagccaattggcggcaatttcactcaatgggggtatcttttacatggtcaacgttcaattacccaggagttgagtagctgacatttttatttacagacaagaataggagaaaaatatgacactgtgagcttgggcactcacttctttcttcacagagctcaacttgttacagccgcttagaatttctcacaatttgagagctcagaactcatgttcgttggcttaattaccaacaagaataatagctggtgtcatcacaacaatggtggtaacatctaacaacaatgaggtgccgagatcactacatacaattaacactcggcaatgcaacatactagagaaattgcagcaagaatgcaaagaagatggccatcattggtttctcaggagtgtcctcaagctgttcagcccctcagccgaaatgctgcgcgccaccctaccgggtcggctcactctgacctggggaggagcctccaggtggaaggagaccaacaccgcggttaagttgtcggtggcgcctcgctttattgcctcctcaacgatctccctgcagcaggacttcacatcgttgtgttcttggaggcgcctccgtgcaaagtccaccacgttttggtttgagaagacgtcccagatcccgtcgctgccaattatcaagaactcgtcgtcctttgtcagtgtgatcatctttagctctggttcagcactaagtggacctcctggattgccagcttctttcatgccctcaagatgccagtcaccgagtgctctagtgactcctaacaaaccgttgaggtaaccatcgtcgacatagccaccaagtgattctacacgcagtttttcgctgaggctgcaaggcctgtggtccactgacatttcaattgcagtgccgcaccgtgaaagaaccgccctacaatctccagcatttgcaatcagaagagtcctgcagtagacatgaagatatcagtatccatcataagtgtttgcgaacaagtgacaggtataaaaacgtagcaaaaagtttacagaaagacatgatatggatgtttgccacttcatgcttttagaattatatctaggaattaataaagcaatgaaatctatagcacgtgataaagattcaaaaacaggcatgatcttatagcttaacataattggaaaacacatctgctagtagatctaagtatctaaccaagcccaaagtaaaattgaatagcaataaggaaaccaagattgtcgcaggtatttagttcatgtctcatggtactgataactgattcttataagcatactattcaaagatgggaaaaccacagtttaatgtgtcataaaagcaccttccgaaaatcattgctgtaagtgctgttgtgccagaagacagtgttgtctttgcaaactgattatctgcatgaacaaaggatcttcttactactttctcaagctcaagaggaaaatcagcatcttccacaatgatccttggtaaattatcacgaacaaaatgggcagcatcttttccaccatgcccatcaaagacctgatagtggaaatggagcaaagacttaattcacataaacgtgctatgattagtagttttatcaaaatacagaagcagaagaataagaaaaattataaagccacttattgaacattaaataaaaactgagccccaaaaatgtgatagtagagtaactttactgagatatctcgatttcattaaaattgaaacagtgaagaataagatcaagttctgtaggtgtgagtatggaggatgtttggatatgattggttggatagtccttaagaatgcatacaaatttgttagtaattgtactcctgttacactacacaaataagctgggtcaaaaaatgcagatggcatgtttattttctactatgcgcactacacaaatatgttactactggactagcgtactggtctactggatgctattgatatgttactactgaactggaagaacatatatctagttctgaacaaatctgacaaaagtttctactttcattcatgacatgctagtctctttttagctgtaagtttatgcacaaaaaaaggtaggtactcatttggtcagtcagaatcggggaaacatacaaatgagcgggaaagtgcttaccccataaaaggaaatagcttcattatccaccgattgataaccaaagttcttagctaggtcagtaatacacacatgggtatcttccatgtattgacgacctccaatatccgaccaatccccagatcgaatatttgggacaaaattaccagacttattttgcttgaaatcagcagctgtagtgttctcacaaactctttccatctgtccaaacaaaaggattaatgctagatcaattaatttgtactggaaattcagagctggagcaattaataggaaacaacaactctaatgaaaagaggaggcaatactttgctacaaagttacattctttaaaatgcttctttagaaacgtggctagacaagttatttcaaaccccaattgaacattttatttatttattagatgatttactagctaacgagtaatgaatgaattattcattgagtgtcaacggccgataaatgtaactccagataacaaaacagaagattaagcacttggggtaacatcacataagaaaagatcccatagctgctactgcctggtgtttgctagatgcaacaaatatatcatcaaaaactacacgcttcagcactctccatagcaaaaaattaatgccgcaacacttatgatccaacaatctcactagccatagataattaaagccaagcagtttctacaactgatatgaagaaaaaagaacacttcaaagttagcaaaccacatggatcacttcaggaaaaatgtgcccttgggtgagagagaagcacaagaaccactcttttttcctcatttcagtcaagagagggaaataaagtaccatgtacactttgcaggtactacctctttcctgttctaaagcacgtgatgattgtttttgccctgtttggtaggtacaacagtctgaaattagggcctgtttgggaaacagggacttattttaagtccctgtcacatcggatgtttatacactaatttagagtattaaacatacactaattataaaacctattctataaccttggactaattcgcgagacgaatcttttgagtctaattacaccatgatttgacaatgtgatgctacagtaaacttttcataattatggattaattaggcttaaaaaattcgtcccgcagattagctttcatttatgaaattagtttttttattagtctatgtttaatactccaaattagcgtcaaacattcgatgtgacacggactaaaaagttttagccccatctaaacacccccttagtactccacaatgaacaagccagagattggaagctgcgactataattatatatattcagtacaaaatcaaagtaccaatgaacaatgcaatgaacaggtgaccaataacgtagtattagtagtagtatcatcacacattggcaagaagaacacctaccaggccaccaaacttcgcagctaacaaatgcagaaaacttaactcctccacacacacgatcagtctaggcacaatcagtactagctagcagtaataattaaacaagaaaaaagaatcacaatcacttctaataatactccatgtgtttcaagaaacggaagaggcgtgtgcacaaagcaagcacccagaagggcatgctttgcttccttccttccttccttccttcccaatctcatcatcatcgtccttccttccttcacgccatgaagggaaatcaaacgaacctaacgaagaagaaacgccccaagacaaagaatcgaatctctcgttgcggaagagagagaaaaccaagtagtaccctactcacccgaggcgaggggagttcgtcggggctcttgctcttgctcttcccggcgtcggcggcggcggcggcgggctccccaaaatccagcctctccgcgccctccgactcctccacgcacataccggcgcgccgtacagggcgttcttggcaccacggagctcgatcgatcgatcgcgcaactgggcgccctgctgctagtggtatattgcagctaggagagacagggaagagagagaatcggagcaaagcaagcacaagctactactctgtaggaggagagagagaggggaatccgaggaggaggaggagattcttggggaatatctgcggagaaggaaagaaatgggagggaaatggaggtgggtgtgtggtgtggtgtgggggcgagagagggaaaagctttgcggtggtggtggttagttggattgatggaggtggattgcggcggcggcctggaatggggggttagggttagaactgcacgaatcttaaagctaatccaacggtctagggactctatcgtttcggcatattttgtaaatgggaaataattactacctccgtttcatatcataaggcgttttgactgcttcaactttgtagaaacaaaacattttcaacccaaaataattttatcataaaaatatatttatttattgatttaataaaattaatttgatattataaatattatatatttatctataaacttagtcaaacttgaacgaccatgaccaaagttaaaacgtcttataacctaataaataaaacttttatatgcgtgttcttagtgatctaaaagcaaagactggaaaataaactacaatgaaaaaaccctaaaattaactctaaatttaaggttgagattttaatttttgatttataagcatgagtcaaaagacgaggctgtagaatttgaatttatgaggtatttttctgtcaaacgccatctagacatttatttattttttatgatgatggtgagaggaagagaagcacgtgggcgtagaaacgtcacatctgacgtggttgggctttgggccttccattgtggacctcgaatccgacgacaatgccacaatgctgccgtaggagagcgagaggaattaaatttaaaaaatatatttatcttttttttagaaatatgcggatgtaattttttttttcacaaatacaacgtcgtcactgtatggaaatgtaaaatcaacacaatattgctgaactattgtgcgaaaataacgatggtgtaacaatgcggacggtctcgtagactgaggaagcgagactgcgcgtggacagtgcgagaccgagcaacagccatttgggcatgcccaaaaagcaacagcattttgggaaatgattaattagtgagttgattatcctgattaatcactaataatgctaattaaaataattaattaattgctaatgatgctaattaatctattaatcatgctaatacggatacaaagtcacggtctcgcgcctcgccctgcgagaccgtgacgcggcaccgtcgtgcgacgacggtatacttctgcaaatttcttctaagcgtgtatatttatgtaaaaaacatacatattcatttttttccaagcgagagggtgtttattttgttcggtggctaatgtgccattttaaatcacacgaatgaaaaaaaaagaagaaatagaaaaatatatgattctaatataaatagaagtataaaacagagaattgcaaagacataagaaagattatttgattgggccttacgaaaaatataggattttgataagagatatagacttaaaggaaatgtttcaagaggtcagagctcttgctaagttttctacaaaatctctgtatgattgtctattccataggaatttcaaatgataggataattcaatcctctctttcaacagtctttataggaaatttttttttaggattgaatcctctaaaatttctatgttttttcaataaaccaagagagtacatgtatatatgtcggcatatttttaaggaaaaattagtcaatatttcatttgatatatgaatggtagtaattcataatcaactggtgaacaattaacttgcatatcatttaaaagttgtcgtttacccactcttttcctagtttagcacttacatgctagttacattgtaattaagatgtaattgagatataactataatataattagaatgtaaccattaaatatgcaatgtaatttgtttgttgccattcacttcatgttaagaaaatcggatcaactgaattcactgcattaggcagtgagaaacaagtactaacattcattgcaagaatagatcaattaatttgtaccacatgcccaagatcaccacacatgttgttccaatttaattgctagtgttccagcagaatcggttcatatctgcgttgctcctgcacggatcgcagagaatcaagtggctcaaaatcaactataattagggcaaatatctgtcgacataaatttatgtccactacggcatatttgcaaacgaaaaaaaatttgtaaataaaactttatatacattttcttagtgatctaaaagcaaatgatgaaaaataaacttcgataaacccccccctctaaaatcaacttcaaatttaaggttgagaattcaaattttgactgataagcatacacataagtgaaaagatggagctgttaacgaaacctttatcaaagagtgtcatggttatgaataccacatacctaatagtagttgactaaatctcggcaggacccaccacataccatgtcttatacggaaactgaccttgagggagttccggataaggaaagacaaccagagttctacatggaaacgacaaggactactcggattgtatccatattggttttcctagttctacttgaacaatgggacacctatgggtataaatacaagcccccctaggaggacagggggacaaccatgatgagacgatcaacacgatcaacgacaaccatgatgagacgatcaacacgatcaacacccaccatgacgagacaatcaacacaatacacgggacaacatacaagccaacatacgtcaagacaagccgccggatatcgacatcagagatacgcctggatcgaccctatccggtaccttcagaggccggccgtagggatctagcactgtctctgattccgtcgggcgcgagttcgaggaggaaggctaccctgttgtcgactacaagtcagaccttcagaccgccatgtcgacaacagttagataggctacctcacatattgtactggtgtgattatggtgaataaaaagcaacatcggctccggccaacaggatgtaggggtattacctgatcgcccctaatcaccatcctacatccaactatacattaggagtatttatgaaagggtattatgggttttttcttctaactttaatacatgctaaacattttagaacgacaagtccacaagtttggacagaggaagtacttccatctcatctcaacgtgcgcagtccgtatgtgaaaactgaaaagtaatcattgtccctccctaactatttgcatctttgcctgttggcccgttaatgtacgggctcccaggctattaattatataggctaacttgtacaacatactagtactacctcctccatcctaaatacttctccatcctaaatacttgtcgttttcagttttcgtttgtaatgtttgaccattcgtattatttaaaatattatagaattattatttattttttttaacttgatttattatcaaaagtaagtatgacttatcttttttatatttacactaattttttaaataagacgaatggtcaaacgttacaagtaaaaagtcaaaacgacatcatcagttcaaaacgacatcaccagtctgtaatgtttaagcaaagattgaattgcacagactctgaacaaacaccagatcaaaatattctgagaaaatgggtttatcttatcactgtaaatatgctgacactaaaatgcagacaagaaaacaaccacccagcattatcacaagctgttggccacaacatgatcataaaacactagtatgtgcctcgcgcgttgccgcgggacataatgaaaattggttattataagcatggagtgaagcacggaaacaaaaggtattcatgtagattttgaaatataaatccaacgtcaaagctgatatgattagaaactgcagtgtcgttaatataaatgtgaatacatatatttttaatatttcacatgacaacaaaaatattactggaagtttacttactaaagcatataatatatgtaagatatgttatttcatcggacaaaaagaactgatgacggtagtcagttggcaattaaaatagttatattatttacatggcaggcatacaagtgagtgagacaaataatttatctcgtagaacactcttgcaagccaaaaggtacataatagggcatagaggtgcattgatatattttctagcagaacacctgctgatggaaaaatgaaatttataatgatcattgagatggctggatgcttggttcttcgtatgatggcagctgcattatagtatgattatgagcatcagccataatcaagactggtagcatagtgaataacagattaatttttaagtaaaataggtatgtgtgtgaaacatccatatacagttgttgaagtggctaatcacattgaaacagggaaaataatatcatgtgacagttgatgagatgacaaatgaagtggtaagacatgttatgaaacatatatatggatggaaaacttgatgaattatagcatactatgaacttgtaccaagactaaattaataggaataggtgtgtgatcaaatatgatagactacttaaaagcattagctgtgagagaatctagatttggtgtggaagattttttttttcttttggcaattaatgcaggaatgcaaggatcttcaaatttatataggtaacctgtaaaatgctgtaaacttcttttcacattgaacttgtttagtggtcagaatgcaaaatataaaaagaggaaaacaaacttacgaagaaaccatggataccagaaggcatatattagaggaaagttgagtgtgaagatcacataaaatagacaggaaagaactgaactattgtaataataccaactgcgtgctgctttgacaaggcagaggtttcagataaagaatcctgcaaacaatgaagataggtaaatttgacattatcaaaacacaaagaatataatcaggtcaagttagtaggtctgagaaaaaagaacctaggactcacattgggggcaaggcaaccaaacacaacaaattaccaataggtagaacacgtatgcttgacttacctgtaatcatgtatgcattccttgttgatccagatcgttaaatatttctttgtaaacaacattgtgagtgctggtcacatgctcagttggactattctcaattagaatacgaagaccatcaggcgatgttacacgtgagagtgcgacataaagttgtccatgtgaaaagacagggctaggtaagtagacacacttggtttggaaccatcccttcgaacatgtttcccttaagcaatagtattcgtaactctggaaaagtttcatctatacatcttgggattgcaccactgaattggttatatcgcagatccattgtcttcaaattagcaccgaatggccagacaaggggaaatgttccattcagttcattctcacttaagtggagatatgtcaaattgggcaaagaaggcaaggggccagacagatggtttttggacagatcaagaaattgaagattcaaaaggctggatagacctgttggaattgatccagttaaatgattccctcttagattgaggataaaaaatagatgatttgaagctatgcaatttggaatggatccagtcaacttgttattgctaaaatcaaccacaccaagattcacgttggtgcaaatgctagtaggaatctcccctgagatattattatcgtttagcactagatgattcatcgacatagttgtaggaaaactagcagttatttcacccgatatgttgttgtaagataaatctaaagttgaaagattctccaagtgactaacggctgaaggaaatatgccttgaaaaaaattcttcgataagtttaggtagctcaaattagggaatgtgatgttgatgtccacaggaaggtccccgcttagcctgttataagatgcatctaaccatgataagttctgatttactgtggaaggaagaatgagtgatccaacaaatgagttatgtttcacactcaagtatgatagatatatattattctccagtaaccacgtcgggaaatgaccacttagattattgttcgaaacatcaattaggtataatccgtgctggtgtgataagaaacttggtacaacaccagaattggcattcaggttgcagtttgatagttcaagaacctgaagctgactagatatatttgcttctggattctcagtttgcacttggaagctggcactgttgcttgatagtctcaggtatttcagttggagatgatttgaaaaagagtttaggagtagcagaccttcaagctggttatgggaaagggaaagttgctcaagtaacgtcatgtttgcgaacgaaatagtggggaaccttgccgttaagagattatttgacagatcaagtactctgagaaaagttagatttctgatacatgatgggagcaccccaaagaaaaaatttccgtttagatgcaattctcgaagacttgtcatattgcaaacagctgtaaatgaaatgaactgtgtgatgtcagtacatgattcctacacatagctgctcctaattctaggctatgtttgcgagtactcactccgtcccacaatatagcaacctagtactagacgggatatcacctagtactacgtatctggacagggggcttgtccacatacgtagtactacgttgctatattatgaggtggaggaagtacatactaatcattgggaactgggaagtcatactaatgtttcaaaatagcataaagagcagagttaagtaagatttctttgacatgactatttgaaagaatactcccacaaggcagcaattaaaagtttttgcccttgggacttgggagcttctggttctaaactactgaagttaagcacactgtggtttggagttggtgtatctactttgtgatcacactaaatttgaattattttatcgattgaaggagaacaagatatattactaccataataatcatgtacttaaatttggtgccccaatgtaaagtgtaaagttattcacttttccaccacactcacatcggtgttcaaagtttgaacttcaaactgcatgccattaatttgtaagcgtggctgagattattttgaacaacgtagaaacagttgtaaaatattggaaccatgacacggtcatttactcatttactattgcacctttatgctttcacaaaaactttaaatgagatgccatacctcttgatatgttcccgaaaattccattccaacttagatcaagaatatccagcttcattttgcttaatcctataacatacaataaataaaccaaaataagagataaattccgaaataaaaaatcttttgtcaggaaaaaaactaatattgaaaatacaagcatgtgtgatgcttactttggacagtaaagtcattctttatggcgttcccaccgaggaatggggaacgcagagatgcaagtccaaccaagggcatgatactactatcattcaactcattttcagatagatcgaggatttccagttggcgtaaattagaccatacttcaaaacctgcagcgaatgatgaaaaacactataaatatgaaaattagtaaaaataaagactaatgcaacaggagttatccgactgcgtgcatacgtatgcacctacctagagaaggtccaacaaaaggacaccaaggtgaccattttacctaagcatcacacaccctagggagctccctgatcccttcctcggtgggtcacagggacaaggtgtttacatctagcaagacaaccttggtgtggtgaaatccaagttattctgaacagagacttcttagttgctacaacttgcggcccaacgattggtaaatccgtaaatgagtgattttaaagtcgttgagaaggtaccgaaagataccgtattttctactgtaaaattttgtacctctcagtaccggaggtacggaggtaccaaatttgcactaaaaattgtggtacctctcaaggattgtaaaatttctcttggtaaatatataatatcaatgttcctaaatgccttcttcgatatgtgaaacagcttgagggaggagaaggaaggaagacctgctgacctgcaccaggcatgcatcccgcgatgccggcatttcccaaggacaaattctgcagctcacggaatggaaggaacatactgcagttgagtaggccataccacgacggataagctgcatcaagatcaagggccgtgacacgccctgtgatggagctgcaggtcaccctctcccaccggcagcaatctctgctactccagtcaggcggattgccagccggccaaaggaacgcatcgcaaatgtccataagatgtttcctctcttcgtgcaaacaactgtcgcagaccaccaaggtcagcagaaccaagcaacaccaaatgcaggggttcctcatggccaccacaattcccaatcctcaaatacgctagctctcaagaaatttaacccacaggcaccgattttatactgatggtctcggtgcatcacactcaattaccactaccagcagattccacactccccatggtggcatcaagcaggtcgctgatttcgacggtaatgactgcctacctgaaatgaaaagaaatcggtgtcagcatcggcctcgtgactcggcgtcaaccgtgaagctagccagcccgcgcacattatctcttagtagaagaaaagcctgagatttctttattccagcaagcgagtggggcttggacttggagtcttggataagtggactgccggcatgcttgctccatggtagcaatgactaaatccacgagaaaataataataataataataataataataataataataataataataataataataataatataaaaaaacaaagtagtttcctcggagatggatcggtcctggtcatctgcagactgctcacttttggacccaaaacctcgcattggggaatagcaatcagtctggtcatccaccttcataaaaaaaaaaaaagtctggtcatccactcaaccagcccgttcttgggggcaacctgcaggaccttgcatcatcagtaggtcgaagttgctgtgaacggattaatggggaatacagagcttactgcgtcgacgccatcgtggaaggaattgaagaaatcggcgccaacggggagggttgaggccggccaggggcaccgcggggcccccgccgccggcagccaggaattggccttcgatgccatcgaggaaggaattgaagaagttggcgccgacggggaggggtcgcggtcgatgccgccgccgccggcaaccagggcagcatcggcatcggcgtcggcgtcggcgtcggcgtaggggtggcgttgtgaaggcccatcgtgtagaggcctaatattgaataagtctattttgactccttcaactcttgccattgctcgaatctcatcactcaatggcaaaatcggttattaaccaaacctcttcccccacttaaagggactaatgcaaattgactccttcaatagtttgggaaacggtttttattggtgtcaaattgactgacacggcagcctagtcattaggacattcacaatgtagtgaaaaaggtgagtattagacattaaaatattcttactactaagtaagatacattgtgaaagtagtaaatagctacgactaaaccataagcttactaccaagttataagtattttgtggtgggacctacctattttttaattgtggcatgactcatgtttgttttttttttaaatgggctccaccttattacccactttacacatatatatacattgtggtgtatcttcaatctactactacacttgtattgagatggagagagtattaccatcaattcatcaaacataggcccaccttactacctacttttgtaataaacattgttaatgcccttaaagaatttaaaatagaagtgggttccatgtgcaagtgacaagggtaaatattaaaaaaatgcaggttccacttgtcagcacttctccttcctccggcagaaattcatcaagaacctgtagaacattttgattgtgtgccgtgatattggacaattgttggcccgcccaaaaaatattggggaaattttgtacaaaaatgattccatcaaatgtttgcttgccaagcatataaccgacgatgtataatccaggtctccaggattaaagattgacagtcctcaaagaaatggcgtatttctatcatctacaactcttcctaaccatctacagtcctcaaaaatcagaaaaatacaaagactaatgcctcgcactgatcttgctaacaatctcatcttttgccagccgtatcaaaaacaccagggcaagtgatatggaaacaatcagcatgaaaaatacgctgttccatcctcttgttgaaatatacccagttaacaagggtcccaaagccgccccaacagaacccgtgccatcgattatcgcagacactgtagccaaagctctcgagtttcccttgattgcatcctgagtaccaagatcagtagcaacagctgtggtgatgagtgagtatgggccattcacaaagtagccggcgaggaacatgagcccaatgttgtggtgcatggatatgcttccatatgtccggtaaaggataagcgcggggattgaaagaaaaaggaacagagctgatgttacagcacgagcacctattttgtctgagagcaaaccagccgaaatgcctcccaaaactcctccaatatcgaaaacaacagacaaaattcctgaagccttgtgtgataagaactgacctgccacagctgcaaaatcaaacataggatgttgagtaaatagaacatgctcttatgtttgctctaaaatgatagatatcttactccagacaacgagaacagaaataatgctaccagaaattcacaaaatcctacagatagaagacaaactttcatttcatcatagaagggcatagttatgcttaataagctagattagccacttgcatcaaattctattagttctttcatgcctctagctggaaagctaggttggtaatgcatagtattttcaatcaacaactaaatggtgcttccacatgcaaagatccagtatcctctagataccctgttcttttcagcttattcactggattattgaagcggattatttgcttcacgcttcaaaaagtaagttctcacgaaaacttattctactgcattgcttagagcacttgttttaagctatttgataaatttatttctcaaaatatttaatttatccctataatcaagtagataatgcacaataataattcactcactaatctaaatcaaacaggggaacataaaccacggtctcataaatagaacttttgttttttgaattcaattgatgtattgatgatgctacataactatctaatcatccaacaaatttgaatcaggcctaaaacccagcatcttgaaacttctggcatcaacataattccaagcctctagagtttgacagcaaagttagggctcaggatgcaaggttaacaaacttgcagcgcagatagttgagttaaacccattgctagagtgctagacagtagatactatcagtcttcattcggttaacggtgattataaaaaactagcatcaagcaataagatcatactctactgattctcaactgaaaaattaagaaatagaatgtacttgaagcatataggacataccattgtgccggatatagaacggcaaccagtaaaggaaggtataagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41836 - DNA, 960 bp, Oryza sativa
cgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgccggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagta

SEQ ID NO: 41837 - DNA, 37955 bp, Oryza sativa
  unsure (1)..(37955): unsure at all n locations
tccgtatggtgacacttttgtttgtttgtactcttgtgcaggaatgtgttagtaattcgcttatgaacatttattacttatgttgaactaattatttatatgtttctgatcaatctgtttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttccaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggactgtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgttgttgttcgggtgggtgatgttcactagcacccacgggcacgctgtggacttccggctggtccactacgcacggttcatcgcggatgctcagccacaggacgtgccacagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttcttcacataacatgtctaattccgatcatgtttattgcagcgtcgttacgctcacgtccaggtgagacgaggttacccggacttcgtgttcgagtttgaccgtctcctgccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcatgtgatgagacagttcggacttaggcaggtgtttccgggcaacgtgcagccgaccgtcctccttgccgaccactcgtgagttcggattgttcatttctaaatttttatgataattaagcgatcatcgagccatataatgtacctctcttcacatgttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccatggacgtcgtacctccagctggtccggtgcaaccacggcctcgcgtgcctaccgtcggagcaggacctcgacctacggcacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcacttccgcgagctccgcaggggcgttcgccacctcttcgggcgcgttcgccagctcttcctctcacggagcgtcgatccctcgcccacacggtactttactttttattaatactattaaatacctgtatgaaactgatagtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgagttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacgcactttcggcgcttcatggtagtgtcagatccagtagcgcgtacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacataatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaactatgccctaaaaaataataaaattgtattttaccagtcttggagattttaatcttgtatagttttcaatataaaaagatttgataactattgatatttataaaaaaaaatatagcacagtataaaatcgccctcccccagggcagcaagggggccgcctgcaaaattccatgccccctcgccgcccatttgcaggcggccccccgcacagtacaaaatcgccctagcggagggcggcaagggggccgcatgcaaatttcgttgacggccgtcgcccgagagcgaacggccgtctgccacgtcattttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcggaaaaagtgcaccgaaggtccctcaacttgtcagcgagatacaaaatcatcctcgaaccgcaaaaccagatatgcgggattccttaactatacaaaaccgatcatacgagattcctcggcggtttatagcggatgagtcagcatgggacccacgtggaacccacgccacctcatctcttccctcttatttcccctcttctccctttctctctctcacttttctcagccggcgacgggcggcgctgtgggggaggaggccgccggggggaggggagaggagaaggtccggcagccggcgtcgcgccggcggaggcaacgccgccgtcagcatcctcccttcctcctctctctctctctctctcactcttttctcctgttggaagccggccggcaacgaacatagtggcgcggcggcgccaccggggagggtggtgctgcgtggggcacgcggcagaggtgggcggcgccggtgccgaggaggaggaggtcgtggcactgtcgtcgtcgtcgtcctcggcgtcgaggaagaaggtgggcgcggcggcggaggctagggggttgccgcggctggtgcggtacaaggtgctggtgctcgtgctcgtgctgcagtttctgtacagcaggcaggcgtcggtggcggctcccaatagcgggccgctcccggggtgcggcgcctggggttgctggcacacgcggtgcggcgccgccgtcgacctcgccctcgacacgctggaagcttgtgtacgcgtcattctatcttgggaaacatggctgcagtgctgcacggtttgaacttcaggtttatctggtaaagatcaaatggtgaactgaaaacagtaggtgtccatcttgttcaggcagagatgtgtttataaacttcagaatctgtattactcctggtcgaggtagaagttgatacttggaaattggaatgataaacagatgatattctcgttgtttatacacaggacaagctacaggtttcgcagaattaaaatgcatacgaatgcaaagagaatttgtcctctgcttgcaaggggccaatgatatatactgtatgagaagaccaacaaaaagattcctgtaagagattctgggcaatgttcagagttcagagacttgcaaactctcagatgatggacagtgtcatcgaccataacccggtcagaatgtctctataccaattttgcacaaatctgacgacgtgatatatatcataatcgagctgaaaagattagcattggctagttacaaacagcaagttgacaggctataataatctcatactatactcctacttgaaaaggattcaaaagattgcttctttatactgtactgacgatggtagaactgtactacagtatagaattcagtctaggttcttcagacttgccaatggcttgaacaagaataaaaacagagacatctttcgaactgaagaagcaaccatcaaaataaaaaggctcgtgaattacaatatattggagctgaagaagcaatgttcagctttccatccacactagccgcggcaaccccctagcctccgccgccgccgcgcccaccttcttccccgacgccgaggacgacgacgacgacagcgccacgtccaagtccgcctccggtggttccccggccatcccgcctccgacaacggcgccatgctttccgccgccgagggatacgacggcgaggaccgcgtcagcgcgctccccgacgacctcctcgtcgcccgcctcccttcaagggcgcgactcgcaccgccgcgctcgcctcccgctggcggcgcgtctggagctccacgccgctcatcctccgcggcaagccccttgtgcgccggcgtggagggccctaggggcggcgaggtcgacgatggccgccgcccacggcgaggtccccgtggaggcggtggtggctagcgcgtggaggaagcgcggcggcggcggcgctggtcgccgatctcctcctctccgccgccgaggccgtgggcgttgcagccgtcgaccgcgccctcgccggtcacccggaccccttccgcgtcgtgcaccggtccgagctcgcagagtcctcaaccatctgctcgcctgcaagcctcgcgctcgcgctcaacagagaggaggaaccgaggaccggctgacatggcatcctgatatatgggacccacgttggtcccatgctgactcagccgccacatagaccgaaatcggggtcaaaaccaccgaaggatctcgggtgatcggttttgtttagttaagggactatatatatatatggttttatggtttaagtatgtttttttatctcgctgacaagttgagggaccttgggtgtactttttcccccaattaacacggtgcacgacacgacacacggcgcgattgtactttacctaccgtcccctctctcgatcggcttacggacaatgcgtatgacgcacgcccggattaacgtcagttgtaagtcgatggtcggccatgaatctacatgtcagtccagacgcacgaatgcatgactcaggtccagttcttttcttccacaagacttagataaatattaagattttcgtgacacgcttttcaaactgttaaatgataaatgatgtgtttcgtacaaaaactttttatataaaagttgcactaaaatatcatattaatctatttttcaagtttgtaagaattaaaactcaatcaatcatacgttaatagcatattgttttgcataaaaacttaggggctgtttagttgatggccataagttactacactttgccatacttaaggttagacaagtttgaccatgttagatgattgtttggttggcttccacaagtgtggcaagattcctcttttgtaatctaggtcccacatgtaagtgtctctaaaaagtgtggcatggtttcattttgttggctagagtgtggcttggattttgatggcctcatctttggcaagtttggttaagaaagcatggtaaacctagtcaatgttagtatctgaaccaaacagccccttaatctccatcttcatcttcaatattcaaacaccaccgtagtattgtgtagtactctaccagctatgcttaccattgctgagagcagcgtgatatgacgatctatttgtccactccatattgacacttcaatcaaccacccaactcgcaccgcaccggttttattttataataaaggtgatattctggatatagtgctcgtcagaatgtttcttttaggaatacttactgataagcacgccagaccacctcactggctcactacacaaattgaactctttccaaagaacagcaacaaaaataaattcatcgtcctcttcgtcatctgggctggagaggttgtagcgaccgacgacgacgatgtcggcggttgagaggaagacggcgtgcgtcaccggcggcaacggctacatcgcatctgcgctcatcaagatatgctgttggagaagggatatgctgtcaagacgacggtcagaaaccccggtgaggttctcctcctcattttttcactctctaagttcatgttttttgcagtgtttcttccattcagttcaggtgtgaaatcataggccagctagtaccatatgagctttttagcgagtgttttcgcttaaccaattagcaaatggcaggcttagccgcacatgaggacaaaatcttatccttttccaacttccaactgatagttacatatatacatatcgtgacatatgatggatcgaattattatgagactttatatgatctcaaaaagatggtgtgaattttcagagttcagtttcacctctcaaagattctactaattgctgcgatttgtattcagatgacatggcgaagaactcccatctcaaggacttgcaggcacttgaccccttgaaggtgttccgtgctgacatcggcgaagaaggcagcttggacgatgccgtcgccggctgcgactacgccttcctcgtcgctgctccgatgaacttcaattcagagaatcctgaggtgaaaagcttacacccttcgtcttaaaaaaaaaaaaaactaatattacctacaaacctgaaaacatgtgtctatctaagattgtatataggaatttatttttttttacaaggtagtacttggcaccactaattaagatccctactgactacgagatagctagttttcgtccgtttccaatccatgttcatccaactttgatgtgctctactgctctccatttcgtttttttttccgacgttgatggtggcagaaagatttggttgaagccgccgtcaatggaacgctcaacgcgatgagatcgtgcgcgaaggcggggacggtgaagcgcgtgatcataacatcgtcggacgcagcgatctccagaaggccgctgcaaggcgacgggcatgtgctggacgaggaatcctggtctgacgttgactacctgagaacggagaagccgctagcctgggtgacgttcctctcttgacattttcacatctccatcttatccataaatttaagaaaacttttacagtattatactgacagtacaaataatcgaaaaaaatattattttttcctcctgcttcaatataatatagtataaaattaaaggggataaaattgtctttttatactattggtggagggtaattctgtaaactcataatttatagtgaaatactcccaccgtctaaaaaaccatatgtcacattctagcactccctcagtattttaatgtgtgacgccgttaacttttttatcaacgtttaaccattcgttttattcaaaatttttgtgcaaatacaaaaatatctatgtcatgcttaaagaacattagatgataaatcaagtcacaataaaataaatgataaatacatttttttaataagatgaatggtcaaatgttagtcaaaaagtcaaccgcgtcataaattaaaatacggagagagtacgaggttgtgttttttttaggacggagggagtagagataggcattattttcaccaccatgaggtgccgcgccgctgcaaactagcacaatggatgaaaattattaaaataccattgttaatttaataaaaattcttaaaatactcagtatattgtatagaaaagttctctaaatttagggcctgtttagattgtaacaaaaataaaccttaccaagttttggcaatgttaaaattttggcaagatgctaatattatcaaaattttggcaggatttcttatatattgactaaatttagcaataaactaaacatagactttttttataagtttaccaaaaataaatattgtatggttgaaaatggcgtttgcgtttgcaggcgtactgtgtctccaaggtgcttttggagaaggcagcatgcaagttcgcggaggagaacaacatgagcctcgtcaccgtattcccggtgttcaccttgggcgcagcgccggcgccggtggcgaggacgagcgtccccggcatcctctccctgctatccggtgagttagaagcaccagcaccagcgatcaaatcaacaagctagctcccaccaaagtctcaacacttgcaggtggttcttagatcccaccttaaaaatttacaccccgtcacatcgaatatttgaacagctatataaaatattaaatataggctagaaaataactaattacaagattacgactaatttgtgagacgaatctggtattacagtaaacattcgctaatgataaattaattaggcttaataaattcatctcgcggtttattagcgatgctgtaattagttttttattaatgccccaacaactcttacgacaccctatataatatccgatgttacacgccaaaactttaccgcgtctctgaatataaacacacctaagttggcttctgtttattacttctcaggtgatgagacgcatctcgaagtcctgaagcccctgcaatcgttcaccggctacgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttggccaacttcgaaatccaacatagatatacatgcatgctgtgttcgatctgacgagcgagtgatgatctctgttatctttgcagcttcgacgggatgcctgagaaaccgagagtctgctgttcgtcggagaagctgatcagggaagggttcgaccgttcgagttcaagtacacgaatttgggcgacatacttgatgaccttgtggagtaaggcagggccctgggaattctaccacattgaacgaacagctcatgctgctctactttcaacctactcccttcgtcaaaaaaacgaaactaagactggatgtgacatatcctttcgtccaaaaaaacgaaactaagactggatgtgacatattctagtacaacgaatctggacaggtgtatatccagatttgtaatactaagatatgtcacattcagtactaggatggtttaggatggtttttatgggatagagggggtagatgtcacgaggaccaaactatatatgcgcttgtgaaataagtggtctgtgcctttaaacatctcaaagaaaaaaaaatacagtgttttaagatgagcctaatacacagtagataatggcaaaaaaaattaataccttatagggtatcctttggtcttgcatgtcatttaaatagttatatatatttttaaaaaaattaacaagattcatttggatgatacgtaagaaataaggagatgtccattttgagggaccaaggctccgttcatttggtctgttagggatgccacttgtttttttagccgcttcccaaactgttaaatgatgtatattatgaaaagttttaaagcttctttaaaaaaaatctaataaaaccatttgtcatatttatagtaattaatactccctccgtttcatattataaatcatctagttaaaccttttaagtaaagggtttgactaagtttataaaaaaaaactagcaacatgtaaaaaaaattaatttcattaaatactacattaaagatattttaataatgtgtttgttttgttttaaaatattgctatattttttataaacttgattaaatttaaaaaggtagaatagaaaaaaaattcaaaacaacaatactatgaaaatggagaaagtattcaattaacctgacactaataatttagtctcatttagcatttgtgaaaaatcctaaatttctagcaccacatccaaactcagcccaaaagagcttatccggatagtggccatccactttgcccaaaaagaaacgtgctatgcagcctcgggggttccttatttagtgtatatgcgctagcaaagtacgtagtgcaacactttatccaatttcctttcttgttaaaaacttttaactcagatttaaaagcttgcatgtgaagatttgaaaattttcgcattaatatttaaaatttcaagtcagatttaaaaattttcaaataaggatttttaacttttaactcaagatttaaaactttcaaatcaaattcgataacttttaaccatgatttgaaaaaaaataaatctatatttgaaaatttcaactcagaattgaaactttcatttcaaaatttaaaactttcaactcaaattcaaaacttccaaatgaaattgaagatgaaagattcaatttctaaaataaaaaattcgcaaaaaaatagccaaaaaaaagcgcatgagggcgccgcgtaagctttccttcccgttcactcccaggctctcggcgcatggtcgcccattcccgatcccctccctcgcgagaaaattgcatatgtaccactcgtaaaaactggcttcgctataatgccattctcaagataggattcgcccaaacgccactcttaacacgtgggtattcgctggaatgccactttcgggcttttttccatttcgaaaatacttttcatcaatttcaatttttcttggactattatgcccctgagtcaactgattcagtcggactctttcttctcttcgtttcaatctagcgaccgaacgcgagaagtcgagaagagaagcggcagcgacaccggcgccgcccaccaccactgcatcgccgccgcggcgtgcctcaccggtcccgccccccaacagctgcgccgccgcctctccccggtgagtctcctccccagccgccgcctatcctcagcgaaaccctaggcaccgagccggccgcatcgacgcgtacggccgtgctgtgtccgccggtgaggtgctggcggcgcaccccaaccacgtgcttagccggcagtgctcgtcgcagcagggggcgatgggccggatacacatcgtgtcgccggagtcgaagctggagtgcggcgagatctacttcctcatcccggccgcctccgtccccgacgccaagagaaggacgagcaccggcggcgccgccggccacgggcaccacgtccgcagcaagtcggagggcaacgccgccgtcgccgattggttgggcagccagtgcagcgcgtcgccggagacgacaaggatgatgagggtgcagaagcaacaccaccaccaacaccggcggcgcatgagcaccgggagccatgcctcgccgtggcagccgcacctctcgtgcatcactgaggacccctgagcttagctttcatttttttttcttctcttctctgaattcatagtggtttttttgcctcctgtgtaatttcctctggtgcctggtaaatatttttgttcacattttgtgtcaatgatgtgccgattttacattctgaaatcaacaactgtgtataattttcaagcacaaagcgacttctattctagtagtatcttcttgtatgttcgaaaaacattttgcaacttctttttaaagttcgtttgggttaaccaaagcgaacgaacttgctcatacaaaattaaacaagtcggcagctctgcttgatgcgaaattaaatgaaaattaaaccgcttgcaagttatatatatgaactcatgaattgaggttgtatgtcatggactcatggtgtatgtcaccgaggaggcggcacaattgcgcggactaggacgagcggcacagctggggaggacctcggcgcggcggctggagctgaggtagcggtggcgcagtggtggtgggcggcgccggtgtcgctgccgattctcttctcaccttctcacgctcgctagattgaaccgaggagaagaaagagtctcaggggcataatagtctgagaaaaattgaaattgatgaaaaatattttcgaaatggaagaaaacctgaagtggcatttcagcgaatacccatatattatgagtggcgtttgggcaaatcccatcttgagaatgatattatagcgaagccagtttttaatgagtagtacatatgcaattttctcctccctcgcgggctcgcggcccacctcggcctgctagctttctagcgcgcgcgatgggctgcccctgcctgctcggcatcagccccaatgaacacggtgcacagggatagtcacacgacacggcgcgattgcagtagcactgtacctaccgtccgtcccatctctcgatcggcttatggacaacgtgtatgacgcacggccgtattaacgtcagttggatgccgatggacggccatgaatccatcggtccagacgcacgcatgctcctttgactctaccagctacgcataccattgctgagagcgtgatatgacgatcttgttgtccactccatattgacactttaacccagctgacgtgcgtaatcgacgctccgactcaggacctgtttagattcatgggttacttttcagtcctctttcaaatagctgcaaataatctaaaagttataaataggtgagctatttcagggctatttgaaaataacacatccaaaaaaactatcccccttaagaatactaattagggctatttcaggtggggcccactaaaaaatgtcttttctctttatctctctccatgagaaagtgcattaaagattaaatagctcttaaaataacccttggatctaaacaacttgagactattttattggatggctatttttttcttaaaaattagtagtttttaaaataactcttagctaattctctatacatgtctcaatcaaccacccaactcgcaccgcaccggttttattttacaataaggtgatattctggatatagtgcatgatgtcagcatgtttcttttcggtagtacttaaaaaaaatcttactgataagcacgccagaccacctcactagacaaattgaactcttcccaaagtacagcaacaaacataaattcctcgtcctcttcgtctcatctgggctggtgggttgttgtagcgaccgatcgacgacgacgatgtcggcggtcgagaggaagacggcgtgcgtcaccggcggcaacgggtacatcgcttctgcgctcatcaagatgctgttggagaagggatatgctgtcaacacgacggtcagaaaccccggtaagattctcctccttttttcactctctagttcgtgttttttactttttttgcagtgtttcttccattcatatgatcatatcctcggcctgctagtaccatatgagctaattagcgagtgttttcgcttaaccactcattagcaaatggcaggcttagccgcacatgtggacaatatcatatctttcgaaagggagaagttgtcaaatcttatccttttccaacttccaaccgatagttacatatatatatcgtgacatatgatggatcaaaatatgatgcgactttatcaatacgatggtgtgaattttcagagtttcagtttcatctctgaagattccactaattgctgcggtttgtattcagatgacatggcgaagaactcccacctcaaggacttgcaggcacttggccccttgaaagtcttccgcgccgacatggacgaagaaagaagcttcgacgatgccatcgccggctgcgactacgccttcctcgtcgccgctccgatgaacttcaattcagagaatcctgaggtgaacagctaattaacatcactattgactctgatactctgtaactgatgtgctctactaatcttgatttcctttttttttttttttttttgcgatgttgatggtggtggcagaaagatctggttgaagccgccgtcaatggaacgctcaacgcgatgagatcgtgcgcgaaagtagggacggtgaagcgcgtgatcataacatcgtcggacgcagcgatctccagaaggccgctgcaaggcgacgggtatgtgctggacgaggagtcctggtctgacgtcgactacctgagaacagagaagccgccagcctgggtgacgttcctctctcttgacattttcacatctccatcttatccataaattcaagaaaacttttaccgtacaatatatactaatatatgctactactagtatgtgctgccagtacaaacaattcaaagatttttatgaatatttccttgtgctttaatatattatagtataaaattaaagggggtaaaattgtctttccatactattggatgagggtaattatgtaaactcacaacttatagcgaaatactccctccgttaaaaaaaaatctcgtaacatcctagagtgtctagattcgttttactagaatagtaggatgtgtcataagaggttgagttatttaaggacagagggagtagagataggcattattttcaccaccatgagacactgcgctgttgcaaactagaatgaaaattactaaaataccatttttaatttgataaaaattcttaaaatactcagtatattggaccgaaaagttctttaaatttaccaacgaaaataagcttgcacccaattggcaatggcatttgcgtttgcaggcgtacagtgtgtccaaggtgcttttggagaaggccgcatgcaagttcgcggaggagaacaacatgagcctcgtcaccgtgttcccggtgttcaccttgggcgcagcgccggcgccggtggcgaggacgagcgtccccggcatcctctccttgctatccggtgagctagaagcaccagcaacagcaatcaaatcaacaagctagctcccacaaagggcctgtttggggggagcttctagctgctgcagtatattctagaattagaagttgctctaaacagttcagcttttgatttagattataagaagatataattgtaaaatccaaaaaatgaagctgggaaacacaatttttccagattgtaatcttaaaactccaaacagaccccaagtctcaacactctttgcaacgcgtgttacacagtttaagttggctgctgtttttttactactacttctcaggtgatgagacgcatctcgaagtcctgaagcccctgcagtgggtcaccggctccgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttgaccaacttggaaatccaaaatagataaatattgttgtgttcgatctgacgagcgagtgatcgtctctgtatctttgcagcttcgacgggatgcctgagaaaccgagagtctgctgttcgtcggagaagctgatcagggaagggttcgagttcaagtacacgaatatgggcgacatactcgatgaccttgtagagtacggcagggccctgggaattctaccacattgaacgaatagctgatgctgctctaccttcaacctagctgtcacgaggaccgaactggagtatgcgcttgcgaaataagtgatcagtgtttttaaagaaaaaaaaatagtacagtgttttaagatgagcctaatacacagtggataatggcaatgaagtttaatacccttagagcatatccttcgttcttgcatgtcatttatatattttttataaaaaaatttaacaagaatcatttggttgatacgtaagaaattaggggatgtccattttgagggacctaaggctccgttcgttggtctgttagggatgccacttgtttttttagccgcttcataaactgttaaaagatgtatattatggacatgtttttaagtttctttaaaaaatctaataaaaccatttggcatatttatagtagttaatactacatccatttcatattataaatcattttgaactttttttgtcaaacattttcagtaaaaggtttgactaagtttatagaaaaaattagcaacatttacaacacaaaatttatttcattaaacactacattaaatatatttcattaaacacgaccgtgcctgggccgtgccgcccggatggccatctatacatccggtcatagatttggtttttatttgtagtactcgtcaacaactagcatgtgtcacattcgatacttggttgattttttatgagacgaaaggagtactcctcaatcagatatcaaccaaacaaccacccactttcatatcaactgaacagttctgtaaggacagttccgtaaatggtccatccttctttccatagatggtccaaccccgcacatagtgttgcatcctcgtcctaaaataatttgaaatgtttggatcagggactaaaactttaagccatgtcacatcggatgtttggacactaattagaagtaccagaacattagtgtgccggttggcacactttctttatagcccgatacattgtttagcgtgtgtttgaaacatgaaaattttgtaagatatttttagcatttcgttcaacttctatgttccattaaatattgtattctcttgcatatcgttctgagcataatctcctgtaatgttaatttgggattgtgtgttctctatgtttctggtggacgattaattatagatgttgagtttctaacaaatttttgatataattaaatactataaagtattaagaaagtagaaagtaggtggagttaaataatagaaggttctctgaaaaaaatattagaagattaatatttttttaaaaaaaggagtgattgtaataaaaaaaagttacagaaaatcgtaaacttacaaagcttgctctcaataatccataatactcttgatgtccacaaatattaggtggaaggatccaactcctaaatgctagaagtagaatttgaagttaagtagtggcctattgacggtctttgtgttcactccacccctcatttttctaggtcactatagtctgctccactctcttttttatagagcagaaaaaactttgttgagctttagctacagaaaagctggaaggtcctgccaaattgagcactgcgtgtcgtatcactcacctcttgatttaattttcttcatgtcttacttctaaccattctgtcatttttcaactatattttatttaataaatggcattatagttttttcactccatacttatctctctaagaaaaagattgggaatattttatattagtggaggaagtacacttggttcataagatacgatggtaactggaaactgaaaaaaggaggaattgaaatggtcaattgacttggtgctacacggtgatacgatagctgaggaccctgttgctcatattttttattggatttccctttttttttttaataattctgagttttcttctatcggatatttgaatgcctctaggagtgatgttgttgcaaaggactataatctagatgtataagtctatggatctagatactttaactagacttatcttaaattatgatttatatttgagtggttctagaaagtctctatgtttattgcgaagtgatgtacagttagaagcttctggaagctgatttttttttttaccgggtgggaacagctagatgttctggatgctgtgttgttaaggtacaactttttcttaaaagaaactgctaaggtactacttgcttttagaattatcacataacactgtagttttctattttgcttgatcttctgtatttttttccttagacaaaattcatgatttatttgataagctaggggcgccacgtggcccaatcaaaagctggcataaccactggctttagattaatagatagattaaacgtagactaatgacaaaactcattacataaccctggactaattcgtgagatgaatctattgagcctaattaatccatgattagtctatgtgatgctatagtaaacatgtgctaattatgaattgattaggcttaaaaaatgtctcgtgaattaactctcatttatgcaattagtcttgtaattattctatgtttaatactctaaattagcatccaaatatccaatgtgacatggaataaagtttactccctgaatacaaacatacctttgcatctaaataacaaagatttcttattggtgacaactgacaagcatatcctatcagatgaacgtcagtgacagtgactgtactcttgtactcttacaaccgccgtcttcattccagtaagctatttctctcaggaggacgtagtggagcctggaggggacgaagtagccggcggcacggcgatgtcagcggttgggatgaagacggcgtgcgtgaccggcgggaacgggtatatcgcttcggcgctcatcaagatgctgcttcagaagggatatgctgtcaacacgacagtcagaaaccctggtgagattcttcccccttttttgttgttcatgatttcagttacaggctgtgattagtttcatgccaaaattagaagttcaatgaaattagaacgatgtaatgaaaaagttagaaatttatgtatgtaggaaagttcgatgtgacgaaaaagttgaaagtttaaagaagaaaaatgaaatctaaacagggccacagtctttctcccattcagattcaaaaatcttttggtcagaggtagtttatttgctgaactgtcgtcatgaacaatagaaaaagttcttctatctgcaccatatagaaaatctttatatgttccaactgatatagtgacatatgctggaaacgatggatgcaaatctttatgatctcaattctcaagacaacgctacgaattttcagagttcagtttcacatctgacgatcctactcttgtgtattcagatgacatgaggaagaattcccatctcaaggggttggaggcactaggcaccttgaaggtcttccgtgccgaccttgacgaagatggcagcttcgatgaagccgtcaacggctgcgattacgccttcctcgtcgccgctccggtgaatctccagtcagagaatcctgaggtgaacagctagcttagctaattaatccggttttctctaatcgacgtcacagttgacagttgtcttgtgtcatctgatgataagcatgctctttagtctctagtactgaaattaatttgctcttaacttctacgatgacaaattaagctgggtttcctgccaacgtttgatggcagaaagagatgattgaagccggcgtccaaggaaccctgaacgtgatgagatcgtgcctgagagccggcacggtgaagcgcgtgattctgacatcgtcggcggccgccgtcgccctccgtccgctgcaaggcggcgtcggccatgtcctggacgagtcgtcctggtccgacgtcgactacctgacgagagagaagccaccatcttgggtcacattctactcctttcttttttggtcctccatcaaatcattcatatacattttttaccgggctgatgaaaatgacggctggctgatgctagcacaccccattgtttttgcgtttgcgttttgcaggcgtatggtgtctcgaaggtgcttttggagaaggcggcgtgcaaattcgcggaggagaacgacatcagcctcatcaccgtgctcccggtgttcaccttgggcgcggcgccgacgccgttgaccacaacaagcatcccaactacgctctccttgctgtctggtgagagcctgagaaacatacgtcaaatttaagaagctactcttttatttgttcagattcaagatatatcacattttatatttgatttgtttattttagaattaagagagtatgtacttccattatgtgttacgattgacgttgtttctttttcaggtgatgaggcgcagctaaaaaccctgaaaggcctggcggccaccggctccattccggtggttcacgtggacgacgtctgccgcgccgagatattcctcgcggagaaggagtcggcgtcggggaggtacatctgcagcagcctcagcaccaccgtgatggcgctcgcacgtttcgcggcagcaaaataccctcagtacaacgtccaaaccgactggtacatatacacgaactggcactttcagtttcaactttcaagtgactgatcgatcgacacatgcatttcttgagagaacctgatgagccagcgataatctttgtttgctcgtagtttcgaagggttccctgagaagccgagagtgtgctattcgtcggagaagctgacgagggaagggttcgagttcaagtggacggatctggacgagatattcggcgacctcgtcgagtacggcaaggccctggggattctaccgcactgaattgatggttgctccgtcaatttggagttttggacataaaaattctcttgtgaaattgttagtcctcttgtcttgtgaaataagtcattgttgtgtgttacggtatggtaatctctttatgatacggaccctttcactaccacagaacatgtgaaaaacctcttaaggtatcggttttctcaaccgacactagggatgcggcaccaatgagtgctccagcaccaatcccattttaaaaaccacacctttgagaccacttgcgatctataaaaaggctcgatgcatggctggatccaattaaccattattgttatgggctctctaacccgtaaacaaggtggcccatagcaaatttagaataagttcatttaaagtcccttaatttgaatctgattttcgtccttgtactggaaaaactaggtatgatgggtccctcaacttacaaaaccagtgcaaacaagatccatcaccaacattgttctcatttttcgctgacgtggcacctacgtggctaatttaattaggtttttggataacgtggcattgtcgtggcatttacgtggcaatttaatttggaaaataataaaaactgttagcctacatgttagttagaaaaaaataattaagaccggtggggcccacgtgagccccacatgtcattctcacaatcctcttcttccacctctctccccatctccctctcttcattgtatctctctcctctctcttctcctccctccaggcgcaacggccgacggacagcgtggaggagggcggtggtcggtggggagaaggggtggctgttgacagaaaacacgaggcctgggagatctacttaactccagtgcaggtccaaaactcgccttcggatgtgtgagcgtgtcagttgatttgatcctgcaatcaacaagaaataaagacaaaagaaccgtggttaaatctataaatgatagccgatcggccagatgccgatgacatatcatttatatccgagccgatgtcatctgtgtatcgatcggcaatcgtgaatgagtaaggaaaaactaaatctacttgatcggctgtagatattaacgatatataattcttatgtcgatgtatacttaaatcaggttgtcggtgacatgggatcgggagtatcatgactagaggtttgaggcagacacaatcgcccacgtggcctggcaccctcgggggacgtcgggcccgagggtgatgtgttcgccctcctcttagtccccccgatggggtcgggctgcacccccctcggccccgagggccgaggcgccccgacccctcgtgggttttcgctccgcgtgtatgggttaggtgagcacagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggacgagggcttctaggcgctcgtccccagctggagctagcgtgttacctcccagagatggcacgttagccctgatcagatatatgccaggcttcatcctaaccattacaagcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacccagggtccccggccgaaccggcaaaggggggccagcgcggtctcccggtgaggagccccacgctccgtcatctggcgcgccaggtaggggactctgcgagtgatcttctgagctcttgcgctctttcgtgtgcaccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctacgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcggcagccgctgttcgccgttcggccgtcactccttcgtcgactccttcgacccgggaagatctgcgtggggagcaggacgcccgcaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgacggcagcatcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggcaatcggcgaagtgaggccaagaagaaggcccccgccgaggacatcgacgacggcgatgatgacctaggtttccaagagcctggggccaccattgccactgtcgatggaggagcgtgtgctcacatttctcgccggagcctcaaggccatgaagcgagagcttctggccgcggcccctactcatgaggcgacgcgccgggcgcggtggtcggaggttgccctaactttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctccggtcaccttcggtggacccgccaatttccgcacggagcgagtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcaacggatagtcacgtgcgatgaggtcccagtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgtgacttctggaggccggattcatccgcgaggtcatccatccggagtggctggcgaacccggtggtgttcccaaggcgaacggcaagcttcgaatgtgcatcgactacaccgaccttaacaaggcatgtcctaaggatccttaccccctgcctcgcatagatcagattgtcgactccacagcggggtgcgaccttttgtgttttctagatgcatactctggttatcatcaaattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaatgaacccttgctactctacttagcggcgaccccgcaagtggttagtgcggcgttggtcgtggaacgcgatgaggacaatcctcattccgcgcacccccaccttgtgccgacttggcccgggagagagcagggaggagaggcccccgagccgaacggtggcccaaggcccccgacgaccggagatggccctctgcccgcttgtcagacggtgctaggagcccccgacccccaggaaggccccgaggccactgcgggaaggccgcacctatcgccctctgaccccgaggctaaccctgtgccgatttggcccgggagagagcagggaggagaggcccccgagcagaacggtggcccaaggctcccgacgaccggagatggccctctgcccgcttgtccgacgacgccaggggcccccgacccccaggacggccccgaagccactgtgggaaggccgcccccgtcgtcctccgaccccgaggtcgtcggcacagaagacgagtgcgccccgcgaggccgctcgggtgaagagcgccccagggatgcggcccctagcgaaaaggatcggccccaccgaaaggtgcagcggcccgtctactttgttagtgaggccctccgggatgccaagaccgataccctcaggcccagaaaatgctttacgctgttctgatggcctcgaggaaactgcgccattatttccaggcgcatcgggtcactgtggttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggtcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtggcagctggactggggatccgccgcctcctggtgttaggcgattcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcactcctcgggaacaaggcgttgtgcttcttgccgatatccatgaaggcgaatgcggagcacactccgcctcgcgcaccttggttggtaaagcttttcgccaaggtttctattggccgacagctctcaatgatgcggtcgacctggtccaccgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaaacacggcgattcatggatcgaggagttgccagcggtgctctaggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagctttgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgtccaaacgcgtgctagattgagcaagctctcaccaatgtgggagggtccgtatcgagtgatcggcgtcccccggccgggctccatacggctggccatgggcgacggcactgagttgcctaacccatggaacatcgagcaccttcgtcgcttctacccctgaggggggggtcgggtgtcangtttcnggctcgggccaaccccgtacccccccctcgggtgtgcatggttggccgggggctaccacacatgcacattctcttttctcttatttcagtatttcaataaaagcagtttcaatttcctaagggctgtatctgtgccgttttttcctttttgaagaattttgacttgaaataagatcactcgtgctcaaccttgccctcgggggctcggttcggtcagctaaaatcgccaaacggggcccagaaccgagccgtgccctggggcgtggtgaactccgggggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacagatcatcctcatctcatttgtatagcaaagtaaaattaacacaaaaattttcatcatttttgattgcagattaagttgatctatacaaaaaagaggcctgaaggccttagaagaaagaaaaagaaaaaactagagattagcgggggcctgggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttgacggtcttctcgagctcctcggggagctgctggagagccccggccatcttcgagaggtgctgagcgaggcctccctggttggtggagtacttcattgtctggcctttccagaggcccgcctgccgaccggcgcgatccagatgggagactgcatcccaaagcatgccgggccctatctcgcccgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttctcccgcgcctcgaggtcagcggcccgctggtccagtgcggccctctcggcgcggacacattctagattgcggcgtgcctgctccgccagcgctgcctcacggagggacaggctgtccgtcaaccgttgcgccgcggcctcggcctcttcgagagctcgctcccgctcggtaagcgcgtcctcgcggaggcggagtgcagactcctcttcggcgcaggcagactcgtgcgccgccagcgttgcctcccggatggcgacggcggcctcgcggtccgccaggtccttctccacgacgcaggcgcgctcttccagcgccatggcacgcgcctcaagggcctcttcacgccgccggagcgccgtttcggtctccgttgctcgctgctctcgggcagcggcggcatcaaggaccccctgggcggcgtcgagctttttctttagctccgcctcccagctcccgtattgaaggcggagggtgtcctgcgcctcgttcatcacggtggtggcgatgagggcagccccccgctcctcctccacctcttgagcgatctccgccagcgccgtcttacgggcttcaagatctgagacgtgccggcggtgtgccttgcggcccgcttccaccatggcctccaccgatcgccgcccctcctcgacacgcgcccatgcggcgtcgagctccgcacgctccgcctgcagggcctccacctgggcacttaacccatccaacaccgcggtgtttgcggcggctaaggcctgcagaaggggctctgcgctcagcggggcgacggaaggcgtggggaagagctgccttggagaagatgtcgcgcggctcggcccgccaatggacgtgccggactcggggatgttccccggacctgtttggtcctgggcgtcgcccgaaggagtgggcccaggcgacgcgcccgcagcctcgtcgccagctgccccggaagttgtcgcctgagcgtcgcccgagggagtgggcccaagcgatgcgcccgcgacctcgtcgcgagctgcctcggaagaaaccattgcctcgtcctggcgaaatccggctttctcccgagcggcttcctcggcctggtgggctcgggcggcctcctcccgagcggtatcctcagcctggcgagcccgggcggcctcccgggcggcctcttcagcttcccgtaggcgatctgcggcctctcgccggtcagattctcgcctccgtgcctctgtggccgccggatcctcggcctcagattggccagacttggaatgacgggagggacgcgacgggatctcgctaaaacagaagaaaagaccagaagacgaacaaagacgggtgagtgaaaactcgcgttgaagagaatggatacagccacgatgagtgagagatgaacctgcgagggggtcggttgaacgaccactttggaggggagatgaggtttccccgagatggttctgtctcccccatcttgcggagccgtttcttcttgcgctccccctcgggctgtgatgttggcgcggccccctccgggcgcctgctgctggcacgcactgccccgccccctcggggaggagatgggggaggtgttcgtcccagcttcctcttcccccggtcgtcgatagggcggttgctccccgagcccctgacgcggggcccagaagcacgaccccctcctggggtagattgatcccccttgcggctcccgcctgcgccgtcgtggccctttggagctccctcctctgaggccccgactgccgtcataatggtcaagatggaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtagtcttcggacccggtgtactcccaggcgccccgagcgcgccgctggagcggcgcaatccgacgacggaggtagtcgccatacaccatggcccctgtgagcccctgggatcgcaggcccgccaggcggtcgaggacagcgtcatagccatcccccagatctaccggcgcccgccaactggaggcctgcgccgggggctggctcggaagtcggaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtaaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatagcggaaccagccctgccattgcaaaagggagaaagaagacggaccgccccgggtagtctgtgtcgcgaccgggaaaattgccttttcccgaacgccagtgtattaatccccgtcccaggaaaagccggggtacaccacacaaacatggtataaaagacacatctttattatatcgataatatttacattattacaaaggcacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcctcgccggcacggccgacgggagacggcgcgcccgcgccccgatggtcaccgccggcgaccaccggcgcggcggagcggcgcccgagagagcggagaagagagggaagcgaaaggggcggtccacggctcaccccgggacgacgaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtccggggcgacgacggcggcgaaccggagctcggcggcgacggcggagagagaggaggacggcgcgagcacgaatccgacggggagagcgagcggcgagcggcggaaacggaggagagaggcacggggaacaattatatagcgccgggagggagagagagaggccggaggggaaggaaacggccgcggcgatctcgggcgccattgatgccggcgaggtttaggggaaagattccgagcgaatccgagggagagagagagggaaaagcggggggaaacggagagggaatcacggggagtgatttccccctctttaatgcgcgcggggatggcgggatgcggcggaatccgcggcggcggcggcgctagggcacgggcgggcggcgggagcggcgcgaggaaggcgatgacaggtgggccccacccgtcagcgagggtggcgggcgggcccgcctgtcagcggcgcgcgcgcgggggaggggccgagtgggccgcggggaggagagagagggaaagagcgaggtgggccgagccggcccaagagaggaagggggggaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacaaatccaccccccttataagaatctcgtccccgagattcgaggaggctagcaagaagataggttgggcggtcttctcttcttgtccgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccactggacatgctttgacgtcttcccaaatggctttactgctggacttcttattgtctggtcgttatccggccaaatttgaagcttcgttgttagatgtgattttactctgacctctgtagactatcttcgaacatatcacttgtttcataactgggaatagctcccacgaacaagcaactcagattcactttctttatgttcagtttactttccgctattctcttcatgttgtcatcatttagcat

SEQ ID NO: 41838 - DNA, 1190 bp, Oryza sativa
tataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggttagg

SEQ ID NO: 41839 - DNA, 10187 bp, Oryza sativa
acacagatccaccaaaacacaggagtagggtattacgcttctcagcggcccgaacctgtatacatcgccggtgtcttctgtgcttccggtctcgcgaaccttccacatacagattgggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctaggaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaaggaaagaggaaaaaagcaaaaaaaaaaaaaagtaaactaaagcttaggaagtactacggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatggcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggcgctcctcgccggcggagcggcggtggcggtggaggcgaggtgaagcggcgcgtgagcatcgacgacgcgctggcgtggcacgcgggggagttcgggcggtggcagctgcggcacttcgtgctggtgtcgtcggcgtggctgctggaggcgctgcacaccatggtcatcatcttcgccgaccgggagccggccatggtgtgcgccgccggggacggccggtgcggcgaccgctgcgccggcgccggcgccgccgcggggaccgggtgggagtgggccagcgggcgcgcctcgtcgacggtgtccgagtggggcctcgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgccttaattgtggcatcgacgtgagaggcaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaa

SEQ ID NO: 41840 - DNA, 12027 bp, Oryza sativa
  unsure (1)..(12027): unsure at all n locations
actctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctacggagggcggcaagggggccgcctacaaatttcgttgacggccgtcgcccgagagcgaacggccgtctgccacgtcatttttgccgccctctgggatggcgatttttaaaaatcgccctcccagagggcggtaggcgactacttccgtcaatttcaaaatgaaaaattattttgtaaaacttttaataaaaaaattaaaaataaaaaaaaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtggaagttttttttcggttgtttccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccttgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcanagaggcgccgcctangagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccgg

SEQ ID NO: 41841 - DNA, 13662 bp, Oryza sativa
tgcaagtagttcatcataaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgaggggaacaacatcgttatcagtatggcagaatcccgagggctctaccgtactccaagaaggcatcatcgtacatctcgtccagcgtcctgttcttgaactcgaacccttctccggcgagcttctccgacgagaggcggatcctcggcttctccgggaggtcgccgaggctgcatgaaagttcaccatcgtcagagctctcgataagatcatggagacgcatggggaattattactcagtgagatcagctcgatcttacgcggcgacgtcgacattgtactccgggtatttggccgccaggaagcgggcgagctgcagcatggtggcgctgaggccgcagcagatgtacctctccgccgccgccgccgccgccgccggcggcggcttctcggcgaggaatatctcggcgcggcagaggtcgtcgacgtggaccagcattagcccgccggtggccttctccatgagcttcacggtgctgatcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggttcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaagaaaagaaaaacgaggttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttggatctaaacttcaattctttttcatcacgtcaacctgtcatacacataacttttcagccacatcatctctaattttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgccttcgctctgcttgcagcgaggggcattttcttcttgtgttgtttctgcctattgctcaagccaccggtctaaaacgcaatgagaagcatataagtagagaaggaataaaagcaactacgaaagaacaattcatgatcagatttcacaaggttgtgccatatagccaacataggtcaaaataagcaccaaaaaggaggatcatataaacgaatacctttttctgtttcacagctgttcttgcttggtattttcctctatcctctcttccagccttcaccatttctaatctctcctctttcgtaagctttctctttatgtgagcctacataaaggaagatgttcatataagcaaagtgtggatgtgtgtgcatgagcgcgctggcacgagtgcaatgcgggaggggaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttggtcgagccttcggatcagcaggacgcccacgatctttcttgactagcagagaaggacagatctgaacccaaaccaaaagaaggtttagctgaagtgaacaaaaagaaatcacagaatatgcaaaaggataagaactgacctcccggaataaagtaattagagaacgagcggcaatggaaacagctttttcatgggactttttgtataaaacaaggtcctggagtagatcttcattcatcaactgcaggtataacagaaggattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagaccctccgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaacttaaca

SEQ ID NO: 41842 - DNA, 3640 bp, Oryza sativa
catggggcaagcgtcggccatcgggcgcattgggtgtccgccataagcgccgcccccgcctttccccaaccgacgccgcccaacctgatgtcggcgcagcccccgcccttccccaaccgacgacgcccaacccgacgccggcgcagctcccgtccttccctgatcgatgccgcccccgcccttcctcaacagacgccggtcaacgcgacgccagcgccgctcccgcccttccccgaccgacgcctcctcctcccgacgccgccgccccttcgctcgtcggccatggaggtgggagacgaaggtggtgaggtggccgacagcggtggcgtcaccactgcctcatcctcctggcgccaccgctcctcaccaccgtgcgtcctcttcgtcgctgaaccgccgctaccgctcctcctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaaatgagcttttccaaaagccaccgtacatattccccagctacttttaagaagggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgtctcctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaaacgaaggccattattttcctctgtttcttctcttgtatttttctggttgcagcacagacgtcgtcgtcatcgttctatggagtcatgtacaaacatatttaaaaaagtcaacggaaacattttgagaaggagggagtattaaatcagcccgcttgatcgatatgggacctgttttctttttctagaatctatcattaatcagaaacgtacgcttagctagcagaaactggtagtctggtacggcgttctactgtacatacatcttggcaagaggtacaccggtctaacatcgactataccattgtcacgttttgcgtgaactgcaagagaacgcatcactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggttgggctttaaactaacaccagtggcattgggtgtaaataaatcgaaatcggaggggtggggtgggtacccctgatgcgtcagcgttcaaaat

SEQ ID NO: 41843 - DNA, 7419 bp, Oryza sativa
ccaccactgaggaggagagaaccctaactataacccctaatcctgccactaatcccagttcatggcctcctccctcacgccccgtagcccttacccggtaattttctctcttttgtggaaagaaatcgcctattttgggggagggttgattcatgggagcttagttcttgcgatttgtggggtgtggttgttgttgttgttgttgcagaagaaggagaacttgggcaacgcgcggcgggggatgggggtcaagcctggcccgcgccgcaatgtcctctcggcaatcaacaatggcggtggcacgaacagcgacacggcgtcggtggacggcggcgagggcggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttgggtaatgaattcgaatgcacttctcttttttttgtatttatttgatcacaccaagagaacaagatggtactcttttgggttttgagcattcatgtgtgctgtttggtcatcagagtaccatctcatcgtagtgactgagtttattctggtcatttatgttcttggggtactgtacttccagaggcccagcttagcagtgatctggaagagctgaaagctgcacacctgaacttgacgcggcagtgcgattcgttggaggaaagcttcaacaaggagaaggccgacaggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgttcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcaccattatgcttctgctcaggaaacatgtagtatgcaacaagaacagattcaaactttgcagaaacaacttgcagttgcaacaaataaactgaaggttagaaataatattttgtcagtgctgatttacatgtgagatatgattatatgacatttgatctaattgtttacttttgcagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaattttatctcttcagcaccaccacataagcacaaatacatgctaaaagccgtgaacatcttacattgatgtttctagtatatatcacctgcattctgcatttgtataatcaccattatcttgaaactctgactgatgtttctagtttatttcagttttgaagtacttgtcaatttggtatgcttaagttatttttgcatgatgcaggtttgcatatttgcttatggtcaaacagggtctggtaaaacttatacaatgatgggtccaccagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgttggttttctttatgtttcaggcaatcaataaaagcttgtcagctcttagcgatgttatctttgcaattgcgaaaggagacgatcatgtgcccttcaggaactcaaaacttacataccttttgcaggtgagtgacttgtgcaaatggatggtaatacaaaaacctgcaatccctgaatttatttgaaacatatttcttatatcaactttctattgcagccttgccttggaggtgattccaaaacgctgatgtttgtcaacatttctccggaggcatcatccgttggggagacgatttgttcactgaggttcgcttcaagggtaaatgcttgcgagatcggaataccaagacggcacacacaagcccggtccttcgattccaggctgagctatggctgaagttgctgtggccatcatgatgtgatgataatcgatcagcattggggatatcatttggctgaagctgatgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattaattgaggtttattacttcaaatattaaaaaataatttatctaataatttaaaacaacttctatataagaaagttgcacaaaatgcactgtctagtagtttgaaaaacatgctaataaaaatgaggtaaaatcagtatcactgtatcacaatgagaaatgaacggactatgccttttttttttccttcttccaatcgatttcaagatgcactatggttaacggactaggccatactctttttagattactagagtgagctcgcgcgctacgctgcgcggtattgtagcatgtaagactgtaacgcacagaaagaaatgtacgattgcaaggtttgtctaagaggattacctaacaacaacagtcaattccttgtgtacctactaagaacattatttaacctgtatagttttttttttaataactgaagtcgccagaaacagttcctgatagttaataatttaaacaataatttcacaatacatagcaggggtggcaagcatagtatgactcatccaatatcaatgggcacaagatgcagttcgttatgtcaactaactgaaaatggaacatggttaaatttctcgtagttttgtttgcgaggactgcagtattaagataatatctgtaaactctagaactggccaaaaacccagtcagatgagacaatagtattgcatttatcaactatggtatgaaagaccgactacatatttcagattcattagttttaagaagagacttgacacttcactatgagaactttctgttcaagaaacatatccgcctcagcaattcagtcaacttagatcaccaggtgcaatggcaagcatctgctaaaatcatttcttgaacactaagaaaatatgtgccaagttaaatcattcctaagttaatagtttggagaattaacttagcatattgagagatgttactaagtcagtagaactcaaagtttggagaattaagtcagcacatggagagatgttactgagtcagtagaagaaactcaaattaatgaacagatcctcatttcagtcagtgttatgttactaatcagagcagtggactcttaaaatagccatgtaaatgaacttatggttcctgaaaagagacatttaaatgcaacaactgagtatccactgtgaatcaatggacgatgtatacatttacatcacctgtctgattaattagctaccaaactactttgagagttgaatatttgtatagctaaggcagttgtagatgacaaagatgatggatatacctgccttacagtatttcgaaaagaaaaagatcatcatggttaacacatgtgtagggatatttccataggtatttcaaatggttttcctgctttccgtaaaaaaaaaatggttttcctgctaagcatgagcttcaatcttgtcgcagtccttgaggagaatctatatgatattatgaaatatgttaagataaaaaagtgagcgaagtacatcaattatgcaagtgagaaaaggcagtcactactacatcagtgcaggaaacaccaattattcaagtgtgggattgaaccaccactgcagcatgatttttagcttggaaacaactttggaagtgatgtggtggcagaacacaccaatggaagagctatatctgcacaggctataaagaccatattgtttgtgctttgctgcactcaattggcttggcattgttaaactttgcactaggatcacctaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggcggcggtgaatctcgtaccatgtgccgtgccggcctccacccctcttttatatggcgcagtgtgacgggggcccaccagccattgggctgggcgcccccgatcagggcgcggtcaaggccctcttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcaaaaacagatactttacttttgggccctg

SEQ ID NO: 41844 - DNA, 4100 bp, Oryza sativa
cacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctctgcaccgacagcctcagcaaagagttgtcgtcgatggaagaagttgtgtctctccccgacctactccaggccaagcaaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatcctgacggcagcgacgaaaccaacctcttcgagacatcttcaactgagaaggacttcaactctggtgtgggggaaaagagagcaagactgagtactaccc

SEQ ID NO: 41845 - DNA, 8542 bp, Oryza sativa
cggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccagcggcccatccgaaagaaaggaggaaaaagagaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcggaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtataggtagtgtgtactggaataaaatgagcaactttggtgagtcgatccacgaccacccagattgaatcgtgccccgacgacgttctgggcaaacctgttatgaaatccattccgatttcttcccatttccattccgggatctgaaggggttgtagcagtcctgcgggcctctgatgctctgctttgactcgctgacaaacatcgcagagtgcgacgaattcggctatttctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtaggccgggcctctagggcagctacgtacccgtgttctacgatgcccaaatttaggtgctcaagatcttgctgcaatttgtcacacatgacttcggtatatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagttggtgctccttcaatatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttcccccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctgacgaatagccttgtccacaagcttctcaaagtcctcataaactccggagattagctggttggtcaattcatcgtcgagcccaaacaaaaacttctcctgcttctcagcatcggtgcgcacgtcctcaggggcgtagcgcgcaaggcggttgaactcatgcaagtactctgtaactgacatggttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgcccctggcgtcgctggagtcacggggatcattccttgtcttcaccatctggaggggataggtagaaataagagaaaggaagaaaacggatggctcggaaactaatttttcttatgaaattaagtgccattatcttaatctggattaaaacactgaaaaagaggcacacaattcctaattaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcagaagaacaaaaccccaaaatttttcccgaaacaaatccaagtgcaaaaagcatatgcagatgaagaggggttcagagggctcttaggtttccagttggcttgtcctacggtcaaggtcggctctgataccaacttgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaaggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcggcgcgggcggcgggcggcggcgcgagcggcgacgaccgaaagcgacggcgagggcgcgaagagggcggcggcgcacggggaaaaaaaaagaaggaaaggaaggggagggagacctcaccggaggggcggcaatggccggcggagaaaaacgagggaggcggcgaagaccggtgatgccgaggtgcggacgagcgacggcgacacctagggaaagagaggagaggaattagggcggaggaaaacccccacagcgaccatccacgccggccggagtcggaggggagagagaactcaccgacgacgcgagggaaatggggtttcggtggtattccggtgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcgaaaaacgagagaggagggcatggggagcattttataggcggagggggaggcggacgtggccgggaggcgctccgatttcgccggcgacgtgggggaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggt

SEQ ID NO: 41846 - DNA, 1110 bp, Oryza sativa
accaaaaataggagaatggtttccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaaaagaggtgggggaagaacaaggcaaggaagaaaaaacccacagggtggccttcgttgcttgcttgattgacgaacagatcccatgactcctccttctcaaccttcacaactttggaattgccaacccccttctgctgctggatctccatatggcctaagaagcaagaacagaaccctctccctttcactccgtgttcttggtctcctcctcctccttgctcctttccccaagaccccaacaagaagagaacaaaattatcacagactgtctacaggaaagagaagtggcaatcctcctgaagattagataagcatggggatttatattctaaagctggtgggtcctgccttattttggctggtagtttcttctggagtcagtatcctatgcagtacttcaaaagctatgagcttatatcaaccacataaaagatatgcccaacgggaataagggccgtgatgcagaaagggtagcaaattaatagagagcttatctcctagtggaaaaggaatgcttatcaggtgggtactagctctgaaatggtaacgtattcta

SEQ ID NO: 41847 - DNA, 3964 bp, Oryza sativa
tccatatatttcttattgcaataatcgaataacaaagaacaataagtttgtattctcccgctctagagtaataagttttgcatgtggcaaccttgcaataacatccagtttaaagctaccaagtgaacaaattaggagatccatacggaagggaaaacgtagcttgttttacttaaggtagcacacatgtcacagaatcacctcaaaaacatggactgcctgaggttagaagattagtttgctgccattcctagaattcctgcaaagcaagtaataactgtgaattgtcattttctgcgttaactaaaagtagagacgagaccaagaaatttacaagtctggatgtgttcaaatttgatggacatcatagtaacttcatataaaatatctcttactcagaaaaataaataaaaaataaaaaatctcaagttcagtgttacggtttagttgaagactttgatactgaacagaaccatgagaaattaatccagtctctaggagagctttggcaagtttaatcgtttcaacaagatttggggtttaactgctctcacttatgaaaaaaaaaacagctttttgagagaggaaaccctctagaagttcccttgttccttcaagcaggccacgagtccagaatacttgaaaaagaaagataacatgatgatttgatatggtgcgagtttaataccaacaaccctatccattggtggtcctaattaaaaaaaaaagtgatggcaaacagacatgccaaaatcaatcatacaaaaaaagaactaccaaaaagagatttatattccaatcccccattagcttgccaaccatggtgactgtagacggtagatacacaaaacctagaaagaaagggggaaaaaagcaccgatgaattgcaaaaccacacgcaatttctcacagcagtgaaacagaccactgatctacaaagattgaagcgtgcgagctgtgaatcaattggaagtacacgatgtagcatagcgtagcatagcatagcatagcgccattctactcaaaactactacacacgatttacttcgattcgagcatgtgggaagtggtaaaaggagatggaaactacagagggttttaacctgaacccgacaaccaaactccacgcacaccacgcacgcatacggaagaaggatccgaccactccgcgggctggggggcagcaaaaccggggattccggtagggaaggggagcgccgcagtcgcagatgagaagactggtggcggaacgccggaaaaagccgcgtccgaaggcctctgatcttcttgtgatgggctagctggcaatcgcatagtgggggcacctctctcattctcgcttttccttttttttttatttaagaaaatagatttactacttcctccgttctaaaatataatcatttttagaattcatagctaaaagttactgtattttgagacggatatagtcattgaacggattatgcaacggataggagcatatacttgcatataggaataaattaaatattttaaaaaataaatttaataatgacttcctctgtcctaacatggaggatacttccaaatgaatcctagtaatattttgagatagatgaagtagtttaaaataagtgatccggaagaaaatgatctgacacatatattaaatatcttaaaggtgctggattagctatcttaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtaggctttttgctatctcttgtatgaggtggacaagcatgagctagtgcactagctcaaccattgaaggaggccttaaaggtgctagattagctgctctcctagcgatttggagaggcgcatccaatacggtgtggacacgttgtttcgttacagtggtcctgctaccatgggccagctgattgtttggcccagcgaccgacggccttttactggccatcgtggcatcggtggcgcggccttgcgtcgtcgtggtttggctgtatgctcagccatccgcgagccaccgctaccgtcttgacgcgtgcccattctccaacccatgtccggctaggattgagcgaaggctgtgtttctcgtccgctccgcttcagcgaatcggcaccgccgcgtgtcggccatcagcgagacagcgacacctccaaggctccaatgcccagcagcccctctctcatccatggtagtgctctgtcatggtgtacgggaatgacagggttggctgctccactaaaaatacgcgcggagacccccatgaggagcagatcgagggtacctgcatcgctcctttctttctttcattcgaagctggttctgttccttacttcttcctcttagttcctgttttttgtggagacggtactttccctagtcgcatcatcccgtatgctttgatctttttcagttgtgcttcgctctggatttcaccattgtgatgtcgatgttcttctgaccatgcctatgctcattgattttgatttttgttttctgccttctaggttgcgcggccaacccttaccgagacgtggttttactgctcgccgagccatccgcgttgcccccttccacttctcggcatccgctcgtcgtcgtcctctccgcatccgcatctcttcccaatttgtttgttcccctttatgttcttcactgtggctgcacgtacaacaagcttgaatagcatcacatactccccatcccgtcctcagcatcggcgtgccgcatggcatcgcagcgtcgccttcttcttcggcatcaaggtcgactcggtggctcactgctagcacagatggcgggcggggagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcact

SEQ ID NO: 41848 - DNA, 10207 bp, Oryza sativa
tttgggccgaaagtcggcccaaaacctctctctttttctctctctcctcggcccaagccgggccgggaccgagccgccgctctcctctctctcccgctgacaggtgggccccacctgtcagggtcgtcgtcaacctccggccgcccgccgcccgaaacgtagcgccgtgccgccgccgtctccttccaaattccgtcgctcctttccatctccggcgcgaatcgatagaggggaaatgatcctcgcgatccactctatcttttctcttatggaatcgtcggctaatttcgtttggaaatccgtggattcgagttcgattcggatcgatctctctcctccgaaccctaatctttccttctcgtcgccagtcgccgtgggccttcgccgccgcctccttgcccctataaaaggacccccaagcccgccgctacccgtcgccactcttgccttcgcctctcgccgtcggtagcgccctagccccgtgagacctcgcgccgccgtcgtcaccgccgctccagccgtgcgccgccgtcgctccagtcgtcgccgtcgctcgggaaggccgccatcgtggtcgccgtcgcgtcgccgtcctcgtccgcccctccgccgtcgctgtcgaccgccggaacaccgccgtcgtcgtcaagccgaaggtcgccgccgcttcttcctcgacgccgtcgccgtccgttgatcttccaccgccgttttggtcaccggtgaggtagccgtgccgtccgctacctgtgggtgctctccgttcgcgccgccgcgccgtcgttcgccggcgagcatgcgcgcccgagccgccgctggtggtgacgtcgtcgctgacgtcatcgtcgtcgtctctcgtggtccggccgtggaccgatcgatctcggccgttcgttttggatagggtagatctcggccgtccgttccgtagaccgccgctgtgcacccggtccaccgcaaaccctagccgctgacgcaataatcctcttttccttttcaaaaataattctttattgcgtcataattcaattaaaatccatataagtgttttaatccgatttaatctttaaaaattcataactaattcatcttagctcgggtttagttggttcaagtctctaaagttgtataaaataaagatctacatattaaaattatccataaatagaattaaatttatttaattctttttaaatgggctttaattagattaaatcttgtaaaattcatatttaattcatatgaagtcagaatgaggccgttcaagtctcataattcatctaaaattatgatctacatgtttgtttactttatatgtactatttatttggtttttattagtctttttctttgttttgcgtgttagcttgtcgttttcgtcgttgcgaaggttcgtgagtgcgctggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgataccttgggatattataatttgactagttgagctttatatatattggttcaactagatgttagatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacggctttaccttttgtacagcatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacaaccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaagatccagaaggagaagacgtttggcttatactccagttgagctgcctgtgggagtggagctgaagccatcgctagaccgttattccgctgctgttttcttttcttttgtaagtgtgaaacgttattattatgatggatttgtatattaaattgtcagtttgtgtacctcggctgattcctagacgaggattttatgcacaaataagttcggaaattactagtgaatttctgggcgtgacaaaacttctttcaatattgcttatttttaattccgaatttcagctatttttaaattgtacttctacttggactctcctttttctttttttttctttttctctgattaatgtgggaatttctagcccccacagcgaacgtggttcctttcgagctgtcttaataatataatagattttatttttatttcgaattttgattaatctcgtattgggttcttatatagaaacttctttcaatattgcttatttttaattccgaatttcagctatttttaaattgtacttctacttgaactctcctttttattttttttctttttcttcgattaatgtgggaatttctagcccccacagtgaacgtggtgccttcttttcgagctgtcttaataatataatagattgtaattgtatacttatatgcaacttgtgtgtatatggcaaaaaagcgagctggtacagtagtacacagtcgcgtgttttaccatcaacaccatattttgcacacaaaaattctttttacctccagatactaaatatattggggcactaaattttatattagagatatcaaatttatactaaaaagtatctcgaggtataaaaatttgtggtacaatgttgtttggtaaaattatcttgtaaggaaaatatcacaagttcgattttccttgccccggaacctacgtgattattttcttttgcctagcaccatagagttaggctgtttttagatgcaggggtgaaaagttttgacgcgtcacatcgaatatacggatactaatttgaagtattaaacatagactaataacacaacaaattatagattttggctataagctatgatacaaatttattaagcctaattaatccgtcattagcaaatgttagcaccacattgtcaaatcatggactaattaggcttagaaaatttgtctcgcaattttacatacaagctgtgtaattagttatttttttgtttttatttaatacttaatacatatgttcaaacgttcgatgtgacagggtaaaaaattttaccaagggatctaatcaggcccttagctggccagcaacaaatgcttagcagcatttacaatcatggcagcagctaatataaattaaatcaaacatattgtcagcagcaaatattgagtaaacttttaaatggtagtacagtgtcacacccggagttttatgacttcaagaatttgctttggttaaccaggagaaaacccctgttaaccatgcatttaataatcggaattgtcaggtagaaactttttttccaaattctctttgctctgaaaatcactaacaggacttaaagagtaaatattagatcaccagaggcaatgttgctaagttaaaagtgtcaagttagattttttcttcctttgcctttggttgtgaattgtgcctaattctctcccctctcagtccgcagtttcgttttgcatgacgaaccgtatcagtgtcagttcacgggaccgttttcattcctttcctaaaacggcaccgcattgttttttttctttttgggaaagtcctagcccccttgtttcctttttcctccccgtctccctagccagccgcgccctccccctctccttcccgcgcgcgcctccccctccccttgcccgagtcggtctccctcccctccctcctagtcctactcccactacgactccacctttcctaatccaatcctcccctatataagttgttgtcgaaatgacaactgcctacgtcggaagacgtggttactcaacagtggttggaaagaaagtaaagtgtattgaattgagaatttttcttgggatccccccattacatggccctatgagactatttatagcctcattacaggttcttactactagggtttaggttatacaggggaatttacatggttgcccttatgaaagggacatttacatgggtatactgtgtaattgaggtacatgggctcttaatgggccgtcaggcgattgttggcccaatggccgctaggcttgatatgctaggatggcctcatcggccttcgtgaggccgaacttgctatggcgaagtcgtcttccttcgacatacactcttcgcctcacattcttcgcccaagaggcctttggcttggcgaggtacccgcgcgattctccgcccctcgccgtccttgttccatagtcttcgccatgggggcttcgccctgactaatcttgacgtctcaggcttgaatcctcactggtcgcatggtttcggcaggtttggtcgaagggcctcatgccataccgccaacaagcccctcacgggcaagggtgagataggagcttcggccgagaccgtgcaagccatgtggtatggtatgtggcgccccctttcgaccgatgctcctgccgaaacctatattattcctgcaaataaagtgtgttgtgtcttttcggttggtattgttttgtagctttcgcctcttgcggatggtagagttactttttattttccccgggccgaaaggaacagtaatgggctttccctacatgggcttattactgtgcggctaagtcgatgggaatttaccatttcgcctaccctcgcgacgttgcgctttattactggtgggtaggcgaaccgttgcctgggtgggctatatattctcccctcttttcccttttcaccgccacacttgtcattttcaccgcgcgcgctttcttccgccgttctttcctttcatggtgccccttgaccccttagatcttccgtcggttctttttgttcgccactgcacacacccttcaccatggctcctcgcaagccaaaccccgcttcggcgaaagggcccgatcccggccggattgacgacgacaccaccacctttttggggatttctctcatggatgacggcgagctggcgaagttggtcagctctggggcgttggttgaggggcaggctttcgccccggggaaggccgtggtaccgaagctcgtcgacaaccggacggtggtgttcgccgtcttttttgaggcggggcttcggtttccgtgcaacgtgttgttgtcggagatccttcgccatcttcgactgggcgtgccggacctccgggtttgaacctagcaccgaactcttcggtgccatattttttgcaccatgaattcgaagacgatggttaccccggtcggaacgaagaagacggtgttcaggagcatgaacttcaacgttcgccccgagcgctccgatctttggccggtgaatgccgccatgtggaagtaggatcaccactggatggcgaggtggttctatcacaccatccccttcgaggctaggtccgagtcggcgaaggccctccggtgtcggcgcagggcgattgcgccgaaccggaaacccaagatcaccgtggacggcgccatggaggcacggttcgccttgctgcgcaaggtctgctcccgcctcagctgccgcgacttggtggaggagttctgcatgcttcgcttttttcccctctcccggtcgtggcaagtcgcggttgaccaagacgaagaggtcgacggtttgctgaagctggttcctcctgaggggacgaacggtgagactccgctttcgctatgcgcttctttgtttcgctatttttcccggttcgacgcttaatatggctacatcttttattttcgcagtattgattcttgattaggccgacgctgaagcccggaagatgattggcgacgtgtcggtcgtcgagtacagccagctgctcacacaacaaggccgacgacgatgcagagccttcgcgaaagcggacgcacggacaagtgaaactggcccctaggaagcgaagggtccctgcttcctccgattctgacgccgacgacagggacgacgtcgaagatcgtgacggcgaggaggaaggggaggaagaagagggggcggaggctgcggccagaaaggctgcggacgaggcggtcgaaaaccgcaccaagacccctggctacactcctactccaagtctagggcataacgagaccgaggtggagtcgaatagctccccccttcatcgaaaggatttggagggggcgaaggcgctagttgtgttttcggcgggcaaggtggtgaaggggggtccggttaagaaggccgccaagaagaaaggactcgttgatgttgctcgtgttttcagcgacgatgagtcttctgacgaaaccccaacttcgcccgctagtcgcagcttagatctttcgaccgcccccgttctttcgatcgacgctggcggagcgggtggcagtgccgccgccggggcctcagcctccactgatcgtgtcatgaaggttgcggctagggttttctgaagccccttgcgtcagccggttgtttcgcctctagtcaagtcgaaggggaagggggcggccgtcgaaacatctgcctcggagtattctctcgcggcgccccacttcacccctggcgatttcgagacttgggtggaacttattccctttgtcgtgggggtaagcaaccttgtctcacctgtcggcaccccgagcctattcaccgagctgaatgagttcgacgaagggtgttctgctattaaaagcttggcggttcaggtatgctgttcgctctctctctttttgtttgtctttattttcttcttacagatcccataactaacatttgctctcttcgtccgctttaccttacatccagattcttgcggctgactgttcgacagagcgaaccatgcgggcccatcttgacggatttaggagccgtattcgggccaaggatgacgagataggccgcaagagtttggagatggaggccctctccaacaccctcaaggaggcgaaggggaaaacaagcgactccaagctgaactggagaagggaagaaaggctagagctgaggtcgatcgccttaaggccaaactggagaaggaaaaagcccattccgctgcgctgaccgactattacaatcttactgagccgaagatagaggctcttcgcctggaggccagcaaggctgaggcaagcgttgcggaggagtggcagcggtttttgtgggagatggcgaaagccaccgagtccgcgaaaacggcgtgccaaacgctccgccttgcccttttcgacatgggtgcgagggtgcgaggagtccccgccaaagatgcctctgcctttgacttctcggagtggacgcagcaggctggtggtgtggtttcggactgcgccactacgtaaagtgattgctgtgcacgtgtatcggcggccttcactatgggcgttctgcaacagttcggctgtgagcacgtcgccgagttccctaactatgcgaagggggactgggaggttagtgcgcaggacgtttcgcccgcgctccgcgcatggcggaaacagttctggcagaaggacgtccgatccactgccaaggcacgccttttggagcaactagcgaaggcagaggtggtagaccagggcgaaggcaaggatgcggcggtcggagggggtggaggcgatgcccaggatcacctagaggtgtgaggccctccgccctttccttagatttttgtagtttttctttttgcgtttgccacgaaaggcgaacaatgtatatttggctgatggccccttacccttcttattgtagccgaaaatggccttttggatatttggaatgtatgactcggtcttagtcactttttatggtcgatgcctttggcgtatgcgcttgcgccattttcgcattacctaatatttactctttttcgcccattcttactatgaaatttgccttttgccctttctgcactgtttatcaggatgttcgctgaaaattgtgcatttggcccccctctgggaattggcgaagcaaaaacgagaagtttgtggcgttgaagggtctgccaaaggtgcgatgcccgtttcggcccgtttatcgtgaaatgataataacggccacagctataaggtttttaaggttgctggctggatgcgggcgcaccccgggcaaagcttggaagattacgatagtgttcattcaaaatgtttggaggatatggtttgcttttggcgaaaccatcagaagtctgatcggcaggaggcgatttcccagcgtcgttacagtctagtctgtgtttcgcccccttctcctctcagggttgtgtatgatattggtagtgatgacgaacctagttcgtccgaccattccgtagagagtaaggacggttgtgggggcgaagatgtaatttatctgtaagctgggctgtagagccatcgcttttctttacttgtaccatgatgtagggtttgtattcttcgatatatattttcttcgaagtcaagaaagatgtgctttatttccttttcacaattttttgcattgtcacttctcgtgctttcgttaggtcggaacgtgtcggcccctttgcgtgtattagcgaaataggtctatgactttttagctttcggcttccgttttcgatctgttttattctacgttcaaggaagcacttgtgctttcattttgatcgaatgtaacggtgttcggttagttgtttcccgaaacaagctgttgcggtttcaacgttcggcgaacggtgcttcggccgattcgtttcgccccctggcatttttgctgatcaggcgtttgccttagggtttttccacaaattatcaatcatacaaataagaaggcaaaagacacaaagattttatactggttcgggcctccgggatggataatagcccacatccagtttttttttgtcttttttcattttcctgttttttttgcatttttgtgccgaagggcttacatagtgccgaaaggcttacataacaatatgtacatttttacaagttggcgatttgggtgccacccattctacacatagaaacgcttgagagaggcagtgttccaggaatggtcgaactacttcaccttccagtgtcgccaggcgaaaggagcccgtcctggacttgtgcttgatgaggtacggtccttcccacttcgattcaagcttgccaaccgccactgggttcgctttctttcttaggatgagatggccaggtaacagctccgtcggtcgaacttttttgttgtaagttgccgaagtgcctgtggtgtatttgcgcatgtgttcaagtgcttcgactctcaccccctccaagagttcaagtgacaactcgcgcccctcttcgcccctagagaacatcacccttggtgagttagcccctagctctgttggggtcattgcttcgtcgccatagagaagcatgaatgggctgaacttggttggccttgtgggggtcgtccgaaggacccagagaacagatagcatttcatccggccatttacccttcgctgccccctcaagccttttctttagtgcttataggatctt

SEQ ID NO: 41849 - DNA, 1514 bp, Oryza sativa
tgctcaacacagactttcagcacggtgggccagtacacaccttgtcgaaatactttggaggctactgttcttgcggcctggtgtgcgccacagagcccctagtgtatttccttcgccatttcctcacctttggcaaaagagatgcagcgaagcaaaggttggagcaccccagagcgatatagttggcccgagaccatcttgtactttgcggctctgagctgtaggcgctttgcttctgcttcgtcctccggaagccaaccgcttctgagctaccttacgaatggggttcgccagtcttttggatcttcgcccagttctgcctggtcgattgccataatatccaggctctctacgggcacacttggtgcgtataggacttcaaaaaagatgccaggcgaatgtgggccacacaagcagcagatttcgccaaggcgtctgcttcctcgttctggcctctaggtaagtgttcgaccgttatgccggcgaagcacttttccatagaccaaacagcctccaaatacctcttaattccttcttcttttgcctcaaaggacttatcaacatgacttgctaccaacttgaagtcggttcggatgagcaagcgccgaacccccaatgcttttgccttttttaggcctagaagaatggcttcgtattctgccgcgttgttggttgtgttgaactgcagccttgcggcataccgaatcggcacaccccccggcgaagtgagtactgccgcaacacccgcccccttgtgcgaccacgaaccgtcggaatacatcacccagggttattcaacgggctcgggctcaggggtgaatgccggtgtccattcggccacgaagtcagctagcacttgggacttgatagcagtgcgggcgacaaaatgcaagccgaagggagatagctccgccgcagagctgatctaagcgggcgggctttgcagatattgcttcagctcgttgaacgctgcttggcattcgggtgtccaggtaaacttttccgcgccccggagggttttgaagaagggcaaacctctttcggctgcctttgagaggaatcgactgagtgccgcaattcggcctgcgagcttttgtacttcgcgtacgctcgacgggggcttcatttgctgaatggcatcgattttctcggggttctcctcgatacccctttcaaaaacaaggaaacccaacaacttgcccgcgcgaacaccaaaaacacacttctcaggatttagtttcatacccaccgcgcgtaagttgtcgatggtctcctgcaggtaggacgcatggtcgaaagccttgcggcttttacaacgatttcgtcgacataagcttccacatttcgccccaactgcttgtaaaggaccttgtacaccaacctggtgaaggttgccccggcattcctcaggccgaaaggcatcctgaggtggcaaaaggtgccgaatggtgtgatgaaggctgtcttggggatgtcggccgggttcatgtggatctggtggtagccggagtacg

SEQ ID NO: 41850 - DNA, 807 bp, Oryza sativa
gtcaccagctgtgtggtggaatctgataatccgagaacacatcaaacaaggccgccttgacagtgcaattaatgtctcttgccgcatgctgcgtgctggaactaggctggaccattttactctaccacatgtattaaaagcatgtggagagctaccttcataccgttgtggtagtgcattccatggattgatatgctgcaatggctttgagtccaatgtcttcatatgtaatgcgttggtggcaatgtattcccgttgtggttctttggaggaagccagcatgatctttgatgaaataactcagaggggtattgatgatgttatctcatggaactctattgtttcagcccatgttaaaagtagtaatgcttggactgcattggatctgttttcaaagatgacattgattgtccatgagaagcctacaaatgaaaggtcagacatcattagcattgtcaacatactccctgcatgtggttctctaaaggcagtacctcaaactaaagaagtccatggtaatgctattcgtaatggcacatttctagatgtttttgttggtaatgccctgattgatgcttacgctaagtgtggtttgatggaaaatgcggtaaaggttttcaacatgatggaattcaaagatgtggtttcttggaacgcaatggtggctgggtactcccaaagtggcaactttaaggcagcctttgagcttttcaagaacatgcgcaaggaaaatatcccattagatatggtaacatggactgctgtaattgcaggctattctcagaggggatgcagtgatgaagcact

SEQ ID NO: 41851 - DNA, 1513 bp, Oryza sativa
acagaattgctatccagctggctagtgacaagcatcatccatgccacgtggctgccatacgtggaatccacgttggatgtgacgtggcagatgacgtgtactccacatttgtccaagccacgtggctgccagacgtggaatccacgttggatgtaacgtggcagatgacgtgtactccacatggcggatgacgtgtacgccagtatgctagagccacatggcagtcgtatttaaccccacgtgttggcatttcatatgtccacgtggcgttagcgtgcaacgccacgtggccaaatgtggcaacgccacatgttctcattttgaggcgccacgtgtctttatgacaggtgtccttacctgatacagccacgtgttaatatgttttgatgacacgtgtcaaacacattaaggattcaggtccactcatttgttctggcccaacccatttggccacacattttacatctagttgtggcccagtccactattagttctagaaaatttttagcattggcccatttggagcaacaattagaactttgcacacattacaaataggaccaacataaacattgaacacagataccaacttcattacaaatagccccaacatcaacattaacattgaacacagaaaccaacttcaccgatgatcccaaacttgtgagccagtgttgccatcacctccactggcagcagcagccatggcccgccgagctcgacatcgacgatgttgccgaagtccttgctaacaacatcgatcctctgaaacacctgataatcaaacgaaaccaagtttcagattataccaacaccaaatttctgattctccaaatcagattcagctgaataataattcaggatcaattgtttttctgacctgcccgagggtgatggggaggagcctagcaacctgatagtacataaccatatgttagattattttttttatgcgctagataaacaacaagaaacaatctatagatacgacattagttttttaatgatagggctactttgcaacaccaatctgatgtccccataatatattgcactaacatatctcaatgtccccatccccaacccacctcatttcattggccaagcaaacaagcaaccgaactagaatgcataggagtttagcactaaaatttagacactaaagttatgatacgagtaacttcctatacatgcttcatttctacagactataggcatatagcatgaccgtaaagtgtggtgtaaagttatggacaccatttaaacatgcttcatttctacaaagtacatgcatacaacggttccaaaatttatatcaccagtggaacaatgtagcagcaacatcactaagtactataacactagagtggaacacacagcgcgctgcaccagtggcatcagaagacgaaaatttgtcgttattttggtaaacagagtaaatactaaatcaaaaggtattataacagatgagtaccaattctacaatatacattttaatctcaatggaaaacta

SEQ ID NO: 41852 - DNA, 2831 bp, Oryza sativa
ggaggcaacatcagatgaagcagcgagtggacggaggatgtagcggcggcgggaggcgatgcgaggcagcagaaaggcgggaggtggtgcgggagtaccgtcgcggctgctttcggggtggggaagcctgccgccgacgcctagagaggtgccgacgccgatcagggctaccggccgcggaagcgagatgccgccgccgccgccgccgcgggtgtggggaatgcagagggaaagaaatgagagtggatgagggttagggtttgcaaccctattttatacttcattggtgcaatgacagccattcgatcaagaatcaatggccagaaatttatgggccgagtacagtaacgggccgatttctgggtttaggcctactaatatatgtggtatttttttaatttcaatttatgagaactttaaatttaattttaggccaatttgtgtgtgttttaaatgcaaaaatcataaacaacaaaattttagaactcatcaatatctacaactattgtattggtatttttacaaataagttcatttgaacaattcaaattttgaattttcaaaatttgacaacttaaaaaaaattggggtaaataaatgatgtaaaatgaaaaagtcaccaaaatcaaagttgtagaactcatagagatgcaaaatttttattttggtcatttctccatctgactctatttgaacaatttgaaatttgaaattcaaagtttgagaccttcaaatagaattttttattagtgaacgacttcaactgaaaaagtcatcaacaacaaagttgtataatccatcaagatctataatttttattttggtcatttattcatccgataaagtgatagtaacattatttacaaattttacatatctcccgtatggtttcataagttataagagagatatgtaaattttgagaacaacgttactatcactttgtcgaatgaataaatgaccaaaataaaatttgtagatctcgatcagttctacaacttttgtgttcatgaatttttcagctgaaatcgtttactgcttcaaaatgtcatttgaagttgccactttttgaaatttaaatcttcaattgataaaacaaagtcacatgaaagtatgccaaaaataatagttgtaataacacaataaattgatagatcatgaacttagaaaaatttagaaaaaagaataatcaaatttgaagttagtatgagagagaaagactacctacaagttttagccaaagattaaaaagataaaccacactttatgatgaaccccacaagcaggtgatgcaggtcctagctcctaggtcgtccgcataaaacattcaatcattcatgcgttcaagaattgtgaaaggaaaactaaaagtattcgatcctagctgcagcatatttttttagaaaaaggtatttcatatgggctgcaagtagacagcatttgccatctcctggcccgaaaacacacctgggctgcatccgtgggccaaataactaaaacgaaaacacacctgggctgcatccgtgggccaaataactaaaacgaatgttgggacccactgtacctcaattatatgtgggtccagtaacaacctggttagccacatatacaatgtggggtcaatctagatagccacatatacaatgtggggtccagggaaaatctggatagtgccacatatacaaggtgggaccaataggagaatagatattgacttacatctgatgaaatatatttcagcataaattctattaataaaggagcatcataagtgagttacatgaatggtgcgcaacatttgtgacgaaattatctattgttttttgacgctattttaaatttcgtcatggagtttcgatgtctacccctgcgcatgagtgatccgtgacgaaacatgaattttcgtcatagatatgctctgttcaatgacgaaattatacaacgtcacgagcaaaacgtcatagatggacgatttcctactagttgcaggtaagttggagctgggagctagagctgtgccaaacagatcctaaacgtagttaataacaaaaacaaattacagattccgccaggaaactgcgagatgaatttattaagcataattaatctgtcattagcaaatgtttactgtagcacaacattatcaaatcatggtgcaattaggcttaaaagattcatctcacaatttacatgcaatctgtgtaattgttttttttcctacatttaatactccatgcatatatccaaacattcgacagcgtgaaaaattttattttgggaactaaacagggcctaagagcatcaccgagagactcaaaatttcatccccaaaatttagattttgggattattaaacagaatttgaggtttgaatacattgatctctcctagtgatagcctaaaattaacttcctaaaatttaaaagttccccatttaaaactaccaacaaaaaaaaatatttttttctctcccagaccgatgtgattccgaatcccggtcggccggcgacgatgttgctcgcccctccacgcgacagatctatttttcctcccctcattgacattagcaacaacatttagcagcattaggatgcaaggagcagcttcaggccttcagccaaagtaatcatcatgcggatcatcaaacaacgacatgtatcagcaaacatcagtagcaaactagtagcaattactatggatgtgactagacagctaccgatcgctgtgtaatcggatcgtagatcggatgagtagtttaagagaattttatttgaagcataggtggttcctatttgcttgatgaactattttcagtagagtaatggtttcag

SEQ ID NO: 41853 - DNA, 4372 bp, Oryza sativa
  unsure (1)..(4372): unsure at all n locations
tcacccgagcacccccgcctccagttcgaggtcatccgctgctggccccaactcccacgcaatcggccagacatctgtagctgttgctaattgcttatgttnattnnanatagtnattcatnnnntntnnncnnannagcctntnngtttagttnnnnnnnnnnncnccactgaagccattactctgctgatgctgaaaatatagtagtagttcatcgagcaaataaggtttgttttttcatgtagcttttctcgccaaaacccctcatcattctccaacttccatagccattttcctaggagagacatattcattgtctctggatcaagaatcccaagcccaccctggtcttttggtctacaagtcactggccattgcaccgaataatactttctaatcccctgatctgccacataaatcttgttctataaaaatccatcatcctttttcactcctatagcatgatgagcagtagtatgtcatggtgctctttcattcatgttgaatagagttttttttatgagcgagtcccaacttaagattaagaaaaggccatatacactgtagtatgtgttatactccctctgtttctaaatacttgatactgttaattttttttaaatatgtttgatcgttcgtcttattctaaaaatttaagtaattattaattcttttcctatcatttgattcatcgttaaatatacgtatatgtatacatatagttttacatatttcacaaaagtttttgaataagacaacggtcaaatatgtgctaaaaagtcaacggtatcaaatattttaaaagggagggattatataaataaacatgaggctatgggtcctatcttattgcttagcgaccttaaacattgatggcctgtttagttcgcgaaaagaaaatttttgggtgtcacattggacgtttgaccggatgtcggaaggagttttttttacatgaatgaaaaaactaatttcatgacttgcatggaaaccgtgagacgaatcttttgagcctaattaatccgttattagcacatatgtgttactgtagcactttatggctaatcatggactaattaggctcaaagattcgtctcgcaatttcttctctaactgtgcaattagttttttaatttatctatatttttaatgcttcatacatgtgttcaaagattcgatgtttttttgaaaaagtttttggaactgcctgaagatgcccgagtaccaaacagaaaatttgctgcgtgcatatgacgtgatcgtgcgcaaatactccagttcctaaggacctgtacgccaaagggacgtcccctccgctcccctccccagatcctctctctcgaatcgtctttgggcggccaacgcatcttcctcttcctcttcctccatctcatctcaccatcccatccacgcttctcgactcccagacgacgctgctgctgcctttcgtcaaccccccacttctccttccccgccgccgctcgccgccatggatgaggagtacgacgtgatcgtgctggggacgggcctcaaggagtgcatcctcagcggcctcctctccgtcgacggcctcaaggtacctctctcctacccaatccatccgccgcctcccgtgctcggatcggtgctccccatcgtcgtcgatccgtagatcgccccccacttcatctcatctgggcttgacgctgccgcactcggatgagctgctgccattttgatcgctgatttacttagctatgcgagcgtagcgggatggtaatttgtccgtacatcgtggctgggtaggtggtggcgccatggttgtggtggttgctttgcgtttgggggagggatcgtcagtgcgtgcctgagcttacgacttcccttatcccatttaaaagagtagcggcatagcgattttgggggatttcacaacaagatctaactaaacagatcggatgcacttttcaatgtttttgcaggtcttgcacatggataggaatgactactatggaggagattccacctcgctcaaccttaaccaggtaagcaaactgcaatgaacttaatttgaccagtacagggtctatatcttgtcgtcatatcatgtcaaggaatgcttatgttattacagagtacattatttcttttaattttttgtccttgttcactgacattgttttccacttcgctttttggaatagctgtggaagaggtttagaggggaagacaaacccccggctcatctgggctcaagcaaagattacaatgtagatatggtcccaaaggtgcaactgtcactttcccccatcataatctatcttgcttctatatttagtattagcagctaacgtacgtggcagtgaggtaccatataggtggggaacctcaaaaacagaaatcccgtgatggtgcataagttcatcttgatgagaacatttagatccttttatgttacaaatgtggttattcactggtttagaaaactatgtaatctcatgtgtataatactcaaatggaaaaaaaggtctgaaaagtaatgattgccctgatttttgtagattgtcaattagtcggatggtttattacaagcgctaccactatggttccttgagtagcgtattgctgttgcatgattatctaaagtcctctcttttttttatctccgcagtttatgatggcaaatgggacactggttaggaccctcatacacactgatgtgacaaagtatttgtcattcaaagctgtcgatggaagctatgtcttcagcaaagggaaggtaacatcttcagctcatttcctctgttttcattagcatcacatttcctctagtgttttatacttttatctaagtggttgttggatctatattctgatcttattcctatgctagcagtgtaacatgcacttttctatttttgctgtcaaccagattcacaaggtacctgctactgacatggaggctctgaagtcccctttgatgggtctttttgagaagcgcagagcaaggaacttcttcatttacgtccaagattacaatgaagctgatccaaaaacacatcaagggttggatcttactacaatgacaactagagaactgatagcgtgagtacactagtgtttcttgcactgtattcaaccctttctcagtagtgcatggcttccttttctaaatgaaacaatagatttggggcatatatactatatttatatgggatatattgttgtagacttatacatgccctaatgcatacgtgaaatgtcaaacataatgacagtgtgcgggcaccggcgcatacatgaaaccacgtaatatgaaaaaaagaaaatgtgcacttcatagcaaagagaacatccattgtatcatctgtccattgtgtagaactttagaaagggtacgatagacagacttttgcatggaatccatatgtggcacatggcagtctttacatgcgtagcaacaccctaaaacttactggtcactaatgattgctaaatttaggataactgttgatatgactgaaagatttctctggataaaattaccttggtattagaaaccagcgtacttaaatttattttttcgatctgacacgggagtacttaagatacggatgcagttacattattgaaccaagcaacacatttatgttatatgctgcatgctgtggtactgcattacaagcctactttgtgctgctcatgaaatgtagaaaccttgatatcccttttagggaaaataaagtatgaaagcagaggcatcagagcatgggttgggtatctagtgtgtcacatcaatgagattctcactgcaaaattttaatttgcgttatttttaatttgttgtgtcttgactaatgtggacccacttaaatatagattagcttctattgtaacttgtaagaagacttacatcctgatggatattcttgtcgtcttctagtagttgtgttctgacaaaaaagtagtacaaataattgccgccacagaatatatcatcaatttaccttcagtctttcacatgatgcaaaaggatatatctatgcttcttttaccttttctgcatataaataactctgtttccatttgccctttcttttccagaaaatatggtttaagtgacgataccgtggatttcatcggtcatgcacttgctcttcatagagatgatcgctaccttaatgaaccagcaattgatactgtaaaaaggatgaaagtaagtattgatcaaagctcctgtagattgttcgtagtcttctgctacggatatcctgctgttctctgaatattcatgctttatgaagttcaattacattttagtgctttatctacttgtagctatatgcagagtcccttgcacgttttcaaggaggctcaccttatatttatcca

SEQ ID NO: 41854 - DNA, 1995 bp, Oryza sativa
ctagatgatgtacttccatcttaacacattcacagcaaatttactatgttttgttcttcccttccatttgttgagaagttctattaactacaaccacatatgatgttctgtatacatttattaacaggttaggaagatagggaaagttgcacgagcaattgctataatgagccacccaattgcaagcacaaatgactctcactcagtccagattatttggccacagaaacaacttggacgcaagtcagacatgtgaggcctttctcaatcacaaacaaatgctgctcaccttatgaattattacatttgcttgcccattgcttttagcaaagtttatttattcccattttgtaacatttttattggtattctcctgttaggtatgtcttctgttgctcatacacacacaatgtcgctccaaaggggaagtttattgcatttgtatctacagaagcggaaactgacaatccacagtccgagctaaagcctggaattgatctacttggtcaagtagatgagctattttttgatatctatgatagatacgaacctgtgaatgaaccatctcttgataattgttttgtctcaactgtaagttttgcaatatctgatttttgaaatgagcattaagtttgattgtctagactgtaacatatttctggtccacactccctgcagagctatgatgccaccacacattttgagacaacggtgacagatgttcttaacatgtatacattgatcaccggaaaggtagatgtgcttccgcctttcattttctttaatctttaatacatgtaatgcttctatattttgtttgaaacacctttttttggaaaggatgaaaattagccgggaggctatagagaggactagagtaccacatatgttgtaatagcttgacttttgtgtcaccttaaattctaaatccaaatccattctgttggctattgtttgttttacaattatgtattctacccttttcctaattcttttctcattgcactattgcaggctgttgatctcagtgttgatttgagtgctgccagtgccgctgaagaatattagatttcacaaccaaagctcaatcatttcacaaagatatgctttttcttggtgggtaccgcaggacagatcgtaacgagtgactggtatagttattcaaactccacgttataccgagtgttctggccaatatggcttgttgctagcagtaatatgcacaactgttggccaagatgactgaaatgatggtggtttaatttgatacttcagtaatgcaatggtgtaaacagtgtacacactacacaatgacggtcgggcgttttgtgactgatgtatcataactgctggataattttgcatgtctacttctgcagtgttgtgttctttaccttgcattttcaggtttcagttgggtgtgcctgcctccggtatcagccggtagggtagcatgagtagattttaccgagtcatgcgaatgaaaattataatttaacagcttaacctacccagaatatcttattcctggttggattaaccaaaacttcaggacaaatttaaatgtgtttgacgtttctatttgttcttccggttctacctgggatacattctcaccgtttggttggttaccgatgaaatttgaaggcccattgtccgcttgcaaggaccgggaaatttaaactatttgccacttttacgaatggcaactcttcaaatgctatccttatggttgttcttacacaattgtcatcggagagacgtttttaataatttgctacttttgctgatgtggcatgcccctcatactgccagcgtggttttgctgtgtaaattttccgttttacccctgatgggccctacaaatcggggaaatgggaaaaggagcaagagagagaggttcaactgccgtctcatcgtcgtcgattcgctcctgtgctcgccgccgtcgcagcagtggagggaggagagcgcggtgaggtcaggtgcctgggg

SEQ ID NO: 41855 - DNA, 10084 bp, Oryza sativa
ttcttcttctgctggaccattcagaaaatgcttccgtgcttcttttgtactgtatgctgatcatcttagatctataccgtttaaagagtgtggagactacaactttactctggatctcgtcttttgtacttctgtatattggtcatcttactctgctagagtctggtctcactacacgcgtttggttagcatgtgacatgtttttgctacttactcttgtggtttctgtgaggagtcacatttgatcgatcaattactcttgagcttcctggaagcggtggtgatcaagcttcttttcctgactaagcgatatcctaaactgtacaagggaaggatatatatatttgtagtctgctttactgccatttcatgttttgctaaattgtcaattccttatcctcagattcatcgtaaaaaagtatgttttgaaatcatggaaaaaagtctaatcataaaagttggtgattgcatggccctttctttatgtatcattttaggatgcaggccgtggcaccttcgtaggtcactacagtagttcatttgaatcctaaaagcttatgaaaacattcagctagttcaagtgtgtgttcactcctataaacattgataaggacagaatgaaaaggttttactcctattaacattgagaagataactggacaaaatgcaatctgaaaaccgcatataagcaggcaagatgttctatgaagaatcctcatatcgtccttggccgattgaaccggaaacgaaaccatgccaattctatcacgcaaactcgggtagaaaatattaaatccattaaattcttcttgcttgacttgaatagattccttgaccaccttacacgggagcttggccccaacaaggccaaatagcaaactaaccaaatcttatctttaacttcttgtcttttaacttaaaacatatctatctcttatccatagcagcatatctcctaattaaataaaagcaaccagccattgcggccggtgctacagtaaccctgcagataattagcacaaagtacgcctagataaaattcattaatcccaaattgaacaggagaatattattcattaatcccaaattgaacaggagagcagcatggtacgcatggcaatagaaagaagggtagaacggcggcgataatattggacaaagcaaaacattatgctacttactgtaaggactgaactttctgaagttctgaattaactaagagcaaacaccatatcaactcgtaacaggacaagaaggcaacagatcaaggaaactaaattggaggaatcgaaacaccagtgccaaattaagaagttttgcttgtattatatcatgtccgaacatgtaagattgggctgaatgccagttctaaacataactgaaacagaaaagatgctatttctttcgacactgtacagaagttaacccctatgttttttttctacaaggactagagggctacgaacttgtttcactgaaactgctggctttgtacacggagcacctactatcagctgaacaaatagaaccaaggtatagaattgttacatggctggatttaagatctggacagcacaatcagacatctggaatctatagcgacaaagcatatgcaaataacccatctatctaaactgatcttcatgcacaattgatttggttgagcaaactgttgcacatatcatgtatgtggaggcctcggcaacatagagttagccagttcttcattcaactttacaggaaggggtggcatctgcctcattatctcaggaacatcgcctatcctgctataaaattgaagaaattgttgttacataattgcagtttcacaggacaagtgatgaaacaacagcaactaacttaatcaataaataacatctgtatttcaagatcacatggaagaaagtgttcggttattaaaatgtagcagaaaagcattgatataacaaggaggggactaaaatgacattgcaacttattgatatagaatttaggccagttagaaacttagattccaaagtaaggggactacttggggtacaatctgaagtggagaagaaatgaatttactttagaagactcaggaatgagagaaaaaaaaaacataagagccagataaacaatcatgggaagacaaatctggtactcaaatcccgagttattcaagattgtacaaaaagcaaagtagagaatcttactccttcaggactgcaagtatattatccctagtttgacataaaagagggatgttctcctgcacctacaataaatgcaatcattattagaatattgacagcatagcaaatatcaggtgaatgtgacaggtatcagtcatacctttgtgaaacaaaacaatcatacaaatttcggaagaaaaatatttggaatacattcttttaatatagcatacattcaaatggctgctcctttccccaacgtacaagtatataaccatcatgaaatgggtactaataaagtaaaacacctacagttcaatggaaattgcattatgggtttcctggacccgtggttctattaccaagtgaaattcttctagaaccttgcaattattgatagaatgcttgtccatgcgtgatttacgggcaacttaagaaactaattgcaacactacatcttcagcgacaatgcataagaaactaattgcaacactatatcttcagcgacaatgcaatgtaaaccacagccaatgtagatcataatagccaaaatattattcatataatcttatcatgctggggctgagtgctgaaaaaataacagagaagatagaactagaagtacctgcatgtttgaaatattggtatagatctggttcaagatctgtgcattgtgctcaagaatttgaccagtttggcctccaattgctgcaatgacatggaaagcactgatcaaatataatatcttaattcaacgcttaaaatctcaacatagtgataattgttatattaatgaagatgcttctaaagttacagcatgcaacttcctattcctattatatttaaaagtaaatagtactctactactggatcacaaacaggataacatcatacagtataaatatttgcaagcatcatgttctactatttactctattttaaattttcatacatgctctggaaaacttcaggtttggacaaattacaaataagttcaataatatatattttacataataaagcagcatcaacaaggtcgaagagaaaaaaataaagaaggaacaaaggattaaatagccacatgcctggaaccataatatcaagaaaaaataaaagcaaacaaatgagacaagaaagtacaaaatatgagtgctagtactaacaaaacacttacttttgtatgacacatcatcatcatccatgggaagaactggaagagaatatggagcagcattaggtcgggccactaggtgagctggcccttttgatgaagaatcattggctctctcctacaggttagtaaaaaaatatacattttaatcatgcaagaaatttaaaaacaatgatgcttcttttaaaacatctattcatttttacatatttacatccaaacacctatgcatttttacatatgtgaaacactgactttgcatgtgccaccttctaggttgctaaaacacttaaaagctagtaatctgccttttaaaacttcactagaaagaaagaatgtcggttaccgctttcatgaaatcaatagcttgccaaatcaggaacaataatagtgataaaatagggaatcagtagacaagtgagccagatggtaaccttcttttctttgtttttcttagatgactcttccttccttttcttgttactctcctttttctgcaagagatgaaaaagttgatgagattatataacaatatttgttaggcagaagaactatagtgcatgtaatatgaaacatcagaatgtttgaaaacaaaattcactagacataactatctgttgatggcaatactggtcagtttgcatggttattacaagcctacaacttcagttaatttaaataataaaaaacaactatgatgcatgacttggaaggattcatttctgaaagccgactgattttgaaacagatgatgtgattttggcattgatgtagtgtggatgtagatttaatcgtattcactagtgaagaagataaaagatgatgatcatgatcatgatcatgatataataataataagaacagtaatcatgatgaaagttgtagggggggctcaatatggtattagtaatggagatgctagaacctagcatctatgttagattcactatataaacctgatactccctccgtcccaaaatataataacttttagctctcaaggtttatcccaaaatataacaacttcttgaccaacattctcttctcaaccaatcacaaccctccaccattcaattttctcacctacctccacttctcaaccaatcacaaccttctcccatttaattctacctactttcttaatacctgtgtccaaccctaaaaatccttatattctgggacggagggagtaattgcacaaggaactagtaacaggccatccggaaaccattggctaagcatagcaaaaaacaaagtgaaattacttgattgatttaaacaattaagcaactaataaacataatgagaatgataaaataataatatgaggtactgaattatctcaaattggttgattggcatgggatgcttgataaacataaaagaacgatgtattatagaatttttgggtgggaaattcggatgcgctagatatattacttaataagacaagctgaagcagtgaaacataaacccatctgtcaattatcataaccacaactttcctgtatagaacgagctaaagcaaaataaagagcaaacaaatatagaagtacagcaggtgatcagaatccaacttacagccatccatctgcaacgcagggccacatctcgcactgtcttgtcaggcagattcatagcaatttttgcatagcgaactacagctgcatccgccgcatagctacaataggtgtagtcagaaagtaagattgattaacttaattgttgctacatataagtgcaggacattggaggatttgagctagcttaaatgaggacaaaacaaaaatagtacaattcaagaattcagattccgtacaacaattgtggtaatgatggggacattaaccaagtgcatgaggccactacatttattgccagaacaacaaagaacagatagtgttacatacacactacgaaccagaacaaggtggctgcacaatatcccacggtccgtcagtcccacccgaaacggatagactggtgttatgtgaaactaaatttaagtttaccctggtgtaaagtagaaatttatgcttaagtcagtgcattgtgaaacgtaagtcaatctaaacggtgcaagttctcaaaaaaaaacaaaaatctaacgagtgcaaactgtaatttactctattaaatacaagcctccaccactgcactgagtaataaaacgacaactgaaatcctactacaggccatttaagaattcatctagcaaggaaaccctaacaaacaacatgataaatgcatgcctacattttgcagaaaatgtgcgtgttccacaagtcatggtactaatttccatttgggcttccaaattaccaaccaaactccaacgccataaccgatggcagttatccgtttctatacaagcacttgagcattaccatttccttgtcctgttcgcaagtcatgcagcaactggcatgacctgagccctaacagtaacatcgccattgcaactacgacaaaaggaatttcatcctagatagattatatgacagcagctacaactgcgaaattatactcttatcataaaggacagaaaaccttctataaccacttgctcatgaatgacaacaaaaaaccttgcagatattgaatagaagatggggaaaaataacctagccaagcataactactccccataaggaagcatgcaaacattcctacccaaggataacttgctatcattcactagtaaaggaaacaagtaaatattccatcctagacgggaaagtggagaaactatagcaaacatgtagtaaaataattccattctagatgagcagtggtagattagaaaataatcactaaaaccaccatacccacgatccaagaactccccaagatcgatgccatctacaacgctcttccacctcctaaccagactatcaatcaaaagtagtagaaagaacggactattccagagaatcctccttctacgagttattagacgaagggaagagaaaccctagaaaactcacctggccagccctccttcgagcacggcctgctcctcgggcgtccaccggacggagagccccgggtcgtggcgcagcgccgccgcggtgctcgcgcccggcggctgggccagcgccggcgcgggggaagggttgcggtggtggggcccgcccagaagcacccccgtggggtcggcgttcgcccccatctcgccgcctgccaccgccgccgccaactcggcaaccccccctcaggccaggggacgacggtcccgcccaaacccgagggaatctcgcgaaggcgcgcagggattccgcggaatcagagctctgcgcggccgggcggcggcgtcggcggcggcgagggtttggattctccggtggcgcggccggcggcgagtcgggggacggggagcgaggaagggagaagggaaacgaatgaattttgggctttttattttgtggggggtagatggatggatggcctggattggaactcactgtgagtaactgccttcaatcatgaaaaaacggtaagttcctgccttcctgcttcagttgagtcttcctttcactttttttttttgctagggtaaatatgaattgaaggcttccacttttatttttccgcgtatattttttaagcgtatgtctccattatatgatatatacgcgttccggtttatatatagatcgagagttagaacacttgtactacttgcctcatctatagacgtgtgtctgattaggtaggttgatatatagacgcgtgtttgactaggtacgttggtacggagatgtgtgtccgactagatacacatgatacatgaccccacctcatcatggggtcgacgttcgcctccatctcgttgtctgatatcattgtcgtccctgggagacgacggtcctatcgagtcttacctaaatcactcagagaggcggacgaattctacttgtatgatagtcaaatcagagcttcacgcacccttggcggtggagacaatgagcgtttttagactatccgaaggtggacgatggcgaacgggggacaagaagtgagaaggaagcgtgagatgaatatgtgcttttttgggggtcttggggttagatggatggctagagctcactgcctccaatcatgcaaatgattatatgtgaatttctcgtttagtcgcatctccatttcgtttgggtaaaggggtaatgtgaatatgaaggtttacgtccgtgtttctgtatatattttatgtttccgttatacgttgcatcccactctaataggttaatatatagacgtgtgtttgactaggtaagtgttacatctaatatttgtctgattagatgcacatgaagtatgatatgcggcggcggcggcggatccggaaacggaggacttggtggccgcggatccagcgtgggggatctccggatctaccatggcatctccggtgataatgacgatacgatggaggggcggagccagcaccagtccctctcccgtgcacatcccgcagcccctccacctacaacgacatgatggttgcaagcgactacgacgacgaggatggtgttggaggcttcgagcgacgatgacggcgacaaagaaggctgtcggtggcggctgtgagcttctactgttagggtttcttgttttttttcgattttctcttttcgcagtcgaacgaattaagcattggcatgcataaatccgatttttcgcatggttgccctagctgcatgcaaaaatccgattttcacatactttttcgtgcatgtggcaagagcaaccgcatgcaaaaatcagttttgaccgtatgccaaaatcgattttgtagcagtgataggatgtgttctaacttctaatctggagttaggttgggctatcgtttatcgtgaacatgtttcctaaactgaaaatgataagtttcgtgaaaaaaaacttataaaagattcttaaagaatcaataaatccattttctaattttataacaattattacgtaattaatgaatcgtgtgctagtggcttgtttagtttccgcggtactcccttctttttcatattatattgactttttttctagtagtttgactaaatttatagaaaaatatagcaatatttttaacacaaaacaaacatattaccaaaagatatagaatgttagatttaatgaaaccaaattggtgtcgcagatattgctaaattttaataaatttaattaaatttaaataagtttaactaatgaaagattaaatccttttataacatgaaacaaagggagtgctacataactaaatagaactgctatatcaaacttagtgctatatagtgttatatagttgccttatcagcgattagcggttacacagatgggtgaaaagagcttaatatgctgtcaatcatggaattgtttatttatttatttcggtaaggttctatcagtttcatttctcctttcctttttctttccgaggatagggaaattgtcatgtgaaactgcaattttagcttctattattattattattattattattattattattattatcttttgaccagatagtatatattattaattattggatggcgtgtgcatgtatatacatatgttgtgatcgtagagacatgtgtctatgtaggtatacgaggtgcaaaacgaaaaacgatgcataattaaggtgtataggcaagaagcgtacttgatgcatatctaattgtttgtgttatttagtgtgggtaaaatgcctaccgtacgtggttctccagcacaatccaaatgtttaaaattggtaagtgctctaaattggaatagaaaaggaaacggtgaactttatcatacgtttccaagtatttcaattaaacttggtgctattataacttataataaatcttgctagctccttgatgcgaaaaaactcaattttttaaagaatacactctctaaatatggtcatttcctattaaatctggatatatgggaagtgccaaacagcaaatagatgtatattttgaaaaaaaaatgtttcttcactcgaaggtatccatttggctatgtcctcatataactatgtacggatcaaaatatattctcataaaatctattggctattgcctcccacatggcgctaccatatttagtccgggtatttcaactcccggattcacggtcctagttgcatacccgggaataaaggggttgctaaccgggagtgtagatgtattctcccgcagtgtgatatgccccaaagacaattatagaaattataatactatatttatgtatttataataaagtgttccttaatatagataacttactattgatcaatgagtatgacttattcataatacttcttatgtatgttactatttctaaataatttctaactaaatgtcataaagtaaattgcacctaaccccacctattatatctaaattgcacaaaaccacaggggttttgtttggtacgtggcacataaccacatatattatagccataaagttctacaaaaccatactattgatgtttttgactttcatctagttctataatcatatttcaaatttatggttctttatccatcatataaataaagtgaatatatatcacatccatatgagtacagttttttcaaaatttgacacatgagtatgttaaattggttaacgatgtagttttgtgaaatttattactataatacatgtggttatgtgtgacgtgataaaatccttacgattttacgtaactggaccataataggtgaggtttt

SEQ ID NO: 41856 - DNA, 3394 bp, Oryza sativa
  unsure (1)..(3394): unsure at all n locations
taaaacatcaattaattctgttttttcaagtctctctggctctcgctccggcgtgtgcggcgcgtgttaacgctgattcttggtaaagatgttcgtcttgattgagggcaaggcgattggtcatactgtaatgggggattaattatttgcaatgtgtcctcttggtgcctgaactctgaattctttaagcattgtcatcctcctagtaaattatatattccatcgaagatagatagtagattctaggacgaattcgatttggacatagcaattttctgatatatctagtaaattatatatttaattccgaaatgttgggtgatacaggtatttgcctttcaccttgagtcggccccaatttccaatcttgatcttgacttccgcatatgaatgttgcttgatctgtattcgacctatgcaggtgctgttgatcgctttgtgaaatggagctcccagttgctgatcctgggccggtgagggctgaaggattgcttctgcagtgtccctattgtgattcagaggcaatgcacaaactcgcgcagttcttgctccccggcttggctgcggtatgcattgactgcacgacaggcgatctcttcaggaagccatcagttgtcgccgttgacatgaggaaggaaatggtggactacgtcacgcagagaagcgagacattcatatccgattcgcttatcgaatcagaagcaagtcaggatcaagagaacgagatgccggaggacccttttgagatcgtgtccatcttcatggatgattttagtagcacgaagaggaacattatcggccatgtctctgggtggttgatgagcgacagccgcgaagataagattgatgactttgtccaagaaatggagatgacccgcttctggccgctggaaaggagagaaattattgctgaggtcctcctcaagaatgtagacctgaaaaccaagtaccactgccctgagaaatatgaaaatgaagaacgtctcgctgatcataaggcccagtgtagcttcagacctgttacctgccccaatgatggatgccgagcgaaagtttccgttcgctgcatgcaagaccatgattcagcttgcctgtttanaatccttacatgtgagcagaactgtgagaagcggcttctgaggcgtgatatggataggcactgcgtgactgtgtgccccataaggcccatgaaatgcccttttggctgtgattcctcctttcctgagcgtaatcttgagcagcactgttctgagtttcttcaggcacacctccataaactcctcaaggctattcataagaaaggttttacagatgaggggctcaaggaccatgctctactgctggaaaaggttaggctcctgatcttgttaatttacaatgtgtaacatacgcttttcaattaaaatggctgccttattttcttgatttggaaacattgctgtcaaactattgtgaaaaagaagacatacatggactgcagcaatatgatttactgaaataatctggttttgttctgcagcatgacaatgatggtaaactggctaaatctcgggatgtaagatctcttactaatgttgtaaagaatcttgaagccaaaataaaagatgattcgagttagagtggatggcgtctccagagcaaaatgcaagttttttttgaggcagcaaaatgcagcatggatattgaatggtatagctgaagagttgtttccactcacagtatacacagaagagtacaagattctgcacgtttttcctttacaactataattttcccctcatgatttttcttttctcaaaatcggttagttttttatggtgtaaaagtataacattattttatccttgctattttgtccaaggaactcttttttttcatataaattgagaataatttatcaggaatgctaatttttgtttaatttatggaagggcgatgcttgaagtaagggatgtttttcccagtctaattccgttccctgtaccagctaaatactccctccgtcccaaaaaaagacaaaccctggtttccgtgcccaacatttgaccgtccgtcttatttgaaaaaattataaaaaaaattaaaaagacaagtcacgcacaaagtattaatcatgttttatcatctaacaacaataaaaatacgaattataaaaaaatttcatataagacggacagtcaaagttggacacggaaactcagggtttgcctttttttgggacggaggcccactagctgaagttaaatgctattcctcacaatgttattatttgttttttggaaactttttttttcaatgatccagatcaaggttaggaacactagcatttatcggtaaactgttggaatagtttaaattcaaattttgtttttcgatttacacttagtaccgtttacatgccctcacatgtataatgcccattgataggatatctccacctcctacaagttgtgtcgttttcatttatcatggattcgtgtatgatgtttatttcaatgtataaattattacaagaatgtcaaacatcttttttttcaactagtccctgatcggtaccattattcaaattctttttttttttgctgggaaaaccgttattcaaattctaatattcgatttagatttacagtaaaatctattccctctatttcatattataagttattttgaattttttctagccaaatttatttaggtttgacagtttattaaaaaaattagttcggttaaatgtaacattgaatatgttttttttccaaatgttgctatattcttttattaatttgatcaaacttaaaaaagtttgactaggaaaaaaaatcaagcaacttaaagtcttttttatatgaggggaaaaaagagaattgaaaagatacgcaaaacaaggtgagctttagcgaacgattaattgagtattaattattttagattttaaaaaatagattaatatgatattttaaagcaatttttctatagattttttttataaaataaacatcatttagtactttagaaaatatgcgcgtaaaatacgagggagtttttctgtatctaccgaatcaatttctctcaatcagttttatgatatgaaacagagggagtagatcgctaattactggtcaggcttgggtgactggtactttttgcaaatactggtttcctaggttttatcctaacaaataatctggcgatattttacggtgtttgcattttaaaaagggtaaaagtctatcgctgcacaatgaaaggtaccacttaaaaggttgatatagttacttactccctccgtcccacgaaaatccaatcctagcatcccaagatagaattagtggaggatagaaatgactaaaatgcccttaatcattgaaaaaaagtagtaagagtaataataggt

SEQ ID NO: 41857 - DNA, 1646 bp, Oryza sativa
caatttctaaagtgctgcagaacagaagcaggtgaatctgaattgaacagtacgcaggtgactttcttcacctcaatattagacaaacaatcgttactttattgtctaagcaattctaagaaaattatatcgcaaaaaggtccaaatttggcatatagtaacgcagtgaaataatttcccatcctgataaagattattgattagtttccatacctgcaaaggcttcctatgcttgcagtgcatgcatttgtcaggaggcaccaacaaggacagctactgatctttgaaagagctagctacatagctacatatgtcagatggtacaagaagcaaccacaattagattgacatgcaaaattcgattaggaccaaaagagtttacaaataccaaacctgtactgcaacagatctgaaagctacaatattactccagaaaaagcagaataatataaatatctgtctccaattctccatgaaatacaaagaagtgcttgaaatgtttgcagcatatatgacatatttttattccatatataacatatttgctattccatatatgatatatttgtaattccaaacgatagataagccagctctttccatacctaatcagaaactaatacacaaaggtagttagcaaactgagtaactggttttggagaatacaatggccagccggcactgagcagccatatttctaaggcgttgttcgtttaatccccaagagagagggattggaagggaataaatctccttcaaatccacccataagagggattaaacgaacaaggcctaaaggggtttcatgtatgtaggtgtagaacccatagggcccatgagttatatatactaccgccatccttaaaaggatgacatcataaaatgcatgcggtcaaacctcaaaatgttaaacgattaatatatggaaaacatattaggatttgaatatgaaaatatatattagtagatttgctatgaaaaactattttatatagttatacttttattaagttttataaatacatagtttgaaaaattaatgatcgaacatgtgcatggaagactgacgatatccaaaatataagtaaaaaagaatggaggtaataatatggtggtataagtctcacactcttacatgatgagtttaataaataggttaaggccagagtataaaattaacagttccaaaaaaataactccggttaatgcaagtgtaagtagggtaaggcctgatagaagggctagagattagtgatcaaagtattgtctgcaaatatattgtgatagaaattgttatcaaagttatatttaggagaccatgttgatgcccaaaatgataagttttcatggctagagtataaagaatctagattacatcagtattccttactgtgggaaaatatctagtaatacattgttaactacttagtttatgcttctacctctgatgctttcacaaaagaaaccctcaccaatagccccacatgagcatgaaccattcttgaaatgatgaaaacgactggggtcgcgcactacgatctcatggtccacaatcttggaaatgtaggtgaatgcgctatggcaatcaccacatacacgcaggttctttgtgatccttattgggcaaccagggaaagttgtgagga

SEQ ID NO: 41858 - DNA, 1261 bp, Oryza sativa
atggccaggagcatctcagcccatttccacattttccccaattctcctccccatctaaccctaatcacctaatacccaaaccctagacacgggagccgagcaagagaggcgtacgggtgcggcggcggcgagccgccgagccggcgactgcggcgctggcgcggccgcacgactcgtcggcgcagggctgcagggtcccccaggagcaggtccgcggttgggccggagagcgtggctgcgtggcgtttgacggcgacggcccgtacacgggcgtgtcggacgggagggtgctcaagtggattcccctggagtgccgatgggtcgagcactcatccgccagccacaacagtaagcttcaatctctatctatctgtctttgttgaatgttggttgatcctgcgattcatccggtagcactgttccctcgatctgcaagttctgcatgcatttacctgcgtatgatgctactcagatctaagtacagagtacagttgcaactcctctcagcaatgataattcttggcatgtgtacttaagtctattattcccctgtcctacagaaaggaaatcaatttatgtagcagagctaccgtatccacttattggcaatggcgttcggcacactaccattacattgcatgattcttctacactaccattgcattgcatgattcttcttcaattcttccatgagaatccagaggcatttatcccatttccatattgttggatttttgggtctaaaatatgaagagaaaaaatggtcttgctcttgaacaattgttcatgaattttaaatcctcaattcatgagtccccctgcctcaaacattgcacaattttcaatcctctatatatttcacatattgccactcttatatgttgaacaattgtcaaatactagttgagtactttctatttgttgaacaattggcagttagtagttaaatcagttatataaatatatgaaattatacccaattatgttatacaattcagagggcattatggcaattttcaagttaaagcactaggggatttccatttgcacgtgtgagcactagggtagattactatgcacttagtactgtatcctgtaactatgctagtctgtaatctatgagtgccattgaatggttagtttgcagtctgctgcttgaaaaaaaaagggtatatggtactactaaattaattccattgtctgatgatgtcactagccgtttgcctgtcataaaaaaacagcatcactacagtagctagga

SEQ ID NO: 41859 - DNA, 746 bp, Oryza sativa
ccctggacccagctgcatcctggcctcttcttaattcctgatttcttcatcaagtgcctgatcctcgctacatccttccaccgccctgcagtggcatatatgttggagataagcgtgtaagatccatcattttcagcattcatctcgaccagtttgttcagagcatgttcagcaagttcaacatttgaatgtactctacaggcactcagtaatgcaacccaaactactgcggtgggctccattggcatatccttaactgttttccatgccttatctaatcgcccaaagcgggccagcaagtcaatagcataggcatagtgctctgcccgaggtgtcaaaccataatctgcactcatgctgtcaaagtacgatagaccttgatcaaccattccacaatgactacaagcataaagaacaaccaggaaggttatatcgtcaggaacaaagcctgctttccgcatcttgtcaaatatgtccagggcctcactaccacgaccgtgcattccataccctgtcatcattgatgtccaagaaatagcactcttttgagacatgctatcgaatacatgcctagctgtatcaacatccccacactttgagtacatattaatgaggcagttcgccacaaagtatgcagatgagtcatattggtgatgacgaagcacataagcatgaatctgcttacctatacgtatggctgccaaatgtgcacaggccatcaaaatgcacgaaattgtataagcatt

SEQ ID NO: 41860 - DNA, 800 bp, Oryza sativa
cgatgctatataaccaattttgccttttttatcattttattttagggtgttgatacctctttcatacagagtttatgcttcacaacctcctataatatggttcaggcaattgttcgccaagataccctttgccgtcattcacttcaacataaaattactacgtactcattcaattcaattcgttatctctagaatttgttttcaagataatccatttggtaattaatatttaatgtttaagactatcaattgttgtactgaaataaaattataaataaatctaataaatttgtgatagtatttttcaaggtaaatatatgtatagctttttaactaagcattttagaaactactagtcaaatttaaagggtttgatcatatctttttttctaaacatcaaatacttcctactagagggagtacaagataagcaagaaattctgcatttgtggatagcaccaacacactgcaaagttgcaccagctccatgtaaaattttcagatcaactagtcaaatactcattctttgaaaaaaaaagagagaagaaaatcagtttcactagttttgaaaacacgagcacaaattagaagacagaggaacaaaaacagaagtgacgaacaaaaaatgaagtgtgatatatatactcacaggagaagctgtatactgttgccgcggacatattatacagcacaaatgccggcgaatagttgccatcgtcctctgttctgaagtccgtcactttgttcgcccagcgcaggatgccaccgttgtacagtgcaggttcaggatgcgatttgca

SEQ ID NO: 41861 - DNA, 10260 bp, Oryza sativa
ttcacctaccaacaccacaaacattggcacatctgcccctcctttttcattgttggagaaccaatgttggattttgttgcacatgattagatctaattatacaacatggaaagcaccaaaagaaggtggagatgaacattccgtaggtgtttagtttcacctaccaacaccacaaacattggcacatctgcccctcctttttcattgttggagaaccaatgttggattttgttgcacatgattagatctaattaatacaacatggaaagcaccaaaagaaggtggagatgaacattccgtaggtgtttaatgtagatttctctttagaccatttaaagagcatgtcatgctggaagcaaaaaatctaatttaaaataaaatctgcaatttttcatgtttggactaaccatgtattgatgtattgtaatttaaaaccattcagtttcaagtttcaaccattttctataacatgccaaggaacatctgagcgcagggaccacatgacagtctcatgagtaggcatactatggatatgaataaagccatgcacttatcctataaactatcttgtgaaactatgattcgaagtataattaaaatgcactaatcatcttctgattctttactgcttacaaataactcccttatatgaaattaatatgtagtggagcctctcctattctccatcaaaagtaaatgaaaaaccttacaaagcatcggggtgtattgaccattagtaccttccgcttcaacatgttctgtgttgcttctgctggtgtttgagcgggtgttgcgttcttgccatcttcattatgtcttcttctctacatatgaaatatccatgcttaatcacgaactacagtgaacacacggcatagaaaggttggtagcactagaaacatttcatactttcctcttcccctcttccacaaccactcctctagctgccagctcagctgctaatgctgcttttgctgcttgttcctgtaaagcaaccagctgagaaccacactatgtggttaaaataagaaagtccttatgctactatgtaatcagcttagctacctcaaggtactctttattcatttcctcccagataatttttttgtactgtgtttcttcctcgttgtgaaggtacccatcaacctagaaattaatagtagcactgtagtaaatcataaagagcctaactgattatctttcaagatctaaagatgacataaataagttactctatgaaatatatagaagtgatctcatggataggatgaagtacctccgcatcatcaatatcagagagactttcaggaccttcatctgctttatcatttttacctaaggatgaaatatgcatgcagcaggaatgaacttatcaaaagggacctaaaatggaaatatgaattttcttgtggagtatcatcgttgatggtacagcaacaaacaaaccttccccttcaggatcttctgtagctacagaatcaccagcaactttcacagaaggaattgtcgaatgcttatctccaattatattctgtcaaaataagttaaattgagtattcaaattacaaaaacacattatatggtatacaacagaaataacaaatgcagatgttttaataaatagagaaaaaaaatcacaaattcagaaatttcacaaaattataacaaaactgcagattaaaccacagatcatagaactaaatagaccataaaagatatatagattttatgagttagatcctcacactgttgtcctaatagaacttataaatccatagctttgtgatgagatgctaaatctgaagttttttttatagtagaacataaatatgtagttctttttataaattcaatgctaaatagatactagctttgtggtattgtgtcttaaaactatagttttgtcaaaataaggccccatttgaaagtgatgaaacacgggtgaaatgaaatggatgatctacttgattaacacggtaaattaatattttgagaaataaacttaacaaatactccttcagttcgaaaatatataagtatgctaggttttttttagcagagtttaaggttaaggtatcatggtcagaattggatatcatcggaggcgtatgaatgcgggatgcacgggaacggcggcgcgtgatgagggcgatcaatcagatcgcgcaacggcagcatgaatggcgtgattcggacgcgctacagtacggcttggcaataggatcttatctcgagtttgtttagttggttccggtttgttgcattagttcttatctcttttaattagcaattcagttgcatataagcttatataagcaatctttcattcaataaagatcaagcttgaattcaatctactcttctcatctactttctctgttttctcatctcgttcttctagcgtcgccatcacggggcatcgcacgtccaatctcccgaaaccacgtccgcccacatcccacacatatccaatccagtctcttcctggagctcgtgacataaggtggaattactttgatgctctcgggactttatttgattgggaaagatttcatctaatgatgcaactaccagtgagaaacaaatgcaatggttcaatggattgggaaagtactccagaatctcttatatttgtggacaaatggagaaacccaaaatcccttatatttgtggacagatggagtagtagctaggaacaagttgtctaagcaaggcaatataagagagtttttcaaaaaatcataatttaggtgcatggaacaaataatccagggcggattattactgattgccacttccaaacgggacctatatacagtttcgtgtaaatttatactcatatacgtggtgcatgagaatgcaacatattcatataacaaaactgttgtacttgtacaggatctagatgatcaaaagtcacctttttctgcccttgttaatgaactaaaagagcacattatttagttggctaacaaaggaagaatgtatggtaaataggggaacaagcatgagcttaactatgttaagaacatattacctttggcggtgtcgtaatgttattctcaacatcagattcgcgtgcctcacaaactgattccagtgctgcctctttagatgcagcagttcctttagcatttttagcagcctccaacctttgtttttcagctcgttggaaagctggaggatcagagccaccctccagtccaccagacagtttcataaactgaacagtcatgcatgtgtcaggagtaatgaagtcccaaaactgatgtattatgaacatggtaaaggtctgttactttgttgtagcatttttcacagagtccatgagcaaaatgctcagctttatccttgtgcttgcaaagtacttctccagactttggtgaaattttagtaacaagcacttgttcatcagcctttgccaaaaattcttcaatctagcaagagggcagcaaaatataatgtttaatcaaatgcaaattggcatggatacaatacgttgaatgcgagctggaaatgtgtccaatcacttaagtatgaaatgaagacacctctaatcctaatcctgatgtactgtgcatgatagaggcaaaaaccctttgccctttgctctaaaactaaggaaacaaaccgataaataattcaatctcatcttatttttaaactaaataaaactagcacaaggcaccatgaacagtgcttaggcagtagtgggcagaggcagcatccttcgcccattgcatggacccctaatgggcttcacaatgacacatttacacctcaaggaccattttcgtttacaatctagcataatactatttcatttgcttaaagaatattcatatactccctccgtcccaaaatatgacaacttctccaccaacattctcttcccaaccaatcacaaccctccaccattcacttttcccacctaccttcactactcatccaatcacaaccctccaccactcacttctacctactttcttaataaccgtgttcaaccctaaaacttcttatattctgggacggagggagtagtagataacagttgtggatgatgaattgatgacatgaaaaaacagacatgaaagggggcaatacccaatttttttgccagatagaccatgtgaaccaacgggtaaaaataagcacctaaaactagctctatggacagggtaaagaaagtgaatgcatgtctagttgacatgggctgccctgccctaatcagtacttgcttaggtcaatagttgctttagtgtcatgagtaatgtcaaatacttgcaccataacagacaccatacactgatagtaattacaatatgtttcagcatagacagcttaagaatgactttcagagggaaaagttgtaccaacaatcaacttagcgctgtcattcccatctttattacaaatacatcgttgcaacaaattttcatctgtatgcggtaagtaacagcgcctatgaatttggcaatttcctggagagagaatccataccgttaagctacccgaatctgtattttcaaactctatcaagcgcttagttagtgttgcctcgcaaacatgcacaacagcaacctaaaaaacataaaacagaaatttatgtcattatatgctgtagcatagaatcatattcatgtccaattataaaaaatacaaaatgtagcatgtgcccgatacatgctaactgatacagaaggagggcataagacttcagaatacaattctaaataagtatatcagacaaaagtacttgggcttacaatatctgccttggtataatcatatccatgagagagagcagcgatatatagtgctgcaccacacaatccacttggtttcctcccagtctgcaacataagtcaagttattacaatcacaaaaaagaacctaaagaaggaaggagaaaaatatgctagcctgcatccagtctcgcttcatgctagctacaatgcgtaaagccgtatctgatacggcattgtccctcttccccagtaaacctacagataaaaccaacaaagtgacacaaaaaacaaaaataatcagactaaacatgtttggtttccttactaacccaagcaattgccttctggcattgccttgcaaagatctcagaaaagggggggataaaaggatggagcttgcattgcaattgaactccttcacatgagcaacacaagcgaggagatagtttgactatagtatgccccagtctgactactacacatgactctaccatatacaaatctatcaaatagttcaaaataaatatcatatgtgattttaaataattgttatatattttttcacaagaatgtaaaagcacgttgaatagattagataaattaaggtgaagaaattagtcaaaagctacataaatctttgtgcaagaattatcaaatggtccatccatcagtccacttctcactggggtgtaaatgcaagagcctatgactgtttcgagtaaaatttgattcaggactcgaataccacaatttcgatccaattctgcaaatcaatcaaacagcgcctatgatttaagaatcagaattcatgttgtaattgcaatttccaaacagaattgcactccaacatgttctccatggcaaatgtggcaggtaccaacattggaacagcctggcccagcctcttataattgcatgacatgaacaatccccctccccacattgaagaaaccaaatgtgcatattcaaagtgcatggaaatgtagagatgtacacaagaaatggcacatgtgttttcagccgctaaatttaaataatacaatttagtgtggcttacgttctgtaaaacgatgtatgaaaaggctggggtcgatgagcttttggataactggatgttccgcaagtagcaaaacttggcaaagctgcagaaaaacagcacctaggacataactgaaagaaaaatccagatgagccatgtcactaagggctacaagataagggcaggagaatggggcacttacacacttatctgcaaatggtccgagaaatcaataagaagatatgcctttttactttgcctagcacacaaattaggtataatgaatgtcaggaatgaatatcaacaaaagtttgaaacttgacaacagatatccaagggaactaataggaaaaaaaataatgctggacaacttaagaacagcaataactaatgaaaatactgtgtacgacctatgattgcaaatatagcacaccatctgggacatggacataatctacaatgagccacattgactgctagtttctataaccacctacatgctcatgtatttctatggataaagacaatcatggatgttatatgttctctagagaaatggaagttattttttccaatatgaccattgatcaagggttaaaaagtttggccggtgtcaaatcctaggatttgttttgcaattacagggagtattatgttctcctaaagggaaaaatgagatatagcataaccaggccattaagtactctgcgcttgaaaatttaggacacagcattcctttccacatggaagatatatttgagggccatgcatggcaatgttcagattgtgtgcttggtaaaatatatatgtattaaacaaacccatcacaaatgttcaccatgcatgctctatagtctggaatagcttagctgtgttatagtttaggcattttataagttcaatgacaaagaaaagaatcatgctcaagaaataattctattgaaaggtactgcttgagaaaaaaaacaagtacaatgagtgagaagactttcaataaatcaacaaagtaattaggtggtagcataccggcaggcaatataaaggcaagcagcagcaacatgagttgttcgacggccccttgtaaaattcttgtcaacagctagctaaacttcaacaagaataaacatcagcatcaccatgtaccatattattttagaaattataagctactgactactccctccgtcccaaaatataagcatttttagctatgaatctggacaactgtgtgtccagattcaaagctaaaagttgttatattttgggacggaggtagtagtaacaaagatacatactgtataatagcgatgagccatgctaataatagtatctccaccagccacatgtaagctgctgacaatctgcctaatctcctctcttcctggaaaaacaaagcatgaaattagcccacaaagtggcagcaaaatgagatagaggaatgacctcaaagtcgtacctttatttatagttctttcatgggatactgaattaccactctcaatgcttgatagaatactaccagccaaccgggcctgtaaagctccaaaacaaccaacatgagaagtgaaaaataaataaaccaaaccaaattagaagcaaagtgaaagatcaacctgcccgtcggcgcccttttggaaagttggctcaccatcgtaaacctgatcatcaagaaccttcccacacaaaccacaacatctgatcaccatatgaaaaattacataatgacacgcgcacaaaagtgttagagctggtacacagaaatttaagagtgaccaacaaggccatgcttataaacaatttgtactagctgattttgcatcgaaatggaaggagaaaaaagacaggaagggaggcctcacgtgtagtttttgtcagggtcctttacgacggggcagttatcttgacagtgagaacaatacattgctggagtagcaagtagaccgcagagtatacccccccaactaagatcagcctgcgaaaaaattccgattaattagctttttccactcatttccaagccgaaatggctaacatttacagatcagccattgaattataagcaatcaaacatccccagtgcggtgcctctcaatttttcgcctttccctattttgtactctctttgtttttgtttttttagttgcctaattggattcacgtgactgtttcaattccccaatcccaatctcccaacataatggagcataataacaaaatcatagtccaaaactgaaacttcactagtagacacagagggtggcactgcgaacctgtacttcccccacgaacagggggggcgggggggctctcggcggcgcagttgaggagagctcgccgccggcgtgggcacccggagagagagagaggtggacgaggggggggtggtaaaccctagctcgcggggaccgatatttttcctttttgcactcggccgcgcggctcggcggctttggaagatagggaaagcgggaatagaatagagggaggcgtggggaatgggagctagcgttggggaacaggacggggcggcggaggcgaatcgtgagatcgagggaggcggcacgcggcacggtagtagcgagcgacgaaagacgaaagggagggggcggcggatgggggatagatgtgcgtacaggctacagtagttaggttttgggttttttcttttttctttttgttttccacaaactggatgtaggtttttcggctgcagctaggatgccccttttcccaacccctctccctcgttttttacgtgcacgcttttcaaactgctaaacggtgtgtgtttttttaaaattttctatacgaaatttgcttaaaaaatcaaattaatccatttttgaaaaaaaaatagcaaatacataattaataacgcgctaatagaccgctctgttttctgtgatcactattctgttccggatgcgaacttgttctaccgaacacagccttaagcatcaacagacgtataatctctccgaaaatttgtttcagttttctaaactgatcactttaagagaaagcctaaattttatcaaaaaaaatatttccagaaaaatatttttttttgataaaatttaggctttctcttagggagatcaacttatttatttcctattttcagtttagaaaacttcttggtgatgctctaaaacgtcgtagtaatatgaatcaatcagttttatatagtactatcaggtcggctcgactcgatgagttgaattgagctagctgactcgttaagccaactcgggaattggaagggtgaagccgagaactcgactgatgggttggctggtggtggcggtggcgcaacagaggtaaccaccgatcgatggaacgatacccgtttggcgcctgcaggctccagggaatgtttctgagcttcttgctcaagaatgtaatcttgatatgatttaataaagctccctgtatttgtcgcaaaaaaaagtaatcagttagttcggtctcggtcttggcttttctgtttatcctgttttcaattttgatttttttactactcagcccttatacgatgcttgagctaataaatatcatgacagtggccctctaccagtgcctatatgatgtagtgcactgtaaacaggagcgaagccaaatctgagattgagggagccagaagacaaaatggccaaagtccatgacaatcaatgcatatacatactatagccttcatggcttcattgttggtagataatcaacaaaaatatttttttagatagaaaagaaggttcaagtgctcatatagttattaggtaatccttccatttaagattaaaagttattttgacttttgtcaaagtcaaactgtttcaagtttgaccaagtttgtaaaaaaaaaaagtaacatttttcaacccaagacaaatatattataaaaatatattcaattatcacaaatttagttaagtttgaagtagtttgacttggaccaaagtcaaaacgacttataatctaaaacggagagagtagcaactacctccaagcctcaaacatcacaaaatccagtactcaccaacggactaaatgtctatatactaaattatggacaagtgactaccgtacaagtaaaagaaaacataaaactaaaagtcaagcgattaggttattttgctgtattggggaaaatggacaaaacctcacttgtaggccgcgtccgatggtcatgttaggtgtgctgcgtacttgacggtgagacgcacgcgatcgttgatcgaagggcagaggcacagattgcggagagaggcttaccgcgtgcgtagtgtgtcactgttgccgacagtcgctgtcgcacaatgcgaagctgaagcgataggacgagggttaacgaagaagccgagacgtcgacatcgctactctgctcgttgattctctcgagcagacagaacattggatcctagtaaggtccatgggcttcaaggctagacaacaggggggacggatagtggggtg

SEQ ID NO: 41862 - DNA, 2956 bp, Oryza sativa
aagggggcgcgtgcaggtaggccggatcaaataattttttgggatcgcgagggagagatggaggccgccgggagggagggaagatcaggggagggagataaaaggtggaggtagaggcgcacgcggagagggggatgagtcgcgccacttgggccgacgtgaggagggacggacacaaatacatcctgaatccttacgtattttttttacatatcatatttgaggtaatatattagtttataatttaataaaccatatttagtacttactcttactgctaaatgtttgacgccgttgacttttttaaacatgtttgaccattcgtcttatttaaaaacttttgtgaaatgtgtaaaactatatgtatacataaaaatatatttaataataaatcaaatgataggaaaagaattaataattacttaaattttttgaataagacgaacggttaaacatttttaaaaaagtcaacggcgtcaaacattttggaacggagggagtatatgagctgaaattggtgcataccaacagaacccatctagtttaatttcaatgtacgcgtgacaactgcacgcgcaatatatgtcacaccgaaagttgggtatacatgcacttgcgagtcgtatgtgaactgtgatatatgatcatgcatgtgcactagtcagtatacttctccctacctgtctctcgttgttgcctcacgcccacatgttgttagtcttcacgttccaaactccctttctttcaccattatctgcatattgcgttctatccagccggaagctagcaaggctagctagcatgctgcaggccccattcagcgcagctgcttccacgtccataaactgccaagaattaatgctgtcaaggctaacgtgatgtatgaccacatagtactttgtaaaaatgacacgtaggagtatagtacctagtagtaagtgatgctgtataaaacttttaagaaagtcaaatgctcattagctttcagagtgaatttcagtttgacacctgttctttgccaaagttttacccttgcactctggacctccttttttcgttttcctttttctttttactttatagcatctttttactgttgtcatcaaactaatttagtcttaggtgcatttcagcatatttcgtgaaatactttatatatgaaattatttttaaagctaaataaatttattttaaaaatttataatacctaatactccctccgtcccataatataagaaattttgacattttgcttacactttttgaccactcgtcttattcaaaaaatttgtgcaaacataaaaaacgaaaagttgtgcttaaagtactttggataataacgtaagtcaataaaaaataaataataattttaaagttttttaataagacgaatggtcaaatattacaagtaaaatgttaaaatctcttatattaagagatagatggagtacttaattaatcattagcggattttttcacgcgatcagttaagccggaacggcaactaggcctcagtgtaccccactaagatcttttcaccactgcgtgtctgcgttgacaccctcggcgtctctgcctgcgtctacccaaagataagaatggtattgaaaaaaaagattcaaatacaaagttgtcaaagcaaaaatatgtgtttcaggggtttaacgtaaacttttggtaagaaaagagggttcaatctaaaattcatgcttggagaaaaaaaaatagttgctcctctgctttacctcttacaaaatgcacaagttttagtgcagctacatgcagcttgatagcgcgctccaacatatgtagggctgacacgttacaaacctacatggctacatgttatttatgggttatcgtttatcagtgggattatatgggttttgaacttttgatgccatgtgaaataagctacaaaatatagtcattttaaaaatattttaaacttagtgccctgctcgttcggtcaaaactgtagaactttaacttcaattacaataagtttataaaatttaatagggttaccatagtaaaagtaagcattaacaaattattggtagtcaaaatatgaaagttcaaacttatcgaaaagaggaataagagagctgagatgtggaagcaatgggtatttttaacctctcacatcatttttctctcctatctaactagaaataaatattttaatgtgtgcaatgtaaagtagcaaattttcacaaactttaaaactgttttctgaaaaaaaagttaacttttatcgtgttcagaactaaaaccataatatcttgtagtaaaatttgcgtttcttttcaacttatctagacactagctagagctagctgtacagttgcttggcttcctataaataccgtgtgagcacacatcaacacgtcgatccaagaagaaatcacgagagacaacagagagagctagtctctgtgtgctcgtgttaccctcactcacgacgggaactatggcgattggcaagaagcacaaggaggctgctgcactgtcgtcatcatcatcgcctcttctccctgcagatcggaaggctttgctcttgctgctgctgctgctcatcgtcttgctagctcgccctgctgcatcctccggtgagttaaccaatcgatccatgggaggaattaatcctgctcattttggcacccgactttatggatttcgcctgacagaaaaggaaaacaaatttgctgttttgcagatggagtgcgctatgattacagagcttacactgaggtacgcaacgcatcgtctagatctcttcctctctacctcatctcctatgctgatcgatttaccagcctcgtcgtttcgcctatacttatacttacacatttgtaaaaaaaagaattatgtgtaaaatttttataaacgaacttcacgattaaaaatcaaatgttatatgacgaaaatttattttagcttataagtataagca

SEQ ID NO: 41863 - DNA, 5398 bp, Oryza sativa
actgatattttattataaaataaattaatcatcaatgtataatattgaaatccgtataaaaaaacttggacatttatatttttatctcttaattgcaggccaaatggtataaatgctaaaaaaaatgttccccatgactttttttcacactctgtccaaagtttaattttaaggtttacagcctcagcatagcatgaccattaattgctctgatgagatttttctcaggtagcatagtaacaagctcggaataatacatcctcttgccaattccccgagtaatgtttcaacggcaatttccaaccacacttttttatcgccatatgtattagagtttttgccaacaaaaattagtacaggttcttatactttattaaatattttttctgccctggcgttgaactgtgatcacatgatcattgaaaagaccttcagccaaactatcatcaagttgctccctgtcctctggatcaaaatagttcaataatcaataccaattaccaaaggtgcatgcattgttgctggaaacaacatagaaaaaacagccaaacattttaatattgttctaaccaagatttgccggtgcgtatgcatgcatcaaactatatgaacatcagtagtccagatgaggtgcctaagcatccttttgttttcaaatcctctctcctaagtcaaaatgttcaaataatgctaaaaaggataaatagattagttatagtagtagtacacgaatgggttctggaagagattctccactcacttatttaatagagacttgtttgaccatcatgcatcaaccgggtgcctgtatatatgttgccatcgtgtttgttgacctggttagccaccaaaaaggcagacgcgtttaggaaacggtaaacagagatcgcacgttagtacactgatactagaacctgacataattttcataaatcaattatgaaaagatgaacaaaagtgtaaattctaaatgatttaaatttgtcaaaatttgcctgaaatgcatgggaaaagagatccatttcagctagtggcaagaagattcttctcttctttgctctgtcatcagcaaacttcaaagaactcatctacaaggattaattagtcattcttgtggaattgcttgcttgattttctctacgctgggtgaaaatcgatgggccaacaactgctcatgtgaaagccaagatattgacgctagcaaacgctgcatctcaatgccttggcacggctctggtgcgaaacgactgttggtccttcctcaagggtggtttcaccctcaactccgcttcagaaacctccgtcctctatttccaggtgatatacttaatttaattcctcacggttaagtcacagagagcacagtaatatattggcatacaaatttagctgaacctagtttagatcttgacttggtgaattaattaatcgtcatgcagtttgcaatttattcactgcagactgcaagcccaaatgcttcaacgatctcgatcagaagtgcctctttgcaaccattttcacctgaacaatggaatcagcacagggaggaccgtattcagctggtaataaaatgtacttatactgtttcgtcgactcttaggctgtgtaactcttttgggtatagagaccggtttaatccattataaaaaactgtcacacgatggataatttaaaaaaaatccaacttaattgtgaggaagtgtggagcaaatgatgatgccagcatgtaattctttttcacgaacagaaccggaagcgctttgtcaatgtccacgtggcggacagcaacgggagtcgcgtggttggtgccaaggtcgcggtgcatcagatcaccagggatttcccattcggctctgccatcagcaggacaatccttgggaacaaactttatcaggttattgttttcatgattctttccttaatttttttctgagatatatgacgaactttagcattgatttatgaaattaaaccgtgtgttaagcaacaaaacaaatagtggacagtaggttcgtagcggattgcaggtgtctatgtagcgaaccacggataactgaagctaagttccaataacgaaatttaataatcacacataaatttgagtatgtgtatcattaataatgattttataatacattaacaaagaaactgagaaataaattagtgatatttcgatacataacatagattaaagagtttataatgtgttgattcgtaattcgtggagcaagcgtcggagttggcaccatcgacgcctttagttgttatatcatacagtgactgctaccacggatcgctaactcagctcatatagcggctgctaggttacagctcgctatatccaatcggtagcgatagacattaaatgttatttagttgttttggtgttaagatatataatatatgccaatttagtaataataatgtacttaattaatgaatttgtaggaatggttcaacaagaggttcaatgcggcggtgttcgagaacgagctcaagtggtatgcaacggagccatacccggggaaggaggactatacggtggcggaccagctgttgcagtttgtgcaggccaacgacgcagtggcgcgcgggcataatatcttctgggaggacccaaagtacacgccagcatgggtgaagaatctgacggggtcacagctacgtgctgccgtctctggccgcatcgagagcctcctctctcggtacaagggcgactttgtgcattgggacgtcagcaacgagatgctgcacttcgacttctatgagaaccgccttggcggcaacgccaccgtcgacttcttcgacacagccaagcgcgccgacccgctagccacgctcttcctcaacgacttcaacgtcgtcgaggtctgcgatgacctcagctccagtgccgactcctacgtctcccgcctccgccaactcgccgatggcggcgtcaccttcgaaggcatcggccttgagggacacttcggcaagcccaacatcccctacgtccgcgccgtgctcgataagctcggcaccctgcgtctccccatttggcttaccgagatcgacatcagtagctccttcgaccccaaaacgcaggtacgtagttacatactcacaaatatatatctactagatgtaaaactcgagtgacagaccataagaaatactttctctatctcaaaacgtagctatctagtaccggatttaacactacctaaaactactaatctggacatgtgtagatagtgtcaaatccaatactaggtagctacatgagaaggaggtagtatataacctatatatctcattgttaatgtactatacgatgatatgatgttgcaggctgcatacttggaagaggtgctccgagaagggtttgcccatccatccgtggatggcataatgctgtggacggcaatggacaccaatgctagctgctaccagatgtgcctgaccaaccagaacttcaccaaccttcctgcgggagatgtggtggacaagctgctgggggagtggcaaaccaaggagaccctgggaaccaccaatgaccgcggctccttcaacttttctgccttcttgggagaatacaagctctcggtcacctatctcaacctcactgccgagggaaccttctcgctggcccatagcgacgacaccaagcatatcaacatccgtctatcaccatcatgttgaaattgaattgattcttgtgttatatagaaggatgtgatgatgaaaacttggtagtgtaccttaattagagggagactccatacgtttgtgttgatacaatggattcataatgtgtgttcgtacaaggtcatatatatgttgtatctatatcaggattgaggatttttatcatatctttcaaatatgggtttgtttgtgttttctatacagtacattttgcctatattgttaggctacatcgatcatcaggatattagtaacaactagcccacaacatgtgcacatttgggtatataaggtatataagctagcgattgtaaacactagaacatagggcgtagcatggcaccacgcccacagctaaacaactatagtgaactggagacattgaaaaatacaacttctagaaaaaaaaaactcatttgtggaaaagagtttacacaatgggagaccataggaatgagatattgcgcaatgggatgccataggaaaagcactacatctaataatccgaaaatttacacaatggaatgccatagggatgagatattgcgccaaaaaaaaaacaagtgtcctgcgctcttctctgcccacacaattcttcaccgttttccatgcgccgcctgttctgttgcttccttcgacacctgccctattgtttcctcatcgccggtgagtgtcctactgctcctcctctagcctggggtcgtagtgagggaggacggagagcaccatagtcgtcatgccgggggaggatggggagtatcatcgccatcttgaaaccccaagatcccagccactggaaatggagttcataaacactaacagaaaattaaggatatgaaaattaccatactttgtttcatgtagctaacagatcacgtgcttcgcaaaaattggtccttatatgctataattgctgatagcatattagtgtgcctaacaaatttgaaaaccttggatggaatgtggcactataaaatatgtaatatagcagctccaacctccaagagaaaaacagtctttacaacattttgttagagaaaatattgtatgcaatcagataaaagcatgccaatataagaactcctagaggtctctgaggaaaagagaaccaaatcaaaggtatcaaaatttgaaaatcttactcatataaaacattccaaacatgttattttagcggttcaactcaaactaagattctagcaatcaaaacataggataaattgccatgcaaaatctaatatcaagagctccatgaaaagcctgcaaaaaaagaaaacaatagtgtaatgtccctgaggacatatagaggtttaccttgttccttgcataccaaatccattagtctagcatgaacatgtagagaagaaaacctatattcagtctcatttaggtggcttgttatatgccatttaggtggcttgttatataaatggcatagaaccacatatggtagttatttctttatgttattttacctatgcattgtaaaccgaaagtaaaaaagcacataatgcttctaaaaaattaaacacacaacaaattttcaagcactaataatagttctgattatttttccctatggatctcagttagttcaaactttaactaattaagcgtggtgtaagctagataaccaacatgcttcttacggcttgagagttccatcacacaaaaaagacataagggttagtttttttttgttagggct

SEQ ID NO: 41864 - DNA, 4051 bp, Oryza sativa
ccaatactagtagctccatcaaagttgtttatgctcatcttgttggtgcataccatcacttcattaactagggatttttctcttttcatgttgagaagagattctccttgcatcataaaagtgaatggagacagcttgtgttgagttcccatttgacctatggaggatatataggaacatggggtggatacccagctaaacgtgaggcctgcatttcttgggtaggatggtagagtgaggtcatttggtctagcttaatatgcttcctagcagaagtatctatgtcaggagcagtacttcctagtgccttgtggctacgaagtacattaccaagaaagtgataggattcagtggtggtgattgcctcagcaatgtctgtgcctaatatgatgtcacggttgtgagagttggcacatacccatgcacggagggtgagctcctgcacgaagagctcacaaagttttgtcacaaaagttggtgtgtcagcagatagcatcatagcatcattctttggtcgaatgacattcttcacgcagtcaattggtagtatatgctcatggttgcctgcagatgcctcgatttgttcctggctcctcctccagaattcctccatggcatgccgttgttgtgcaagcaattgcaaccttgaaaatgtattgtcctcctcattctgctccacctcctcctttgttggaatcgccatttctttactcctacatttttaagtaatgcatgaacaataactcagttaagtacttgcttgaaacaacaacttatttcatcttcccagtaaaaatatgtaaattgaatagaaactacattgcttctcgttggaagtatagccactaacacaatttacactaacactcaagaattagtagaagtacataataatgatataataaacaacctttcttatatcaagatgttgaagcaggtgaccaatttatggtgtggtcgatgagagaatgggaaccaagcaaagtagtttatataggagtacaaagtagtaaaggatattgtggatgccaactggagacacgatgattcatgaaaaagcatcgaggttaggtgtctctaattgttctcttgtgggtttgttgcggggttctgttagcctttcttgcttctttccttttgcaccactgcatgtccatacacttgtgaattgatgtacaagcgatccactaattttatgcatcattccatacttggtggtctaagcctccacgccatccttggatgattcttctagctcaatgcttatcaatgtacaggtacatgctaagcgatggattttgccgcatgctagaaagagccttctggaaggcttgagaaattgatagtcagttgtaagtaagcagaggaggggattgtttgtgttgttttgtgtaacaacataactaataaagttgtttgctgcaatccaaacgtggtatgtcatatgttgagcccttttcctactttacatgtgttatggtgcatattgtttttcactaaatcattgtttttatgggccgaagtgctgagaataaagcccatctaaatgaggcttaaattatcttaccttgtattgtaatcctgcattactatacaattgcctcccaccatgtagcattaaatattctctttcataatagctttccacgttgtcatcaatgcatgactatctgattaaattttaagcgaagcacgactgtggaatacacatttcctgattttggtcaccctagatcaatccatcatccatctaatagctcaaatcaaattaggcattaatattgtgtgttgttcaactggcaatgttggtcagtatcatatgccgattcaaggggtgaatcagtagtgatattggtttccaaaacaaaaaaaaacaattatactacaatttttttatctcaaaaccaatttactagagatgcacttgatagtgcagtggcaagggatgtatggtttcaactcgaggtcccgtgttcaatccccaacacgcttataatttcttcttaaaaattttttggatggacgtctctccctcaaaatctcattttttatctaaaaaaaccaattcactacattttacatggaaaaaacaaatacatatcgattgaaattaacaagaactagataaaggcacgtgtgttgtaacggatgttttaagagataaaagcaaaaattgtagaccatgtttggtcaccttagatcaatccatcatccatctaatagttcaaatcaaattagtcattaataatcacccatgtttggaagccttgcttcatcatacaagcaaatccgattatgatttattctaatacattgtccagcgaaatttgcaggtcaatacataatatacagcttaaagactgcagatgcttccgaataatcacatccgttgtttactattttcgtaatcatggtctatcctgtttccgttgtcaagactatgtccaaactaaatactctaggtgctttcaaataatcataattttgatatatgccagttccctttcagtctaacaaaacttttgtgtaccctatcatacaatcaaattaatattcacatattgtcttactttagaatccttttacttccaatacaaactattcttctaatttttttctacaatgttccgtagcaacgccgcggggtaccttctagtttagtaaaatagcacggacacattgtagtaccaagatcttcccatttattttgtatagtctaggtataaactgttcttaccattttttttcttaatgcagggattgagtgagaattgggggaggggggaaagggtccatatgttgttaccgttttctctcaaaaaatagttttgtcaccattggatgcaagaacataggaacaattgtattaagacattccatgggaatttgagggatctcaacttggagggtatgttataaaacatgctctcagaggctggactaccaatcatggcagaagatatttcatctgatgatgatgcaccgactattgcttacataccaagctctccaaatgtaattccatcaaaagaaaaacaaatgaagacaattatgtaattaacaatataaatggaaatgacaatattgtaaatattattgtatggctgacacttttgcactaattaatgcatccgatatatgtgtattgtatccttattacatatttgttagctgctagatgttattattatattaaaagaatattaaatagaatattgtctaaaagtagagttaataagttcttacaaaacattcgtagtttgacgggcacttccatgtaatggtttatctagttgtatttctcctacatatataatcagacaattaattaatatttgactatcaatatgagccggatgataagaatattatgtttgcatccactcctgagtttggttgacagttgctccgactctgttcaccacttggcatagcgagcgttgtggacgaatgcgtcattgtctgaagtggtgctgcgcatttgacaaaacagaacccaattatattttctaaataccatgcacatacacatcaaactttgagcatgcacacataaattaatcagtatagcatcttactgtgcttgttattatatcgatatagtgtatgtgcatataccctcattcacacacgcatggcctagcttgtcgatcacaaacggataccagagatagaaaataaagaatgtaatttttatttttctgtcacgttattttgtttgttaagcaaagttaaattgccaatcagttacacattagctcacattagtatttcacacaccaaaaatgttagtgattcaaataatatatatatatatatatatatatatatatatatatatatatatattatatatatatatatatatatatataagtatttggcattattaaatagattgagacaaaaatagatgcattatccttacattccgaatcttttgctttcttcgagggttgggttgtaatcatatcagcatgaatggcgtcttgattgacctgagtaccacataaaattaagcaaggatctatattgacagggaaattatatg

SEQ ID NO: 41865 - DNA, 4623 bp, Oryza sativa
ttgcaattagaagtaagaagttcattacaaaagattgatagattgtaagggggaggagaagatttgtttccaaacagagattacaaatcgatcatcttccgttaagttctctgcccagagagctgcctcggtgatgcatcgttgtaggcaggctcttagtgaggggcttttcccccggaaaacaacatcgtgtcgatgattccaaatagcccacatgcaaagctggaagaagacctgccagtgtagcgccggcacttgcgagttggacccgaacgatggaactgcgtgacgtcttgagcttgcggtcgaacgttgatctgcgtccagaaagcctgagcgaacggacatgagaaacacatatgattagctgtttcatcttcctgattgcagatgtcacagattgcctcctgaacaatggttttcttcagcaaattttcttttgtggacaggcgattacggaccagtagccatgcgaagagtttaacttttagaggtgctctgcattccaaataagatcccagttcggagatggcatgcctgggggtaatcttgcctcatagaatttcttagttgtcaactttcctagctttgcactgaggcggaaatccatctcctcgctcggagagaagttctgcagcaattcctgtaagcagcacagctctgccgatgcagtttcagataaacgtggaacaagattttcagaaattcctatgtgaagagcttcctttacttagatttgtctgtcacacacatgggagaagagattgctgaactgacttgaaaagctttcagtcgaaaaccatttgtcgtaccaaaaggaggttcgctcaccatttcctaccacgacttccgtcaaagatcgcagttctggcaacaacttttgaaaggatggccagtgatgccctagacgagttgagcacagtaacgaggaatctgaaatttcgtcccagacccatcgagtccaggaggtcttcaagttgtaaagagcaaggagtcgtttgagaagaagtgcctcgttctgaatctttaagttcttaataccaagtcccccatgttcttttggcttgcaaactgattcccaagaaaccagacattttgctcccgagcagacatcatcccctgtccagagaaaagcccttcttcgtctatcaatttcttctataatttttggtggaagtttgaaggcacacattgcatacaccggtaggctgctcaggactgcgtttatcagaacaagacgctccgcctgcaataggagagatgcttaccaaccagataagaaaccatcaaccttgttaaccagaggctacaagtcagctgcggacagtttgtgaattgataagggaagtccaagataagacatcggaaatttctccagcttgcactgtagcaatccgacaaaactagttccttgctttgatcgacatttagagtaatcatagtgcttttagcaaaattgatttgcagtccagttgccttggagaactgcagcagagtctcctttagagcaagaacatcagcctcctccgcacaacagataatcaatgtatcatccgcatactggatggtggtacacagcctgtcttggtagattgcatgtctgatttcagtatttctttcaagcaatctttgtagcacatcagcaactaagacaaacaaatatggagatagggggtcgccttgtcgaaggcccttcttgcagcgaatccatcttccagggactccattaagaagcactgcagacttggaggaggaaagcaaccccttaatccagctaatccagttttctgggaaacatctgacagcaagaatcttgaaaaggcttgaccaaatgacggaatcaaacgccttcgcgaaatcaagctttacaataatagtttggcacttccttctgtagcatgcttgaatcaattccgtcgcatatataagattctcatagatgcatctccctttgaggaaacccgtttggtctaaatgtatcatcatcgggagtaccctttgcagccgtgttgcaagcactttggaaagaatctttactgagcagttctgaagagagatcggcctatatccatcgaccgtgttttctttaccgggcttttggattagaacaataattacatgtattgaattctgcatcacagtttgctcatcaattctccaatccaaaccaaccaatcaatctcaatttcacatccccaacaccaaaactctcaaacgaaaagaaagaaaaagaaaagcagagaactttacattccacacgcgtcgagtcgagtcggatagatgaagtataagagaagaaggatgatgaatcgtgtcagatggagacgctgttgggtatccctctcccggtgatccccttctccttgccggcgacgtcgccggcgtccgggtagagcagcgtgtacggcaccctcacggggcccctccggttgacgagcctggggtccttgttcctctcctccaccctcttctccacccgccggagctcgtcgcggaacctgtccagcagcagcagcacctcgccgtcgtccgtccacgtcgacgtcgcgcgctgcccgaggtacacctcgtcggaggtgtggttggacagcacctcgatcagcgcgatccccagcgtcgccgtgaaccggtcgggcaccgtctccaggaagaaccggcccgggtcggcctccagctgcgccatctccggcgaccccgggagcggcacgaaccgccggcaccgcgtcggccggttcggcgggtacccggcgtagccgtactggccgaagttgacggcggcgtgcagcgccgacgcggtccagatgagcgtcgacagcgtctcgacgaggcccgcgacggtgtcgaggtccagccagcacgcggcgtcgccctgccggtcgccgtggcccacgcggcggacgtcgtcccaccacgcctgcagctcggcgtcgccggccaccgccgcgtcggcgtggtagaagtggtcgcagtagctgcgcacccagccctcgatggcgagccacacgtcgatgccgtcgacggcgtacgggtagtcctcgatgtggagggacacgccgccgcgcgccttggggtccctggacgccatccccctggttggaaatgttttagttaacaataaattctcaaatcaattctactctctctagtcaaaattattttacgtttaaaacaacaatatattcgaacttttaacattcccagaatttatgtaagattttttattaatatacagttgattcatggaatttttaaaattttatttgaatcttgttgtcaaatatttggctatcataaaatgcaccaaatgataccaagtgtgttgctacgggacattaatgtgtacgccgcaattgtaaaattgaagtggctaggcggatcgaaagccgttgatctcaccgagaagtaactaaaaattcagacatgcagtaaattaagaatttgtggttctattcattggcaatgtaggaattgggatgatgaattgattgtattttgtacctcttgatgagatcattaggcagggactgctcggtgaacctccaatgggcatagatatcggaggacatctccatggagtacttccccgggtacatggtcttctccaggaggccaccggcgttgagcagtatgctcctggccaaggtgttgatctgcatgttgtccttgaagtgcgggtccaggagcttgtggatcgggtgcatcgcgctcagctgcctcctcgtcgcgatgatgaacggctccactgtcgcgtgcgtgaacagcctgttccattcatggattaagacggtgcatatttttatggtcaagtcaaatattttgttttcagaacaagaagaatttcatgtcagcaagcattcagagaattgtcttgtttcagaacaagaagaatttcatatcagaattcagagaaatgccttgcttcagaacaagaagaatttcatgtcagaattcagacaaatgactcgtctcagaacaagaataattccatatcagcattcagagaaatgtcttgttacagaaagaattgcagatgagcaatttcttgtttcggaacaagaatttgagatgagaattcggagtttcagtctttcagaaacaatgaagggtgtgtttagttcacgccaaaattggaagtttggttgaaattggaatgatgtgacaagaaaagttggaagtttgtgtgtgtaggaaagttttaatatgatgaaaaagttaaaaatttgaaaaaaaaaaagtttggaagtaaactcggccgaaatcttggaccgagcactgcaaaacttgatcacaaaaggggatgtttggacagaagcactcaaaaactcataaaatggtttaaaaccaaataaaccacggaaataaatcccctgatttcgtacaatttatagttttgccactaacacgtgggtcattgtaaagtggggcccacgtgttagtggcacaactgcaaactgtataaagtcgagggagtctatataacatagcaaatttgcaactgaaattttaagacataaggttgcaaagatttcaccccgacagtactgaaaactgattgatcgaggcgtgtgccctactcaccagtggctgatgagctgatggtacccagaatcgttgacggcgaca

SEQ ID NO: 41866 - DNA, 9365 bp, Oryza sativa
gagagacacgtggctagacgtacgaggtgggccgcgttgcgtgtgcagtgcccacatgtgaaacagccctgctcatcttagctattttctcagtatagtactataccgcgcgccaagcagccattgggcttaagctatactaaacttatatctactcgttatttacatgtcatctagctaatgatgataaaaaattaagaatatttaacaagatagattaatatgtgataaatcaattcacaaacatacaaagctaattttaacttcgacaagttgcaacaaaataacaaatttgactgtgaatatatgttaactagtcataatttaattctttttaacttgtaagagttaaattttaacttgcatatttgtggagtggcctatcatatattaatctatcttgttattttttttaaaaaaaaaatttcataagcagttagatgacatacaataacccaactattccctccgtctcagattctgcctcagtttacacaacccaatacgtatatataaaggcctgatcatcagctggccatttgcccacacaatcactcgttgttgaatgttgagtattctcccatcgccatgaacgccttcctcgagctcgagcccttctccactcctctctttgagatccccgatgatgctgattttgagtacacatccatgctcgccgctgacgacttcctcctcatggacggtgactttcttgctgaccagccgccggtgtcggtggaggtggtggcaggcggaggagatgccagtgggaagcggagtttccatgccgacgacggcgaggccatgggtgtcgtgtcccggtcatctaagaggaggaagaaggcgccaaggaattcgagctcactgtccaactgcgatggcagcggcggcgaggggagtgagccgacggcggaaaggccaggtggccggcgggtgtgggtgcgggagcggagcacggaatggtgggaccgcatgaagggacccggtggcgtgcccggaggcggacttccggcgagccttccgcatgccgcgcgcggtgttcgacaagctctgcgacgacctggctgccgctgtcaccaaggaggacaccacgctgcgcaccgccatccctgtgccccagcgcgtcaccgtctgcatctggcgcctcgccaccggcgacccactccgcgaggtgtcccgccgcttcccctcggcatctctacctgccacaacatcatcgtccaggtctgcgccgccatcaccaccgtcctcctcaccagggttgtccggtggccggactcccacgccgcctccgcgtccatgttcgaggccttgtccgggatccccggagtcgtcggcaccgtgtacaccaagcacttcccactggtggagaaaccgtttgtagtcccggttggtaacccccctttagtcccggttgtccaaccgagactacgaatccgggactaaagatagttatctttagtcccgggtgaaataaccgggactaaagatcgatctttagtcccggtttgtgttaccaaccgggactaaagatcgattagccacgtggccggccaaaccatctttagtcccggtttgtgttaccaactgggactaaagattggtgcaccatttttttttatttgcatggccctgtttgctgcatggttgattttatatatatatatatatatatgtgtgtgtgtgtgtataaatcatatattacacacacatatgtataatttaaggcacttaacattttatgtgcatatatatatgttaccaaaatatatattaacacaaaagtaaatgcgtacatatataaatatatatatccatgcatatatagtacaattcatttggttggtagctataactacgacttcgacgccggcgttatgtcagaagaggaaggaccgacgttatgaattgtcgatccgtcatagtagaattcaccgtcgggattaaggacttcttcgttgatgaatcccatcagttgttcttgaacagccgtgataaaatccttgtgtgggagattatccctcatgtgaatacgctatcgttcgaaaaataatgacgtatcaatatatgaaattaataaacaacgtaacaaatcgagcaatgaaattttgaatggtttatgtatacgtacatcgagctctcgtgttgtgcatatttggtttaataggcagtgggcatactcgcatacgtagtagccgcataagttagttccctggtcctgctttgcacactacatgagaaacgatgagagatttaatatactatttatattaactgtaattagatattcaattcaatataattttggatcatgcatgtactcactggaaaatgaaacctccgtccaagtttttctttccaagtcccgcggaccaattgacggaaccgatcccaagccctacatatgcagttgcaagctatgattaattaattattacctgagatcaacataatagcaatagattccccgtgactttggaatagatggcattatattacatgtctatcagtttgaagaccttgtcaaaaatcttctcctctttattcattgagtcgtacatagctctgcatgcgtccaagtcgaagaataacaggacccaatggaatttggaatatgcgtgagatgagatatatatgatcgaaaatgtacatgctatatgtatgggaacaaaatttgttcgaacgacaataaaaactcactctgtgttgtacggcagtagtatgtacgtcttgaaatgctactgcgttaggagatggatgagattgtcctctgtgtctttctcgtacttgtcgatcatttcggtgttgattttccaagggtcgatgaacccagtatcgtagaccctccgccgtcgggccctttgaatctccattctacaacgatgaaaggaaagtattattgcttacatatatgccaggagctaattattgaacgaaacaaatcgaactcaaaaatactcacaaaatccatgccctcagaagagagatgtcgagggcgtccaactggtacagatcgaagagatccttgaaatggatccagagatcttcccattgcaagaagtcggggtttctgatcctcgctccgaacatctctctacccttggcgctcatttccatgtaccgttcatggaatttgtacatctgtgtcggtagggactgcagctgttcaggtttgacaagcggtttaccgagttcaaacttgtatgccacttccgccttcgggattggtgcgcctccaaccaactgatccacagttagaccggtgtctgaaatgaattccgttatgccaaaatcttcgccggtcaccaatggcccaacctcttggtttggttgttctccaagctgagggactggtttggacttcttgtgataggctctctgaagtgtttggtcatagtccgatatctgtaacgcctcgtttgttgtggacattcccttgaagaagttcttcacgctcgggtcaataggtatattcttttcaggactccgaggcttgagttgcctcttcacctctcctgccacataagcatcaagctcctcttgactgcaatcgtacgatggctccttgtttttggtggcgtcaactttcgccttcttcgttgcccttgtgcaggcaggcggtggagcttggcgagaccttgtcttgggaggtgcaggcggacacggtggaggcggaggagccagaggagatggtgcagtaggaggtggcggaggagccggaggagatggtgcaggaggacgtggcggaggaaccggaggagatggtgcaggagaagatggcggagccggaggagatggtgcacgagacgccgcttgtagcccaggaaggatgatgtaccgcttgcgccatagtatgatggcgtggcttgtgtctcgtagatgcgtctcaccgtctcctcctgggtagtccaactcgagatcctcgtacgcggcttccaccagctcaacttcgaccctcgagtatcctgctggaatcggcctgcagtggtaagtcccggaagggtccgttgggatggccattcccgacgccactttcacgtgatgagaggttatctattagtaatcaacctaagcagcaacttgcggaatgtacaagtcaaaaatcattaaaatacgagcataccttgattgataagttcttcaagggaatatacagctcacatggtgtccgctgcgtgatctcatcaacggggcaggtggtttcgtcctgggtttgcatggcgtccatgctctgtgatccgacctgccccgttgaggcgcagctgctacgattgcctgatgggctgaccattgcaggatgaatgtacggctggggatcctgggaccgatgtgcggccatacgttcatccaccttccttgccacctcctcttgcatgctgagctcgtagctcgataccctgtactcaagatttgcaatcttcgcctcggtatctctcttgctcctcatccgactcctgtacgtgtggatgtcctccttaaatccaatcttccagggaatcacgcctttccctcatgttcgccctggatgctcgggagtctatagggcgagtgacagctcatccttctttctgtcgggtcggaatgtgccctgagaagagtctaccactgcgtccgttagtcgactggcagcctcgcgtatctgatcgctgaagacaagggagccatcaactgggttaagcgttccaccgtgagcatagtaccaaaacttcgatcgatccggccatttagcggtggccggtttgatacccctctcaatcaaacttgcctccatctcctcccagttcggcattgcgacgctatatccgcctgaccccaagtggtgatggtacttcttcttggcggcattgtctttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctgaaactgttatgctattttctacagagtccactgtttcactatgttctccgtacccgcgggtagtgtgaacgtctcgagcattgtggtccacagcatctctttctccgagtccgggacaaagctgtcattatccccgtgtgcccttgttttgtgccagtacaccatgctgacaggcacgttgtccctcacaacccaaccgctgtggcgtacaaaattcttggtccacctcagttatgatgtgctgaccctctatcttcttcgcggcacctcgttgtccgcgtgccctcttctgtccagcggagggaagacttccactagcctcctcctcatcgttcccctcctcgttcccctccgcatccctctccacgttcctctcctcgttcaagtactggtttggatcctcgttcccctctccttcgttccagtattggctgcttccctctgcgattgtgtcgtatagtatctgttcctcatcgcgatcagccatctgtgcaaacaaaaaatatttgttaggtatataggatgtatttgcgtaccgtaatattaaaactctgctaatcttatattaaatctctaataatcttatattaaatggctactaatctcatattaaaattgtaataatcatatatatatgctaagtctaacaatcttatattaaatctctaacaatcttatatttaatctctaataatcttatattaaaattgtaataatcatgtatgctaagtctaacaatcttatattaaatcactactaatctcatattaaaattgtaataatcatatatgtatgctaagtataacaatcttatattaaatcgctactaatcttatattaaatctctactaatctcataataaatcgcggctaatcttatattaaaattgtaataatcatatatatatatatatgctaagtctaacaatcttatattaaatggatactaatctcatattaaaattgtaataatcatatatatatgctaagtataacaatattatattaaatcgctactaatcttatattaaatctctattaatctcatattaaatcgcggctaatcttatattaaaattgtaataatcatatatatatatatgctaagtctaacaatcttatattaaatggctactaatctcatattaaaattgtaataatcatatatatatgctaagtataacaatcttatattaaatctctactaatctcatattaaatcgctactaatcttatattaaaattgtaatagtcatatatatatatatgctaagtctaacaatattatattaaatctctaacactcatatatgctaagtctaacaatattatattaaatcgataacaatcttatattaaaattgtaataatcatgtatgctaagtctaaccgtcttatattaaatatctaacaatcacttctttacatcacttgcctgcgcgaattccttcgatggctagctaccactttggcttaaggtacgataacgacgtcttctctgcaacattaccaggaaaatgtattagtctaaacgggccaagttacatatataatcatatatgtattaccagtaaatcgtattagtataaacgcgttcgttctcacacttttagtacaagtgcattcacattcgtaagtgtttcgtgcacgttcgttcgcgttccgtaatcgttttgttcacgttcgttcgcgttcgttaacgtttcgtgcacgttcgttcgcgttcattaacgtttcgttacgttcgttcgcgttttgttacgctcgttcgcgttcgttaacgtttcgttcacgttcgttcgcgttcgttaacgtttgcattcgcattcgttaacgtttcgttacgtttgttcgcgttcggtcacgtttcaatcacgttcgttaacgttcggcactgttgggcgcgcgcagcagtggcgtggcggcgcggtggccgcgccgtggcatcgcggcgacagtggcgacggcgtggcgtcgcggcggcgtggcgtagcagtcccgtggcgtggcgcagcggcgtggcgagctcgaggcgggggcggcggaatggcagtggcgacggcgtcggcggcgacggccgccgcgtcgaagccggtcgtcggccgtggagagagagagatatcgagatcgagatcgagagagagagaggcagcggcggctctcacccaagagatgcggtggcggcgtctgcggcagaggcggcgaggaccgccaagcgacggcgagagacgacggcggtgtcggcgcagggttgccctaggcacggtggcggcgaaggagatcgagccaagattgaaaaacgtctaagtgttggtggagaagacgagggcgcaccggcaatatatatacccccggatctttagtcccagttggtgagaccaaccgggagtaaaaatatctttactcccggttcgtaacaacaaccgagactaaataaaagatctttactcccggttgttctcaccaattgggactaaagatcttttcccgctattttcaaattctttttaaacccggttagggttaggaactgggactaaagataatagcagctgtgtcttgaatttcattgcatatgtgtttctaaaatagtaaataatgcattacaattatttaaagtcgaacaattaatgataaaaccttcgaaaaattattattgtatgtactagaatacgtggataatatataataagcacatgaatgatttaaaattgttaaaaattctaataatcatttataattagcatatgcatgatattaaatggttaaaaattctaattaacatatgtaaatagcacatgcatgatttaaaattaatacaaaatctaataatcatatataactagcatatcatgatattaaactgttgaaaattataattaacatatgtaaataccacgtgcatgatttaaaacctttaaaaattctaataatcatatataactagcatatggatgatttcaatttgattaaaattctaataattatacataattaataaaaaatctaataatcatatataactagcatatggatgatttcaatttgataaaaattctaataatcatacaaatttaacatatgccatacaacaattgatttgtatggatattcagtacatccaacatagtttacatcgtgtacagaacaattacggcaatacatcagcggtgacagttgaccgcacgtactttctcctcactattgttccttccttgtgatggctacgtgagtaaggggtgtcttcatttgataggaggatgctagggtcaatcgtcaccgtgaaagggggttgcccatcaaactgattgtaattctcgtcagtcttgtcctctactccgacgatttttctttttcctgggagaaccacgtggcgcttcggctcgtcaagccctttagccttttttcgttgctagacatgtccttgacgtaaaaaacttgggttacatcattggcaaggacaaaaggttcgtccgagtatccaaccttgttaaggtcaaccgttgtcatcccactgtcatcattcgttacgcctccaccagtcaacctaacccattggcaccggaacagagggaccttgagaggtccatagtcaagttcccatatgtcctcgatggcacagtaatacgtgccagttgtaccatcgtgtcccatggcatcgatacgaacagcactgttctggttcgtgctcttcatgtcttgggccctcgtgtagaatgtgtacccattgatttcatatccctggaatgtcgtgatcaagccagatggttccctcgccaggaaggccagttgttggttaatcgtcttgttacccatgagatgttgtcgcagccacgtggagaaagtatcaatgtgatgccttgtaatccatgcatcggacttactgatgtttctggcgcgaattagagccaagtgttcctcgatgtagggagccaccaatgaagattgttgcagaaccgtgaaatgggctttacggaataaattgttgtctaccgtcattattgctttccttccgagagtcccctttccccgtagtctcccttgagtcccctttccccgtagtctcccttcatggcgtgattcaggtaccctgattgggcgaaggtcttcgataaattctacgtagaattcaataacctcctctgttccataccccttggcgatgcttgcctctggacgagcacggttacgaacatactttttcagaacgcccatatacctcttgaaaggaaacatgttgtgtaggtacacaggaccgagaataccgatctctttgacaaggtgacaaagcagatgcatcattatattgaaaaatgaagcgtggaaatatcaactcaaaactgacaagacattgcaccgcatcatt

SEQ ID NO: 41867 - DNA, 3683 bp, Oryza sativa
gcagtctgcatgtggtggattcttgggaagaaggtggtggtgaggtggggtgaagagggagatgcccaaggtggccggagatggcggcggcggtggccggaggagcgaggacttgcgcgttgttttcctcagggtcggcgccgccgtcgcgctctccgtcgccgggctgctcctctcgcggcggcggccacggcagcaactccggttacctcctcctcctcctcgctcaggtatcaacagcagaggcgtcttgttcaacgtttttttttcatttcgggaagaaattccagattttcagatggaaaacaaaatgaaatttcaacgaaaaattggaatatgaacaatattttggctcaatttcaaataaatttgattcgttttgggccggaggaacattcggacccaccggtcaatctgaatttttgggaatttcgttccggaattgtgaacccgttgtttgttgctgattgctactcctagttagaaaattttggtgatgaatcgtttcttgatgtttttttgcagattcggatggaatgaagggtggtggagggctcaaggatgagctgaggatcctcaagaatgtaagaatcttgtttgcacataattattataaattgtatatattaatgtacttttcatacttccatttatatttagaatggttcagttttggatgtatggtcttgaactgttcataatccagctatattttcctcattatattataaattctctaagtctgtccatatcacatgcatttggggtgtggactttgcttttgttttttaatttcaaccttttttcttctctatttttttagtctcatactgcttgtttctattccagcagtttgacaaaatacaacttgtcctcaaatgttaccattgtattccatttttcttctccttatgttgaccctcttttgttttgattgtgaaggaggataccaaggccaaaatcatcaatggaaactctgtccacactaccactaccactacaacgatgaccaccaccgcgttagtaccactgcccccaaaatgtagaactcttgatgatgatgaagaattcctcctcccagaattcaacgaaatagttctcaaagaattcggccgagacatgggcaacattgcaacctcacctgcaccaagggtaagcgaagaagatgcaacgaagaccccggaaatttttgagcttagagaaatggtcagatcacttcaagaaagggagaagaccctggagctacagcttctagagagctatggtttgcaggagcaagatgtcgcggtgcgggagctcgagaatcagctgaagatcaacaccgtcgaatcgaagctatacacgctgaagatcgaatccttgcagtctgaaaatgagaggctgcaggctcagttaactgaaagctcaaagctggcttcagagcttgaggcagctagaatgaaatgcaagctgttgaagaagaagctgagacaggatgcagaacaagcaaaggagagaattgcctcacttcaggaaatggccgattcttggcagtgtaaggagattattactgaggggaaattcagtgctgaggttgaggaaaaattgagtaagctagaggagttggaaaatgaggcaagagagcttagggttgtcaattcaaggctgcagcaggagaatgcacatcttgccaggcgattggagctcacacgcctgccccctgtacccaagcccatcaataacatggaggtgaatatttactgttcttgaactgtattgtagctggcacttactaatcaatcttaatcttcagatagaggttgttactcgtcagaaggaaacgctgttcttgatatttggtttgaaagagcaatcaattgtttctcataagcgctactgatttttcaaactcatttttcagtgtttacttcagcttgtgttgctctgtcaggaactgaacaagtaaaattggttgcaggtaaaagcattgcaggaagctgatcatttgaggcaagaaaatgacaagctggcaaaagaggttgaacagctcaagactgacaggttttcagatgttgaggaattggtatatctgaaatggatcaacgcttgcctgcgttacgagctcaggaaccaggatgctccatcagggaaaaatgttgcaagggatcttagcaagacactaagcccccaatctgaagagaaggccaagcaactgataatggagtacgcaaatgctggtccggatgagaaaaactttgatcatatagagttctgttcagagtactcttcctcaagagcatcatcattaggcgaacccgacgacgcgtcgatcgatgtctcactgatgaacaagcacaagaaccctaagaagaaaaagttcttttcgaagcttcggaaatggtactgggaaaagaaaaggagaacaaaaccattcctactctggagaggaggatatcgatttcgagctgttcatttgacgagttcaatggaagagagtcaattgatagctattcttcattcatgacagaacctggtaattctggcaatcaacagcatgataatcacggctcccgttggcattctatggacagccaaagtgctcgacatctcagcaaggaaatcgcagatgcaagaaacctccatcttggggtcaagagtgtgtcttttggggaggggagagtgagtaattttgggcatagttctcaccttggcaatggtgaagccacggttcctgaagatgccaagaagattcacaaatttgcagaggcactgaagacatctagaccaggttctaggtcatcaaggaaggaccactgataaacaaatagcataggaacaatctgctgcagagtgcagtaggcccatcttcctggatgtatatatttctccagttcttgatgggagattacttatagaagatgctactggaataaagcacacatgctttattctgtgtaaaatgtacaatacagtatatagtagtgtagtgtactaacctttaatcccagccctcaaactattcatttggggttggcttgtacttattcagtgtattgttcatgtattgctctatgcatacttcactccagctacaaacatacagctctttgacaagttatttatgtgtgcaaagttatgtattttacaatctttatagcctagattagttaagaccatttgtatatttgagtatccaccttactagtatgtcctgctcttcccctgtacagtgatagctttccagggggagggagaggagctagcgatggaggccctcgtggtttgcctaaaatttggattttaaaagttaattttgaaaaaaaaatcatctaagtttattttcaacatctattatatactaaaagtccattaaacatcctacaaacgctttcaagccgtcacaaaaaaattcctacaaacactcctaagctgccatatggcactctaataaattagatttttttttctttaaatatggtggacctattattttttaccataaaaaataaaaaaattgaaaggcccacgttcctctccttccgacctgtacgtgtagtacgcacgccatgctaccgtacgtacgtacgtagatgtattggcccctccttcctttctgttcctctctctctcttatttttgatgacccttctgttcctatctctcctattttgatgatgtggtagagtgaaaacatattatatgac

SEQ ID NO: 41868 - DNA, 4527 bp, Oryza sativa
gcccttttacatgtcattggaattgccgtaaaagaattatgaaataatccaacaccacatgttgcatcatcatatgttgtttttgcaaacttgcatagctaaattagatagacactatataagtaaatagaactaactaaaatatgaatagtccaagctaccaatgcatagcaaatccaatgcccatagttagagaaaacaaactccaattatttcgtgaattttttaaatgtgctgaaataatgcgagcaagctaaatgatctttcgtgtatttgctctaaactatgttaccatcaaattaacattagatggttcttaatgcaaatttagtatatcatagatatatatacatatatatatatatatacatatatatacatatatatatatatacatatatacatatatatatatatacatatatacatatatatatatatacatatacatatacatatatacatatatatatacatatacatatatacatatatacatatatatatacatatacatatatacatatatacatatacacatatacatatacatatatacatatatacatatacatatatacatatatacatatatacatatacatatatacatatatacatatacacatatatacatatatatatatatacatatatatatatacacatatatacatatatatatatacatatatatacatatatatatatatatatatacatatatgtatacatatatgtatatatgtatatgtacatgtatgtatgcatatatgtatgtacatatgtacatgtatgtatgcatatatgtatgtacatatgtacatgtatgtatgcatatatgtatgtatatgtacatgtatgtatgcatatatgtatatatatgtatgtatgtatgtatgtatatgtatatgtatgtatgtatgtatgtatgtatgtatatgtatatgtatgtatgtatgtatgtatgtatgtatatgtatatgtatgtatgtatgtatgtatgtatatgtatgtatgtatgtatgtatatgtatatatatgtatgtatgtatgtatgtatgtatatgtatgtatatgtatgtatgtatgtatgtatatgtatatatatatatatatgtatatgtatatatatatatatatatatatgtatatgtatatatatatatatatatatattcaagcgtgtggttgtggctttctacaccttcccggtaactctatttattttctttgtgcatagaccagtcaaaaggtgaatcaactatatgagcattaatcgtctatgaatatacacttgaagcattaactttggagtccatttagattttaggctataccaaaaacatggaaagtggactaactaagcttgacaaaaatgagatcaccactacgatgaatcacgatgaatcacaaggaaaccttcataggtgcaacgaccacatctcagttgtaggacacaatgactaggagctgtgagaaaaccgtatggtaggggaaaaggaacaatgagtttagctaggtcttacattttcaccaaccccccaaaactaatgaaaataaaaaccaccttgattttaatatgcacttaatttgttaaacatgttctaaacaaactaagtctactattttttatataatgataaagattatagatatctggttatactgatgaattaaatattatatagtatataacttagagaaattatcaaagtgatgttgatgaagaatatttgtcgaggaaacgtacttccgaaagatggcagaggctatctgattaatatgatccgttctcaacgcagcccacgatacatgcccacgcgaatccgcgggctacctttctagttggctttaaaatcgctacccacaaattatcattgttttgctaatacaccatacggcttattagtccttgattcaaccgtgcagggtcggcaccacttaagtctagggcagctgccatctgataactgttgttgaccaccttccttagctcaattagatgatctgaaagatagttcaaaccgaaattgaccacatcaaggtttaatagtttctccctccttaacaataataactcatatgtctgctcaagttgattccaccaaagcataagctcagatttacatggcaattgatgaagttctatctaaatcccatccatcaactcatatgtctgctcaagttgattccaccaaagcataagctcagatttacatggcaattgatgaagttctatctaaatcccatccatcaatgattgaattcctaaaaaaacctgagcatcttttgtccatgagaaaacaccattgactaaccttatcatccatcagtcctaatatcatgcatgtattgcacccattatatattgagatctcaagtattgccgtgggccaaaaatccccaatttgtaactgaaaaatatagcattaataaatcctcctcggtatcatgctcatcaattaaaattattccactaactctagcaaatagatagcaatgtgaaaaccaaatcacactgaattccttttctccactacacgatgccttgctgcacttgcgataacccatggtttcatgattttgttggaatgagcacaacaaagagcagttaagtgaatctatactgttggatgctccagcaacttagcaaaaggcagtgtagcagagcacctttttacaccaaaatgtacgctgtacgcaatctgaacaattcagcaactgaccataatacaatttcttggttgggttttataacttatgctttgagcggaactcatagtaggaattgcaactcggaaccccaagcttttggagctttgggctcatgaggtggtctaaatatgagatttttagggctcaacttttgtgtagtgcagatgtgcatctggcttatccaaaaaacttcatgttctttttccttaagttctctgagtattgatttgaggagacattttttggtggctagattgatgaaattttaactgctgtctcaaaaaagataccgcattgccaaaatgtatatggaggatcagaattattcagaaccacctctgcattgcgaaaatagctgagacatgttttccattaatatgcaatgtttgcttaaggtacatataagtagtactagaaacttgcacggcaacatcgagtatgtattgttactatttttcctttttcaagaatatatgttttgtgcattgtttgtctcatcttgtcaagttaccactatggatgttgtcctgttgattgaaaaaaatgagaatgaaccctagtatttcttaatataaaaatctagtgcattggttgcaaactctgtaatccaaatgatggtttcattaacagaatcagggtaaaaccttattcttcaaatcaaaatgcatcaaaatgaaaagcaaaatgtcttgtttcatgaggttcagttgttgtaataggttgcagccttgcagcaggttggcatcacactggaccctggtttcagtccagtggaagacaagtgatgttgcctctaggttcggagagataacagtaacagaagttgagtaaaagtgacaactgacaactgctctatttatccccctctattttttatatgctgtagaggtgtgaacttatcaaatgttaggactgtgggaaaatgtttggtttgttacttcaccaaatttttgaacagatggcgggtttgtttcgtacgttaccaaattttggtaaggtagggatactcgaacatatttggttcgttatcttaccaaaatttgtgatggcttgaaatggtagcaaacaaaacatgcttcagggtttagggttcttaaagccattgcgtagcagggtttacacttccagtttgggccaaaattgtagtatatttcgggcgagatagttgcttacccttgtgggcggggggagcagctcacaacaaacttgcagacgaaacaacaaaaaatgacagaattttaacatacaattaccaccaagctgaccagttgaactggtttgttgtccagctttaaaggaatatgttttgcagatcatcaaaacaatttcttgtgtcaaaactcaagcgcataacagagtcaacagacaaaacaacaaaaaaggggcagatttctgacccgatctgatggactggtttattagttgattcttaagaactgcttcccagatcatcacaacaaattcgaagcatgtcaaaaggtgcttgaattcagggacacagctagaaaagaaaaaaaaaagagatactgcatcttccctggtttctagcaagaacatgaaagtttggtgattgtatctgtacttatgttctgcttcagctggtaatgcataaaaaatgactctaagcagcaccattcatatatattacaaggaaagaaatcataggcatctacattatgtagaatgagaccatgtaatgtactgtaattaatttcaagaaacagtgtttggtacagactagacaaaaggtaagctcaaggtaaaccataattcaaggggggaaattcagacaacctattccaggatgtc

SEQ ID NO: 41869 - DNA, 4878 bp, Oryza sativa
ccttcaagaactggagtgagcggggccgagagggtggcggcggcggcggcggcgacgcgagagcgggagcgggagaatgcggcggcggcggggagcgcgcagtaggaggagacggcggcgtggtggtgggaggaggggaaggtggccggggacgcggccatggcgtggacggcgaggagcgccatggaagcgagagaggagtgagagcttgaggaatggatggaatcggataagctgtgcgtgcatcggagtagataaaacggagggaaagggaagcccaggcccatggattgggctttgtctcttgggcctatggaccaagcccatgattggcttggccctctgcaattctgatgtttctctttcttttttttttgtcctctcatttctttttctatagataatcatttttttatgattaaattattactactagtataaaacttatgaagaatatagcaaagttatgatatttttaggacttctgaagacaaatctagccataacgtttttaagattttagaaatcgaaacgttcaaaatgatattgatggttaaagctcaaacactgttatgaatattagtggaagagatgaaaaaccagtgtttttaagtgtctttggttctgggaatgtgactatagcgtttgttgagtatacaaagtacaaacaaatagttttccatgatggcacctgggcaattaattaacccaaaaaactagtttacatattactagtttcaaacattaaaagctcatattagtaccatgacactttctgctacaattactgactaataacacaagttcatggcactttgtagacaggcaaggagagtgtgcataagcagggctttacataacttcatacagtatatatggattatggagctacagatgcaatccaaacacaacaaaaaggcaccattaagcattatgagtatctgattggcacaaaaacttttcagcgacagaattttcaagagactgatagctgctatgtatatgttctttattttccttggaactcatactgttcttcttacttccttgagctcactgcataatcacggggaccaacttgcctcagtaactgcatcagcagaaggaacaggagataaccaagttgtttagccatgtagcaatgctgaaaataaggtaaacagaaagagagagagacaaggatgtagtacaacatacctgaaaatatgattccagcttctgcttcagagtggcatgctccctcttcatcttctgaagagacctgcggcatctgaaagagaacatggcctcatcacatcatgtgaggaaattgcatgatgattggatagtatgtgaagaacaagttggacgagtcaatgaaatgcatacccttccagattcctgtcattgcagtttactttgaacacagagcactcattcttcatcctcagtgcaccaatgctgcgccaaacacaggccaactttagcgaattttgaacacataaagcaggcaaagatgacaagctttcggtgagaacattcatattaacaaataatatttgttcatttcacatcaataagcattcttaagtttgaatgtttttatattggttatttaagacctaagacatgattttacactgatgagacctgtaaaagaatattgttcactctgtgttctgggcatatgccccagttttatacctggatccgctgcctttgagttgttgcacaagagaatctaatctgtagaaatcctgagggtatttatcactgcatcaaaagaaatggaagtaaatgtaattgtcatgtctttcaaatcatgggtaatcattgtacaaaaaatcaattatctattcatatcgtggatgcagacatattacttacattgcttgttctatatttgtcaacagtcttgatgaatctttgaagaacagagccgcaacttcctcaacaaaattggggcttgattcatcctgcagttcttccagctgattaaactgttcatcaaggtaaccctgcaggaaaaccacgaggtagattataggcaaaagaaagaagcatgaaatacacaaccaaaaaaaaaacttttgtgcagtccatataatacaaataagtgtactaatttacaagggtaaatctatataattagtcaaagattaaaaaaaaagtcaggttccagcaagtgacttactcccttcgtcccataaaaaacgaatctagaaccggatgtgatattttctagtactatgaatctggacgtatatatgtctagattcgtagtactaggatgtgtcgcatccggtactaggttggttttttatgggatggagggagtaggcttcaccctagttaagtataaaggaaatctagtatttgcctaggagatactaatgtatcatcaaattgatgctactctatgattactctctaaaggttgaaagacctgactttttgtatattctcaatggaatagtacaaaggaaattaagaaagtggtttgctattgtctatggcatattacatccttgacgatctgcttaaactcattatcataatgcatgcatatgtgatgtaaaagaaagttgtataacttttagataagataagatgggtgccaactgctaagtgagcattattgcatcatcccagactagtagactacactacaaaactgagttatgctgttgcaaatgaaattcacaattgaaacagagtgcatgaatgatataagctccacatgaccacatatctgaccattgattgataatgcttttctccaggggttcagtgtgccctcaggggatgtcaagggtgcaatcaaactttgttatatacttacatgtaagacaaaaactgaagaaactaactctctctcctagttaactatctcatctaatattgcagctcaggaactgagaagcaataaaacatcaactagtgtctagtgcaatacactaattaattacgatctcatttctcaaaggaacaaaagtgaaggcatgaaacctgatcgaaaagatttttcttcataaagatgatttggcgacgcaaatttgaatactccatatatggctaagctttagagatcagttcaagcaggtggagagagctgagacacaatgagccatgcacaagagggggggtgtatatatagaggaaaaaaggatttttcttataacatgcaaaacctttattctacattgataatgccctcctgtgaataaagcataacaaaaggacagagtacttttctttcatgaaactgttgaacaataactcgagtaccaatgctacaagttgctgagctctgtatttcatttggtttctgtggtttatatcctagacagcaagagatatttaagaatatttgtgacactgcacagcagaggtttgtagaacagtagcacctagaacaaggtttgttcccgaagaagcaactgtatagatgtaataaataaatattttaacagtattatattgctaatatatattttatgaaattacattatttatagacaaagaagttatttctacaattcaaatactccagagtgtgtgcaagtaactgtaacagagttgggaaacagcctatctgaatgtcacacaacgcaagccgacaaagttcgttagtgactgatgaccacttaatgttttaaggaggacagattcactaaatctagcaaatttaaactttacaagatatcttatactaaacatgagtttcgggagagattttcatgcctccctagaatgacatcaaccgttgaaattctgcattgagtatttaacagaaagtaattatcctatttcctgaattatatagataatcagagtacaaaccattggcaaccttccaccaaactctgcctccgtacaactcagttgatttcattgaacaaaattgaggttgcatgctatgcagatgacaaaattggcatatttcaattaggatttatacaatcaaccatgaaaaaaaatcaaagatgataggactaacatcctgtaaaataaataatgaaaattaccatggacatgaaatatgaacaagcacccaaaaattgttcgcccaacaatgatatttgtttttcataggataacactgcgccaggacagagtaatcccaaatacaaatgaaccttttttttcttccttacaatgggtaccccggaattccatttctcaggggaacaaaaaattatacaatcagccagtacttgtccactcagggtcaccaactatcacaactaacatagttgaacttccttgcagtataataattttccattttcaacgagtttacagctatgtcattccggtgttatgcttggacttgcactggttgaacagaaacggatacttgacaaaacaaaaacaagggtgtagcagcccttggccacaaccttgtgcacaaaacacataacagaatcagataacgactggagaatcatttattttctatgtatttgagaatgaaagtgagttggctagtgatttcgtaagtcactttcattctcctttttttttgaatgtatgaattagcactctgctggttcgttcaaagaaaagagagaggtaatgaaagtgacttacaaagtcactagccaataagccaactgttaaaaagccacttcacaaaaatataggaacaacaggaagttacgaactcagaacaatggtaagtaaattaaataaaagtacatctaccaacaacaatgtatgtattttcaataatcaaattcatatgtgtaatatctattattagcaacaccactgttcaatcagttagagctgtgcccttcctctagctaaatcagaccaataaatttctcaaagacaatcagatggataaaaacatctaggggtatctaacatgcaagaccacaaggcctggaccgc

SEQ ID NO: 41870 - DNA, 879 bp, Oryza sativa
agcgtaatattaaaactctaataatcttatattaaaattgtaataatcatatatgctaagtctaacaattttatattaaatcgctactaatcttatattaaaattgtaataatcatatatatatatatatatatatatatatatatatatatatatatatatatatatatatatatgctaagtctaacaatcttatattaaatctctaataatataataatcttatattaaaactctaataatctaataatcttatattaaaactgtaataatcttatattaaatctctaacaaacacttctttacatcacttgcctgcgcgaattcctttgatggctagctaccacttcggcttgagggacgacgacgacgtcttctctgcaacattaccaggaaaatgtattagtctaaacgggccaagttacatatattgtatttcacgttttaacatatatatatataatcatatatgtatgctaagtttaataatcgtttaattatctcgttcgtacacgtttcgctcgcgttcgttctcacacttttagtacaagtgcattcacgttcgtaagcgttccgttcacgttcgttcgcgttcgttaacgtttcgttcacgttcgttcacgttcgttcgcgttcgttcacgttcgttaagcgttcgttcacgttcgttcgcgtttggtcatgtttcaatcacgttcgttcacgttcggcgatgtcggggcgcgcggcagtggcgtcggcggaccggtggcatggcggcgcggcggtggcgtctcgcggcggtgtcggggcgcggtccggcgccgtggtccggcccagcggcgtgggggcgcggcggcggcgtggcgtcgcggcagtggcgtcggtggagcggtggcg

SEQ ID NO: 41871 - DNA, 4850 bp, Oryza sativa
  unsure (1)..(4850): unsure at all n locations
gatattgttttagtttttttatcacaaatagagattaactttgccgtggtttttttttccctggatatcgtcatcctcgtcttcctggcgaccccagcgacgtcgctcccaccccggcgcatctctgttgttgtacctctgttgtgctaaagccatgacagtgctttcttccatcggcagcttcggtatagggcttgttcacgccgtggcatagctatggccagagccatagcattcaacaagagggtctgctctgcgacagccatgccctgctgctgctgcggcatgctgccctcttgctgctgcgccatgctgctctgccgctgccacctaccgccggccggcttcccttgtcgctgcggcaggcaaggtccctagcaagcgtcgccctcccgtagacccagcagcccgcgccgattttggctcccagtggcagcggtgattgtggctgtcggcggcgggggcggcgccgacagaagccagtggcggcggtcgcccatgcgagcggagcagattcggtttagactctgtatggtcaaacggatctgactaagtgagatagcatgaatttaccaaaataccccccaacgcaaaaagatagaaagacaaatataccctattcaatttatactgcagcataattggaaggaaaatcagataaatttacaccgtcagatcaaatatactgctagtatatactagcagtagaatgtaccgtaaaagtcctctaaatctttgcaggtgggtcttatttttggctgcggttgcttgcatgcgtagatgtgggagaggagaccgatggccagccgcatgccgagatcaatttttgtagtgcggatggcttaagggggcccatctgcgataatatctcttctcttcacagtcgagcctctttagacctgcttgtgaaaatcgatttttataatcgcgatggcaggagcaccgattgtgttaatagtgagggtgttaaaatagaatatgctgatcaagccagccaagaggaaaccaaggaaacacctcaagtccctgatatcatccctccttgctccctgaaaattttggtttttaaatacggaattaaaaattcggaataaccaaaaaatattttgaacttccttgcatactggaatttattgtattttatttcccgttttcttgttatgcatggactaaaggagtgtattttgatttcaaatattatttacttaaagaaccatgattatgaaatatattaatactagttattttctgtcacgtcctgataaattcatcccgaattaaaaatcattctctaaaaggaataatagaattaattaaaattcgaaaagaaattggcaaacactaaaatatgtacaagaaaaattcaaatgtgacccggagaatttttgttaaattctccttggtctaaaaggagccctcaaattttagtggaattttcagagcacaaataataattattaagaaataaacaaagttgaaaaggttttataaaaagaaaaccctaaaagaagtcttcttttccccccttcccttcttgggccggctaggcccacttctctccctctctctcctctcccccgcggcccatcggcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgccgaatccgccgcatcccgccgtccccgcgcgccataatgaggggggaatcattccccgcgattccctctcccgattcccccgcttttccctctctctctccctcggattcgttcggagttaatcccgcaagtttcgccggcgtcttcaagggcggccgagatctccgcggccgattcctccccctccggccgtcctctctctctcccggcgctatataagcgttccccgtgctctcctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccttcggcttcgccgcgtcgtcgtcgaccccgtccgctcctccgatttgctcgccgaccgccggagcaccgtcgccctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccgatccaccgtggaccgagaggctgacgcgtgggccccactcccgtggacccggtccgcgcgccctctccctcggctgacgcaataaatgagatttttaattaaaatttaaatgaagaaattcgtaaatatccatttaaagagcatataaacttcaaatggccatatttggccatttgaactcggaattggaccgttcaagtctctcatttttccttaagaagtcaagaacccatttttgtgctttgtttctgctgttatttggagtttatangagtaanagcttttcttttccgttggtcgtgtagacgctgcagcttcggaagatctgctcttcgtggaagttgaagccggcgtttgggaaagcgagcaaggcaagtcacatcatccttgatcatattgaatcccagtttgtacaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctattcatggttccactagtataaatttaggtagatgcttcgctgattaattaggcaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagcctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattacccccttgtactcctttgcattaattgtgcatctccggtgtggcttgctgagtactgtggttgtactcattcttgctctatctttctcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcgctttgtaataatgtaaatattatcgatataataaagatgtgtcctttatatcatgtttgtgtggtgtaccccggcttttcctgggacggggattaatacactggcgttcgggaaaaaggcaattttcccggtcgcgacattttcctaaaaaccgttctctatataatagaacccctgtgacatatatgctctgtacaaaaaattgtatactactattatgaatgaacactacgggataattcattagaacgataactattttacaaagggaatgtgattccgattattttctaaagaataacagctattaaaaactattttacggaataattcctgaaggctattttaaaaagaaacggcattctcagataaagtgtggttttcctatggaaaggcctagcctgatttgcataataggaggatttgttatttatttgtgtgtgcttaggtactgtgccaaaagatttctattaaattcttttccctaaatggctgtattatgttcgacatccttccgtttccttatcatctctgacagttgattaagcgcttcggtgcgaaattaatcacca

SEQ ID NO: 41872 - DNA, 791 bp, Oryza sativa
ctatcctcttcttatgaatcaaagggctttatagaaaataaattctctaaaattcatttgctaatcctcaatttcaaaggggctaaaaaaagccgttgtggattgtgaaattggtttgcatcttggagcatcatcactcacgccgccgcctactccttccgtcccaaagaaaaacaaaccatgggtttccgtgtacaactttgactgtccgtcttatataaaatttttttataatttatattttcattgttgttagatgataaaacatgattaacattttatgtgtgacttttctttttatttttttaaataaaatggacggtcaaacattagaccagagtttgtcttttttttttttcggagggagtacgtaggtactacagtcccagaagaaagtggatcctctcaagaaagaagaaaaaaaaataaataaaagaagacgaaaaaggaaatcgtcgtgcggcgtccgctcgtcgtcgactcgcgagttcggccgccgccaccgccgccgccgccgccgccgatccccatccatcccgcgagcaagcaagggcgcaggcatcctggtgagcgcccagcccatcctctttctcatctctagaaccacgcactttacttcttattcttctcgaatttgcgtaaaccctagcttctgttctagaaatttgccgcaaacaacagtttgtttgttaaaaaatatagtaaaagtttgcggattccccccattttagatccgcccctgggcttggctagcacaacattttttagtgggggaaggaagggaaaggaat

SEQ ID NO: 41873 - DNA, 3941 bp, Oryza sativa
acaaaaagaaatttaaataattcaccgagtcttctcgctgctttgcatttgttgtggccttgtggggggttcttcatgcacacctaagtactctgaaactaattatctgcactcatctcaataaacatgttccttaaccgttctatcattaatcaccaaaactcatttagggggctagatgcactttcactattctcaacttgctttgcttgtatatcaagtgtgattgagtctcttgtctagtttttatcttgcttaattgctcgagtcttttgctatatgttgactagattgtcctagagcagtcggacaatatgagcccctttacaactttccgtttttcactctgaccggacaatccaccacattgccaaactctccgactgctcctatagttagactgtccaacctaatgtcagactatccggttaagctttattccactgcaaatttttgaatttccaggaatgcctattcactcttcctctagctctaggcgatgtatcccatcctcaaggccatttcaaggacaacatcgatggcagagatatcgatggcggtgaggtcggaggtggctagatctggtggcctctaacctccgaatggctggatccgatgaggaggagcgggtgttgcccggatgtgatatgcatcctggtccaattaggatgaggcatgtgtggcccatgaaagttgtgtgtgcatgtttggtaccacatttgctagtttagtaagggtgaaaccaagttataagggcatatttagtaccataagagtttttgtgaggcttttgtgacccataagagttgtgtgtgcatatttagtaccatattgctaatttagcaagggtagaacaaacttatattttcttttgtaccagtagtgatgagtcagtccattattgttgggtttttaaataaaccagcactgatattctaggtttttttaggacacgcgtgagttgggggtgggctcgaaacccttatcggtgcttggtttagtctaatcgacacaaataggggtggttatgatggctattctgtagtacactagtacataaatgcccttatgtgcctgttggaaactggttgtaggtgccgctgaatgatcgattaatcctatatatacatgcgatggtgaaaattgcagtgtagccaaatgattaatcctatatgtacatgcaggatgaagaaacacgtggatgaatacaaaactcataatttcaacattgggcagaagaacaattgtgagttgatgaagttaaaatatcgatcatgtaataaataattttagtctaaaaaatcatgacacattgatcaaatccatcaattgggctagggttgaaaagtatggaaggaatgggcttttggcccaaaaccaaggaatagttataattaactttttcaattatagtgtatagcaattttaatgttttaatttgttgctaaactcctaatagttgtaccattgaagaaatgcttttacccgttgcaacactcgtgtattttttctaagttaactttaaatgagtactatcacaaactctgaagttgttaccaggttcaaaattccggaataatactttcaaaaagtcatgaatttaggcccgccctatatgaaactatttcgccgaaattttcaggaatgttttttttttgtgaatttagccaaagtagtttttcaaatttaacaaaacttgttcaaaattcaaattattctgaaatttccacaattagtgaaatttcggttcaagcagagtctccagatatagaaagctccaaacagaaaaatctgaacctagcttggtcgttatcagcttataaccgccagtaatggtagctagtagtagcagctactcaaagaagcattgccgacgtgatgaagaccgtacgtgcgcgatccggtgatctctcacctcttcggcggcggcggagcgcactgtattgccgccgccggcgaccactccgtcgtctacgacttcgagctcgtcgtgtaggaggttggcgtcgagctcctcgccaatgcgctcgcagaggttgtgcagcacgcagcagacggccagcatgttggctagctccggcagcttcacctcggcacgccgcaggcactgccaccgcgccctgagccgccggaacgcgcccaccgccgccgcgcgcgcgtcggccacgtgcgcattgagcctgtcctgcgcccacgtctggttgggctgcgtgtacggcaccagcatccagctcgtcagcgggtagctcgcgccgccgacgagccacagcggctgttgccacccgagcttgtcgtggccgagcagaagcccagcctcgcaccgggcgtacagcgccgacttcgcgaggacggcggcgtcggagagcgagccggggtggccgatgcagacgtcggtgaaggcgccctcgtcgtccacgacggcctgcatggcgacggagtaggtggccttgttgttccggtcggtaaggcggtggtcgtagtactcgccggcgtgctccctcggcacgacgatgcggacactggtggagaaaccatctttcgtcggtcggactaattccacaatagtctcggttgcaacaaacaccgggactaaagatccccggttaaaaagggtaacgggcatcaccaaccggactaaagatctttagtcctggtttaaatgctgtcagggcctgtcaggccctcccgggatatttagtcccggttggtatcgtaacattagtcggactaaagatcccagcgatctttagccccggttcataacaccaaccgggactaaaatcccacccctatatatatatatatgtcttcgtcctcctccagcccgagtaagcttcaaaatttcttcaaaaaagaggggaggtcatgccaaaatttctattgaatttattttggtgattatatataaatcggaggtgcctaaaaggttagcaacttcatcctccaatgttttatttttttcatattacatttggatcatgttttgcacacttttttgtcttcaaaattttattgttagttgatgagagagaaaatttgtgtggagaagaaagaatatatagaaatttagtttatttgttaaagaaggttttataaaatagttgagaaggaaaatatagtgaaagttaatcttgaataatagaaaacaaagtaaaatgaaaaattaaaataagtacaacacattaatattagtttaaaactttataaatagtaaatatataattattcggtgtaatatttcataattttgtatgaataatgatatgtcattattgtgttactgttgaaagagtttgtaattattttataattattgtatgactgtcattattgtacgaataattatgtgtgtacgattttttttcatgtcatgtagatggatcggcaatggatatacgctgactggcggtccaaagagtttattgacggcgtgcattattttttgagagtggccgaagctaacaggcaaaagggttttatttgttgtccatgcaataagtgtaagaatcggaaggagtattctgcatccaggactatttatttccacttgtttgagtcggggttcatgccaagctataattgttggacatcctacggagagcaaggtgttgaaatggaagaagatgaagtggaagacaacaatattccgaactttgctcagtacgctggatttgaaggaaatcaaacgggcaaggaggaaagggatgctgatggtaacaacgttgcggatgatcttggtcagatgttgcaggacagcaaggaggattgcgaaagtgaaaagggggcccataaattggacaagatgttagaggaccacagaacgtcgttgtacccaggttgcgagcaggggcacaaaaagttggataccactctggagttcttgcaatggaaggcaaaaaatggtgttagtgataaggcatttggcgatttattgaaacttg

SEQ ID NO: 41874 - DNA, 4208 bp, Oryza sativa
ctggaaataaactttcaaactttcaccttaactaatttaattttataactttcgaacctaataatagcagaaatctgtaattctatcaaaaggggaaatgagtgagaagaatgttcttgtcatgcactattggtgttcctaaagagatttgaaaaataggtgcctttatgttgaacctgtcaatggaacaactgccccgcagcgctcgacatcagtgtggctgatcagcagggtacgaatgagtgcctcgcaacaagcttggaatacagcagttttgagtttcttatctgattaggtgtcaatattcttaacatctaccctattatacttcctctagtcaaaactcaaaaatatttgcggttcccagtaccacataaatttaactggacggggtactaatgtatgcaattctaattgtaaacactccctaattttatagaattgtattattattgaactgcattatctctgactctgagtatactggtgcactactcatgtccctcctgaccatcgttttgaggagcttccttgacaaaaatgagaaagacagtcctgtcaattattacaccattatgtttttgtcctaatctctacattgcatcaaaaagttgatgacatgcatgctattttcttcttttttttccccagtagcacatgaatcaggagtgcctgtgttttttgagcctgtctcacttgcgaagggttcaaggattgcaccaattgcaaaatatgtgagtgcaaaggattgaattggtacttattactatgtatcatgttaaggtcttgtcacttaataatttcctggtgattcagattacttacacttccccaaatgagattgagcttgtggcaatggcaaattcattatctcctcctgagaaatatacttttgtcaaaatggagcagtccaagaacaaagccaaagctgtagagtatttgtttgaaatgctcagcccagcaatgtttttcctcctcgaaaagggcataaagtttcttctggtgacgcttggctcaaatggtgtttttgtttgttgcaaagagagcacaagtttgatggaccagcgaaagtctgaaatgatgtctttctcaactccactacttcaaaaattggagcgatgttttccatctaacatgcttgtagatttgcctagagaaggctcttccagaacatgtgtttttcattttcctgcagtatctgcctcagtgggtagcctcacaggtgctggtgattgttttgttggtggagtcatttcagctctatgtggaggtttgggtatgatgcaatctgttgcggttgggattgctatagcaaaatcatcagtggaatctgaagctaatatacctgataagttttctgctgcaactatcgcaggtctgctatagtaatttgttttcatcttgtatagtgtacttctgaaatttcagattagatcttagtgctgtcaaatttattttattgcacaggtataactccttgcatttccatttctcatgcagatgatgcaagaagaacattgctatcagctaaaatgatgtggtgcaaataaccattggtgttatctcgtgaaagtcttggtgggcatgtaatttcctaataccgtttgttgattaggctatatatatatatataaggctgagtgtggattcaggtcgtgggctggtgacaacttagcaagtttaatgtagtagattaaggagcacggcaggtttctaaatttgtttgcatgtacctatgcctttatacttcgtcagtttctgtaggctagtgatgatgccacgtttgcatctgtatgataatgtcacatcagcgtcacgtaggatctcgaaaatggtcgtggcaatcttgaaccagaatgatatattttgtggtactaggagttctggtggatatcactatataaaaacaatctctgtgagacaaatcttaaaactaaaaagacaattctcttagggagtagggaaaagatgcattattttcttttctttgcttgtgatgattagttcatcaagttggtaaagtagcttgggaagtcatttgatacgaaaaagctaaatatgaggaaaataaaggattggtgccagaggactcacatgtatgtgtgtgctcatagcaagacacccttagcactttaagcataagcatttcccaaatttgatttaaaatggaacatcatactatatttttaatcttatccttgagctatgttgagatagatgagtttcaaggagttaggagcgggaaggcgaaaatgctaataaacggtcatccgcgtgcccgctcccctgcgtggcacgttggcacgcgcggaggggaggggcggggggacgcgcgcgtgggagtggacatgtgtcccgctggtttctgatatctttttttctttggttttttccttctttttttttggtttttcttttttttatacatataggatacaaagtttgtatacatgtatacaaagtttgtatacgtgatattatttctaggtttttccatatttttttaatacgtacgtatataaagtttgtatacgtatgtatacacactttatgtataaatttttatacataaaaaaaacgtatacacattaaaatatatatttttatatgtatgtatatatacgtataaagagaggagagagaggaaagactagagggaggagggttgtcgtgtagctcgtgcgtcatgcgcggcacatggatgaccgcgtatcagcaccgcctgcgggaaggtggccatcatccacgaagttgtgggtatccctttactctatacgacattttccttagctgaagggtttgatggctttaaattgacttcgccaaaaggcctcatctccaaagcccagctagcgaggtgtccctctcagtgtagagcagagttcatcacctcgctcttgtgagagagaataaggggaagctctagaggagtgttggagttgctgacactctttccactcttgtacctcgatggatgtttctttttataaaagtaagtgttcatgctttcttttggtatttactcttcttgtataagtaaaatatatgcttatcattgcaggttcatcgcttaatatttatgttaagtactctagtactaatactttggataaaaaatgaagttcttggccaaggctagagtagtaattgataatgcaaacgtagtgtttaggttataggttacatttatttgttgtgtgtttcatgggctatagaggtaggcgacaaatggtaacagccttgatcgtcttttgtagtcctccacattccggtacgtcattgggctgtaggctggattcgcttggcagaccaggggaaagtcggtgcctgaagcaagtgatagagttttaccttaacttaattgaagaattttaacccatagaaaccctccctactctccgcctaccattttgttgttgttggatgaacttgatttcttgatgttatacacatgttccttgtgattcgatacccttggaatactctgaggtgaagtgttacagcgttatccgtgcgcttgcggatttatttgtgatcgtaacaaataccaataagcatttctggtgtcgttgcttgggaatagttgttatattatctttgaacctagttctccctggtatcttttctttttatttcttcttttcttttctttcctgccatggagtagctatctattcaaaactcattctcacatttgactggctttataaccatggttcaggggcaaaatccttctcggggtgcgacagtgaaaacccctaccatcatctacgagagttagcaattgtgttcatgcctgacaatctcaggcatgacgcaagaaactttgaagtggaagttgtttccgttctctctcatggagagggcggaacaatgatactctcataccattaggaaaacaaacggtgaatgggaggaactcaaaagtaggttctatcttgcttttgtcttgttaacctatgttgtctccctacggatggaagttctcggttttcaatagtgcaagaaggaatctattgaagtagcttaggctaggatttcattgttaactcaatttgacccagatttgtctatactcgaccatgttacaatatttcggtttgggtctaaacaaggactctgcctcatatcccggaggttcgtttgcacacaaaaccacaacaaatggaaggaaactcttggatcttgtccatggaacatcttgttcg

SEQ ID NO: 41875 - DNA, 2954 bp, Oryza sativa
tgcttgtgttcttcaatacgcacgtagggattagtcttcttggcaaatctatcgggtttcgacatggttgatactagaggagaagtggtgctgcgattgcagagttcggtgttcttcaatacgcacgcagggattagtcttgttagcaaggtctatcgggtttcgacatggttgatactagaggagatgtggtgctacgattgcagagttcagatcaacgaagtcagctcgtgttgccatcacgagccattagtacgaaccgacaaaacctttcggagttcctcaagtcctatcatagaagtttatgggattctacgtggagtgcctatgaggaacgagaatgtcgaagccaccctagacttccacgtgttcaaagtccctgacttcgatcttctgatcgactatcccatagaaaaacttctataatgtgcctaatccagattgtgcctaaggagttatgacggtcgttgaaaatgccaaaaacaaattgatcccacaacgaatcgtcatgggatggaggatgtgcctagattacagaaaacttagcaaggcaactaggaaggatcactccccgtcgccttccatcgacgagatgctagagcggcttacaaataatttcttctgtctccttgatgactattctggctatcaccaaagtcctattcatctcgatgatcaaagcaagaccacatttgcttatcgtcgaatgttgttcgggttgtgcaatacacccatatcattccaaaggtgcatgatgtttatcttctccgaaatgacgaatgaaatcatggacgacttctcagtctatggaaaaatcttcgatcattaactcgagaacttagacaaggccttgcaatggtgtaaagaaaagaacttgatgcttaattggagaaaaaaaatgtcatttcatggtcaagaggggatagtcctaggacagcgaatttctgaaagagggatagaggtggagagagcaaaaatagaagtaatgaagcaactttcatctctcaacaatgtaaagggaatccacagcttcctaggtcacacaaggttctatcgatgcattaaagtttttttctcaaattgctaaacccctaacttatctgctagctagatatgctccctttgaatttaatgatgagtggttaaaatctttcaatttgttaaaagaatctcatcttagcgccaatcattcaacctcctgattggttgttggcttttaaaattatgtgcgagtttagtaattatgttgttggggtcattcgtggttgaactaaaaacaggaagcactatgctattcgatatgctagtcaagcatgatagaaagcaaagtcagcctgctagatgctgaaagagacattagctcaattctactccctcctttaactaagtatataaaaaaatttagcaacatctaaaatattaaattagtttcattaaatctaacattgaatatattttgataatatatttgttttgtgttaaaaatactactatatttttctataaattggtcaaacttaaagaagtttgactagaaaaaaaagtcaaatgacttgtaatatgaaatggagggagtagaaatctgataactcgctcttttccacgtcaacatgaaggcaggagactcggagaagttctgaacaagagacattctttccccaccatctcatctctatgattagctcaggtaagtttataattctatggtgtccagatcctacaaagaatggatcaataaaacctttttatgtacaaggaaaccaaatctgagactgcacaaggttaacaaatggactataagcatgcatctgtaagaagcaatgtactttgtgtacttcgcttcctctgacgggccgaaaaagaatcaactcatcccctagccttcctttttatcaactcccaaaaactcgagttgccaaaacctctgatgatcaattcagtgatacaaatgccatcactgccaaaatatggttgggtcattgctataaactgcacgatcctggatctctaagatagagacatgccaatcgacaagtcttgcttggatgcatttacataacacaagtcctgttgggaacagccaccagctagtatcatccctgccaaaagtaccaatgcttgtgtgaaaagaacagaggcagagtttttgaggtagcaacagttatggtagagcagtagcgaaatgtcatttggttttcagctaaggttacttacccgcccaaattccaaggttgcatgcttggatgccttttggctgaagacttgtaatgcacaagtccacacgcaaaggccacgatctgcaagggatgaaccaagtgtgaatagattaagaagatccataatggaaaggattaaacttgctattaccattagcagaaagaaagatgcattgcagctgttgtaatgtccttaagaaattgaaatatagctactactgcaatgagtaagaacatcaacataattccatgcaactagttcttccaaacatcaggatttgagctcagaaaaaagatatctaaaatgcatgtattttggtacattacaggctcaaacttcgactcaataagacacatggacttcataaatgtatgctcaaaagtatatattaaaagaaccaagcttgatgggacttgagaatgagtcaagggtttgagctcaagatcagctccactgtgctcgagaaccctggataccttgatgagcccaggctttcttgacacatcaagaagtgggaaaatactgcctaactgaatacactatagcaaactgtaccaaataaaccgaaactgtgtgttactgttcttgtgattgtggatgtatgagcaatgataatagccaaccaaattatataatttccccttttttggaacctaaagcatttgaaatgaactggtaatatcaaaatataagtacagtcaaagatgagtactcacaacattaaccaatgatgtaat

SEQ ID NO: 41876 - DNA, 1625 bp, Oryza sativa
catcgacaaacttggtaaatgcatcctcatacctaacaaaaatccgataaacataatcttaaatgagacaggtaaaatttgtggcaaaaaaagcaaaaccagtaaagataaggaaaaaagaatgacaaaagagcccaaaggctgaatgcatgttgttcaaaaataatcttgatttacttgtggacagatctacgtacacaatctcagaaatctgctcaggtggggtgtgtggtagatgccaaggttcactgaaggtgttgggacccatgaaatacatcctgtgcacatgacagtgagattcttcggccctattggtttccagtacctaccacatgaggagagatttcaacgaaaaaccagaacaatcacaccacagcttaaagaaacaaattaggaatgcagaatgttctgctacctcattgagtgattcgaggaagggaaaagagtgatcaatttgggagctatgttgagttggtgctggtccaggcaactcatcagtgccaacaaacttcatccgagcgatactcaaaacaagggctaataaaaaaagaaggcctgagagaaacagaccaaacaaccaaggtccaccaaaagtgtatattaactcttcaagagcagtaaaacagtgaggcatgcggtatctatcggacacacatttgtatgggcacggggtttcagtaacacctcctgtcaaaaacaatatctaaggttagaacattaaggtaaactggccgaaacatttcatatatcacatgtaaagctaacaaaagttgaagagtttgaaaatgctaaaacatgagagaacagaacttcatactctcattaaaatagtaaacaacaataattatatacagcaacaattccgtctagccattagtttacacaagacaatcagttaaaagcaaggcacttctagcagctaggccgcatggaactttgtggtatgcatacctcgtgtccacagatttattgcaaataatcccattagatataggaccattgacagcctataattctttagaaaatttaaaaccatagacccaacgacatatgtatttgcagattagacgccataattctgtcactaaatttatttgatctgcacttgagacgcatacaaaaagaaacaatagaaatgacctcggatgcttatgtagacagcacgatgagggagctcatttgtagggcatggagaacacaaggacttcaaagacccagtaatgttcttatatgttcctaaaggacaggcctgcatcgtgccataaaaaccgttgcagcaaagtgagaaaataagtagtatggcaggttggactgaaaaaattgaagtgcaactatgacatgcggctatgttgataagaagacatgttatctgatttaaacaaagaaacaataagctacaaatatatcaataattcgaaaatagcaaacacacttttgctacaagttaccttgcaaaatgtgccataaagaccttttgggcaatcttttcctgtcactgttccattttcacccggaaaaccttggccatcaacggttcctcctctgcacaacaaataataggcagtatttttttggtcaaaaaggaagagtcagcatactgtttaccaatcttactgtacatggct

SEQ ID NO: 41877 - DNA, 8450 bp, Oryza sativa
caagtgggccttgtagaacagctccaggtccaacctaaaatggaattacttatcaattagagtagtctgaatgatcacgaaggatcagaagcatctaatagaaacaatgaaatgattgaactgtaaaaaatcaaaaacaacaaggttgcaacagggttataccagcgtacgatatgcaaggtaaaagagaaaggaaatgcatcaagggctgcactctatacctaacagttggacaaaatactgatcttgtatataatgaacaacactctatatcttaagggcttcgagaaaatattgatcttgtatatcatgaacagcagcataattcatctcaaagataagtttagaacattaaatttagtgtatcgagttagatgagatatgaataagtaaataacagaatggagaacactacagatagatcacgcaaactactgatgtcacacgatggcctcataacatgtcaaatttaaggcaatatcaaaggcatattcatcattccaactctgaaaacaatccgaatccataaaaatgtgcctaagccacaaaaggtatgcagaaagaaataaagcaattcagactcataactgattgtgaataaacaaaccaaaatgaacttattttaccactatgttgtagaaaagtgataaaataagacgttgcgcctgaatcgtatctccatctccagataaattcaggatgccttgaccatgaattccaagattgccaatagaatgtataactgatgattcctgacaagcatgggaacaaaataaatcatacagaagagaaggcagaggaggagaagggccatatcttgcaattttgaacaaataacataccttcaacactatcaaattgctaccctctagtaaagaagtcgcaactcctgactctctgccaccatcaatcaacattctagagttccacataagaagcatctttacagacattcgtaaagcaccaaacacctgaatgtgatttaagaatcgtgaggtgcagatacaccacataatgggttaaaattgagcaaaaggaatacaacatctgcatgaagtaacagcagataaataccttaattgtagaatcactcataagaagttcctcagccaacaattcaaactctgaatatggatagtgtgtcaagccaaaagttaatgtagcgcgagatagaaggctaatttgtccttgagcctgaaaatcagaaaacattgaaaaaagggtaactgaaatatctatagtgactagaatgaaagaaacatttagttaaagaaaatactagtccaatatcagctgcaagctgcagcaaatgtatccctgttgacctatacctgccagtcccaataaggacagaaaaatagctcaacagcagggaacagcaactcatgttatttaccaaggtgacatgcagtaaaaaagaacattttttcccataatggaagtcaccagaataatagcattcctcctcccaatttaagaaagaaaaagaggctcagatcctttttaaagaaaataatttatgtctttgcaatttcatctccacaaaaacgaaacaaatgaagtgtttatggacaagcaatcagaatagactttaaaactaagtgcctcacacctgaatacgactccaacgcaagggaagagaaactttggcatgattcttgataaaaacatttgtccagagtggatcatatgggggttctagaaaaactgtatcagtttgtgtgctcaagttattgttgctaacagtaatactcttaggcacttcttcataaagagtcccagctgcacctgcattgtccagacaacctgagctcctcccacctgttaaggcaacatagttcaaacacaaataagtagtatgttgaattgttgataagcttgtacaaactatgtactttgcataaaccaagtaccaactacacaggtaatactaatactcataacttgtcctcgtcaaacgaaaaccaaataagaaattctgggctagtccaataaatatctatctaacctagatcagataacgccaaagttcactttacactccgccagcatgaaacaaatggagaatatgtagatcatcttttaattttcgagcaggattcaagaagccaaatcagaaaatgaaaactaacaccctgcagggacattagtgtcccttttaaactgttactggaagaaactggttggttctgtatatttaacaagttcttgatgtttaactctaaactaataacttggtcagaaaagttatggtcactaacttggtcactaaagttatggtctctaaaataataatgtagaaggtttaaagaatagttcatatcttacaatttacaacaaactgaactatatgccagtggtttccctgatcagaagtttgaagaacaaagtatattatgctaaaacaagctcttttgacagttgaccaaatcaatgttgaaagtcagaaaagaaaaattcaaagctggcagggaaaaaaatacggataccatgaagatggcaggttataaacgagaacaacctcatataacctcagcaactagaaaatcaatgtgaagatacaaaattggaagcctatcagagcaaaagtagtccatgatacaaatgaaatcaagtgaattaccatgaacaaaaaattgggagtcatcatgcctactgaaaacatcaacagaaacacgcccaccacctcccccagccaaaccatcccctccgcaagcacttattgtgccacctccttgcctgttacaacaaaatatcagagaggaggcaactgttcgaaataacataaattcgaaatttaaacaaaaaagttatatatatatattcatttaatattttaaaatatcaatgagtatggttttcatagaccagctcacttaaaagtccaaaactccaaatatggctggtcaggccaacctgcattataatctaacatgtacataactgatgcttcttggtaattctttgcttccatggttccttctacgttggagacttggaatgtattgtttgatcttcgctagtcatgctcatactagtcactatgacataattgtggaattttagactagagcaactgatctggagtaagtttaagtagcatttagtccaaaatcctttgtttattagttgcctggcaatatgtctttctgaagaatgtgtttgtaacccaaatacgtagatatcaacatacaatcttcgagggctacaaatcctatcatatgatttagcacttaacataattgtaaattaaaacttatctggtccccatcactgcaactgtcagttttaggcatatataaataaaaaaaggatacacaatctctctcaaatccttattaggtcctaaaataccagtaccagatatagttcctcctgatttatttcaattgggaagtactgtttcaatccaatgcactggaatgtgaaatttgtaccattctcaacacagaagaaattttattggctttacatccattccagtgtaaaatttctaatacatctattggacaagctagtgcatgttgagtgcatcctatacaggaatcatgatctattacagaatatgatattggatatataactttttaaatatggtaaaattaaaaataacaaaaatataagtatatatgaattgtgggcaacaggcagagcaatgatttatccaaacttcaaaaaataaattcgtgttgcctttgtgtgaaagtgtgaaaaagagccaagaggcctgaattttgaactttaacagtcataaccatatgaattgcttatacgatttcgaattagccaacaaagttaatatcatattttcaatataaattacaaatactcacatggttttagccttgagatagatgcttcccccagagccacccccacctttggtgccaccatctcctccattagcaagaattgttccattcatcataatatccttggcgaacaaccacactacacccccaccaccaccaccatagtccttctcgacgctggtagaaccgcctttgctcccgtagctattgggggtcttgagttcagcccaagcgtacatatcgccgccccacgaatcctcctgcgcctgcccctccttgacgtagcagctagcaccacggccgccatggccaccgccatcaccatacgacccagtaggcacgccgctggtcttatcaggcgggtcgccagcgagcgcggtggtgtcgattacagcatcactggagagcgtgatgttggtagctgaaagagaaacccacccggccacgacacgggcctcacggccgaagaagatgccgccggacaaattggcggagacgacgcacccaggcctctcgcaggtgagggcgacgccgtcgacgagcaccagcgtcccattcccgctgatgtagacgccggggccacggagcctcacggaggcagggaccacgcagcgggtgtcgaggtcgcccacgccgcggaggtccccggcgcaggtcgccgacggggcgggcggcggcggcggcagcgaggggggcggcggcggggtgtagtcgtggaaggtcaggatcgagtacgcctccgcctccgcgtccccccgatcgaaacccccgaggctagggttccccgatgcgacggcgaggagggcgagggcgaggtgggggaggcggaggcggaggcggaggcgggcgaggggaatgtgggtggccatggggtgggaagcatcagaggacccagcgcccggagggtaggtggggggtactcgacgaggtttcggattggcggcggcggcggcggagatcgccggagacggcgagggggggttggggtttggtggtggttgctcggtttccgcttccgtcgctaatgggaatcgaagcggggcggtggtgcggtgggagataggccgtccgatttgccttgagattcggggaggggttggtggggactgactactatgctggggtttggtggggccggatgggcagtggcgcttttggttgattcatagaggagggtataccatccatctctctctatcacttgattgcagctaatagtgaatagctttgtatgatcttttaaagtgcaatgtgccaagtgacgacagcttatagtagcagattagcaagaggtcagtttgctggtacttttggaaagatcttacagttatttgaaatgtttgtttctctttcactaaagtatcaaagtactccctccgtttcataatgtaagtcattctagcatttctcacatttatattagattcattaacatcaatataaatgtaggaaatacatttagattcattaatatcaatatgaatatgagaaatgctagaatgacttatattatgaaatggaggaagtatctatttgtctatttctcgttttcacatatcactaagttacttgtaagttgaatcgtttgtaggtatcatccttttttaaaaaacccgggcacctctttgcttccacaaattattctaatctttgaaaaaaaagttaatttgatctttgccattgcaaatatgcctattcagataaatatcatcactatttatctattcgtagtctcaaggcgaagaaagataaggttgtgttacttggtaatggctcaaactcactcattatctgtgctggtccttaccaatctcttcttccttcactgccatcgtgcagcgacgggagtttgacgctcaacggacgctttgtgctccatggcagccccacaaagagcatgaatgtctcttaccagtggggcccaatgcatattttatttgattttcactggttgtaatatcaaggtgccaataagagtcacattagtcaaaatcgtcttacaaaccattgaagagtcattttgcatcggtccgaacggtaggagaactcgttatagctagttttctgtcgaggaacgcgaagcagatccaacataaatttgaggaactcgaattagactttatctgatgagtaacagatcgatgctctctttttgggctggtttagtggtcacattttgaactttgagcccattaaactcccatggacaatcattatttttcggattacatttcataccccagcgtggtcttgtagtgcataagcttactttttacttactagtacagtgtaacaatcttctattgcttacatcccttgggtcaaatacagctgacaaccactcttgtgcagaaattgtttggagtagattaaaaagagagaagtacatcaatggtggaatgaacggggtataagcacgatgcttattgattcattaccaaaatattcctgaaaatttataagtagtgaaaagtacgaatatctgtacaagccactaaacacctacccctccgtctaaaaaaacccaatcctaacaacgaatctggacacagattgatctttttttagacggagtagtaaaacttaaccattcaaatatagaaattattaatacttccaaaacttaatatgcaaatacgacacatcaacgcactaagcatttaaaactcaacaacaaaagcatagtaagtacatctataatttattacatgctaaaactcaacaaacgagcacggtaaatcataatatttatcaatatcattttcacaatattttaacccaagtccatccatcttttctacaacattcaacataaatttatccatatattccacggtaaagcacgggacataatctagtatataatataacagcctcatcggatggcctaataagtcaaagaaaaagcctaattttaaattttcaagtttaattttaaaattaattttgacatattttcaacatagtttctttttcaacattagcttttaagtcacaaataacacatttctaaaagttttacccacaaattcatttttatttcctaataagccgttttggcttattaggaaataagccaaccaatggggacctgagtgacggtagaaattatttttttaatgccccacaaataattgagatgaaaaaaaagtgtaagtgggctggtttatttgttgtggcccaagcaaagcaagcaagctagcgtagaatgcagggccttagccggcccatgagagcagcatcaggcaaccagcaaagcaaacagtaagcaactcgtaaagctcctgtagcatcgcaaattagtaaccacgtcggaagtttgcagtgagagggaaaagcttacaagaaggagatcctaatatcctatgttcaaaaaaaaaaaaggaggagatcctggacaataacaacactgaatataaaccttctgcgcaaactggggatggtaatgaaagggcagtttatgagtatatgagctaagctcatttttgtttgttttaatttggtgattttttcgcaggcgaacagcataacttgaccccgcctacgataataacttttgtgccacttgtgaaagtgggtttgccccgtttacaatgatcaatttccgtagtaatgtgactagctagcgagtattttctttgatggccgcaatattatctgtgataattaaggaatttgagctgacatttacaagcactatcactaaaatggtcaccactgtcaattcagcgcgaactggctatgagagtattattgagatgcacttaatagtgcagtggtaagaggtgtatggttttaattaactccaagatcctatgttggggctcataatttttttttaaaaaatatatttggaggaacatctcttcttccaaatctcctttttttaagatggagtatcactgctggttcaccatatagtttcatgcccaaaacgacaagaaccggcagtgttgctctgtcggttcgttcagctgtcggatcacgtattcacgttagccgttattctctcgattcaatggatcggatgcatagatgctcggccctaactaatactattaattaattacattattcatgcatccattttatctctagaaacattccatactgcagcttggatatgtagctagcttttgcaataatgttgatctctatagctatagctacatacattgcttccgggaaagggatataaaagatgataatgacatgatcaaaagattgccaaaggatattagcataattcttcatcactctagaccaagaacaggaagaatatgcatcaaatgcatgcagctaatgcttgagagttgaaacgaaacatgctttacatcgatatggttcgctttggtatgttctccttttgtattgtgcatatcagctactttttgcttgcttaaaatatttttaggtcatttagttatacattgtgggaggagaatatatgttctgtcggctgcactctcttttaattttctgggggatgcaggatgcaggttgcatgagccgttgatagagccaaatacacatatatgcactcatgcatgtatgtacatgacaatgttggctttgtaattggaatcatatcaaaatttgaacacacgtatttttgtcagatttttttcatcaagaacc

SEQ ID NO: 41878 - DNA, 1002 bp, Oryza sativa
gttacaccagtctgcatatatccagaagatattggagaaatttaatatgaaggattcatatccgacgagaacccccatggtagtaagatctctagcagtagagagtgacccatttagaccacaggaaaataacgaggaattattgggacatgaatgtccatatttaagcgcaattggagctttaatgtatctcgcgaatggtaccaggcctgatattgcatttgttgttaacctacttgcaaggttcagttcagctcctaccaaacggcattggaatgacattaagcaaatcctccgttatttacgtggcacacaagatctcggtttattctttagaaaaaatcaagatttaaccatggcgggatatgctgattctggatatctgtcagacccccacaaagcattgtcacagactgggtatgtgtttctctgtggtggtacaaccatctcatggaagtcgacgaagcagacgatggtcgcgacatcaacaaatcactcggagattataggattatttgaagtgagcaaggaatgcatgtggttgaggagggtgatacaacatgtacagaatacatgtggactaaatatcacaccaactccagccattatttatgaagataattcagcttgtgttgcacaaatacaaatgggttatgtgaagacgagtctcacaaaacatatatcgcctaaatcttctatatgcatgaattgcaaaagaaataaaaatcaaggtgactctcaccaagactagtgaaaatctcgcagatttatttactaagtctttgccaactagtgtttttgagaagcttgtgcatggcatcggtatgaggaggatgagagatgtgcacaaatcaaggggagcacttccctaactgtgttccgttgatattgatcatgcagatcagtatatcattcttgaagaatgaaagagttatccagtagattagcttatggttgtactctttttccctttagtgagttttctttgaagtttctcacatt

SEQ ID NO: 41879 - DNA, 6804 bp, Oryza sativa
  unsure (1)..(6804): unsure at all n locations
gatgatgggcatcttaatagtggataatgatgtggcatctttgcatgttaatcttaaggagttagtgggggataactttatagtaagataggataagcgagggaacacgttgaaatgatgatttgacatgcattgccaaaccaatctcatgttaaggatttattagggtttcttcgcaaaaatatatttaaatggtcataaaaaaagccaatcgagtattaattaatcttgttagaaaattaatactaaatttaattggggcatcatggtgcccggcgggctccaaaatgatatatatcttcaatcatttcagaaattttaattagagcaatagcatgatactgttatacattccagtagtgcgtgctagcaagcaaaacttttcttaatttgttgaacgtaccggatagttctcatttgagaaaagaaaccactacactggacaaggtcacctgtgacgggcccaaaccctcacctttgacggctttgggcttggtcagtgatcagtggtcactggtgagtccaatcacctttgacgggtgaaggaccgtcactgatgacagtcacctctgacgggctagaactcttccgcccgtcagaggtaagtgtctgcgctaacccatgccattttgtaacccgtcactggtatggttacctgtgacggctttttcaatatgaaccgtcagtgatgaggtacatccagacaaaaaaaatttctaaatattggctagcaaatcgctagccaatatttagaaattatatttcagcagcagtaaacagaagcatcacaaaatatatccatcacaaattagccaaaatataacctaaatttctcatcaacaatatatccatcacccataacagtaagggacaaatccatcacacacatgcacaaatccatcacacacattcacaaatccatcacacattcacaaaatccgtgccactgccgctccaagaatcaccgaatctagaaattagagaagggggaggaggatggggatggatgcggcgccgctgccactcacctcctcctcgccgccgcacgtcgtcgagccctcctcaccgctgcgtcgagccgctgcaccgccgcgcgccgttgagccctcctcgccgctgccgctgcaagaacaaccggcggcggcgggcgggcggatccgtgtcccccaacctcgtggaggctagatccgacacctagcagtcgggggacggcggccgtggcgcccggcggtcggggaggggggcgaaggaggcggcgacctggatctggcgtggtggaggcaggaaggaggaggctacccggatctggcgtggtgcaggcgggaaggaggcggcgacccggaggcggtgggcgaaggagctgacgacggggcggcggagagacggcggcggcgaccatgaggctgagggcgaaggaggcggcgaccttcggaggtgggcgaaggaggccgccgcctccgcctctggtccccgccgatggacgatggacggcgccgcgccgctgctccccgagacgagccccaagagccggagagggcgaagaggcggacgtcggtcaccacgacgcggcccccgcacccgccggcgccggtgccgtctccgcctccgacacaggtcgatgaaaagagagggttgagagggagagagagatggggggagtggttgagatggataaggatgagccggtagtagaggataaggatgagccgggatgagaggggagggttatgagaaagatttttttttttatcatctttgacgggctcataaaatttgacccgtcacaggtgactttatctcacctttgacgagttttgtttttggaccgtcacaggtgactagttacctgtgacgggctaaatatttttggcccgtcacatgtaattttacctcacctttgacgggtttcatttttgaaccgtcacaggtgactagttacctgtgacgggtcacctcctgatggctcaccgatgacggcatcctgtaggacccgtcaaaggtgaccctcatcactgaccagcacttatgcccgtcacagatatgccgtcacaggtgcaaggatctggcgtagtgaacgtagccctttttgaaatttgagttcaaggatatatatgtctagtataagatcgaaccgtatacaaacataatataagatttagatgaaatttgtgttctgataattattcaaatttcaattacaatcataaacacatgagacatacattatactgagatccatcgaatcaatcttgcatttgtcctataaaacctttgtacaccataaaaattgatcaaattcttatagtataagcaaagtatctaccagagttccgaaacactggtttatctagaataattactagactcggaggatatcccgatccaataacaagttgattaattaccaccggttactgaatttattccgataaaaatgcaaatccaataattaaatttgtaaccggtaacatgcagaaataattctaaattttaccttaaactataaataaatatataatttcatatgttcttatggaatcaggatagctagaaattaacctccctccaattaggctttaaccggttatcggctgtgaacctactagcggcggttatctattattgagttgcatacacggatcagttcaacccaaaagattaaacagataagaaaagatggacaattcactttatattccaacacctataaccgcccgtaatggtaatcttggtagctactcgaagcagtgttgccggcatggaggagaccgtgagcgatcctgtctctaacctgttcggcggcggcggagcgcactgtattgccgccgccggcgaccactccgtcgtcgacgagctcgtcgtgtaggaggtcggcgtcgagctccccgccgctgcgctcgcagaggttgtgcagcacgcagcaggcgcccagcatgttggggagctccggcagcttcacctcggcgcgccgccgcaggcaccgccaccgcgccctgagccgccggaacgcgcccaccgccgccgcgcgcgcgtcggccacccgcgcgttgagcctctcctgcgcccacgtcaggttcggctgcgcgtacggcaccagcatccagctcgtcagcgggtagctcgcgccgccgacgagccactgcgggtcgtcgccgagcagcagcccggcctcgcaccgggcgtacagcgccgacttcgtgaggacggcggcgtcggagagcgagccggggtggccgatgcagacgtcggtgaaggcgccgtcggcgtccacgacggcctgcatggcgacggagtaggtggccttgttgttccggtcggtgaggcggcggtcgtagtactcgccggcgttctccctgggcgcgacgatggggatgtgctcggtgtgcacggcgccgacgacgccggggatcccggacaaggcctggaacctggacgcggccgcggcgtgggagtccggccaccggacgaccctggtgaggacggcggtgatggcggcgcagacctggaggatgatgctgtggcaggtggagatgccgaggccgaagcggcgggacacctcgcggagcgggtcgccggtggcgaggcgccagaggcagacggcgacgcgctggggcacggggatggcggcgcggagcgtggtgtcctccttggcgacggcggcggccaggtcgtcgcagagcttgtcgaacaccgcgcgcggcatgcggaaggctcgccggaattccgcctccgggcacgccgccgggtccctcatgcggtcccaccactccgtgctccgctcccgcacccacacccgccggccacctcccctctccgccgccggctcgttcccctcgccgccgccgccgccgccgccatcgctgtgagacggcgagctcgaactcgacggcgccttcctcgtcctcttggacaagcgggacacgacgcccatggcatcgtcgtcgtcggcctggaaactccgcttcccactggcatcacctccgcctacggccaccaccacctccgccggcgacggcggctggtcaggatggtgaccggcaaaaaagtcgccggcggcgagcacggatgagtagtcaaaatcggtgaatggcccgaggaaggacgagctcatggcgatgaagtggaagtggggtgagggagcaggaagcgagtggtggtggtgatcactgatcaggcctttatatataggtattgggacgagttattaattttgggaggaggaagctatataactgggcccaggggctgcttggcacgcggtatggtactaaagtgagaaatatctagatgagcggcgccgtttcacgtgtgggcatgaggcacatgcactacggcccacgcgggcgacgtaagagcgatgctaatacttttgccggctgctggctgaatactactaccatgtcaatcgattatgcagaaaaatcatccatacagaataaaaaaaattaaacaaccaaaaaaattgagaagagagggacagtatcatacaacgcatggatatcagggcgctcagcattctccgtagatggactaattccagtagagaacaaccaaggtccttgagtcgacgaaccagtcatgcctggttgctgcaacgtggtgaaccaacatggtgcggacgagggcgccatggactgcgttattactgcagggaacaatgcaccgggtctgtaggtggaagcaaacgaaggcgggacgatgaactgaggtggcagcggcggcgcgatcggctgattccccggcgacgggacctccataggcgtcggcacacatgccctttgagactgccgccccatcttgctgcaggttggtgacgaatttagcatctagggtttaggaggagacaatttgggggcaaactcggttgctttggagtggattgaggatttatacatcgatttggcgggaggcgaggccaatttggcacgcggatgaaggaatctggcatcggggaggaggaacggcgaaggggcagagaaacgcacgggatcaggaggaggaacgaagcgccggcagatacgctcgcatcgggctgcaagaaggcttttttttctcgtacggcacgcttcagccgggcgataaatggaccgcccgctccgccctttttcgtctcttctcactcctccacctgggattttgatgatgtggaacatgttaccgcctgctaactaggatctattaaacttgctctaagcgagtggagcagtagccagcacctcgtacgtctagccacatgtccctctacgattcgcgggacgtgtctgttacgccttttttgttgtttcttttggtggggaaaagggtgttcgttagttcggtttataaacgttagtcggtacagtgatcatccattaagatacactaaaggacgatacatcaacacacaatagttgttaacgaagtttagtgaaaacctacatctttaggcctctgattataggtgctcctccccaatcaacatagcacataaccgctacgagtccatgggctcgccgcgctatcctctccctacgcgtttacactaaattgtagttgtcatgattacattgtggtgtcactctctctatttaagagtgaatctatgatagagtccgatttaactctatgctacacatattccaactctaagttcaaacttttagtaggattagtatgtttgacacatattctcgtagtagatttgtgtgctcaatcaataaacatatgctatttttttctaaaacaaggttgattctattaagagataatccaagaaataccattgacaagcgtccaaatccaagagataccatcgacaagtgtgagttccaataaataccatcgtacgaactattttgtcctaaaaataccatcgccgttagacttccgtccatctcgtgccattaaatgctataggatgaatagtatatttaacgacacggaatggacaaaaccctaacggcaataatatttttgggacaaaatcgtttgtacgatatcgaactcacacatatcaattacatttgttggattatcttgtattaaaagtaagaagcgattataaccctaccaccaaacatctaagacttgcctatataagctagttgcggattattagacatgttttactgaagttaaaagaaagaaagnataacnnccctgccatcttctatattttttatggattgacgatgcaacttttttaagggatggaacgtatgcaataacgtaagtcagttgaatccacttaaactttttatagctaaaatataagaagataaaaaaaactctaactaaatataaaattaggctctaaagactaaaatttaacatatatttttttctttttggaatgtaccgatgtgatattttaaattccgtacgtagcaatgtactggcattttgccagtatcagtcaaaaagacacaaaagtccaaaatgtgaatcatgagtcctcatgtcgtaaatatatatgtttctaagaatgtactcatgtcagaaaaaaaatgcgaattacatgcatgcatagtctcgacaaattggttggcaggacttttgatatacggtctgatgaaaatcagtgtagttaattaggacctctcttgacagctggagaggttgctattgactgcagtggttaattatctaaaaaatctaaaaattctctgaacagtactgttcttccgtttataccctgtcagttggaaagatacatatgacctaccctctaatcagtaggtttacttactgcaagaaccatgtgattattctctgatcagttggtgctactgtcaatatatgactgaggtcgatcaagaagcaaaa

SEQ ID NO: 41880 - DNA, 2525 bp, Oryza sativa
cgagcaagcactggtggagaaaccatctttcgtcggtcggccgaattccacaatagtcccggttgtaataaaaaccgggactaaagatgatctttagtcccggttaaaaagggtaacggacatatttgatctttagtcccggttggtaacactcccggttcaaatgctgtcagggcttgtcaggccccccgggatctttagtcccggttggtaacaccaaccgggactaaagttcgtaactttagtcccggttggtcccggcgatctttagccccggttcctaacaccaaccaggactaaagtcctacccctgtatatatgtcttcttcctcctctagcccgagcaagcttcaaaatttcttcaaaaaagaggggaggtcttgccaaaattgctagtgaatttattttggtgattatatacaaatcggaggtgcctaaaaggttagcaacttcatcctccaatgttttttactgtcatattacatttggagctatgttttgcacacttttttgtctccaaaattttgttgtaagttgatgagagagaatttgtgtggggaagaaagaatatatagaaatttagtttatttgctaaataaggttttataaaatagttgagaaggaaaatatagtgaaagttaatcttaaataatagaaaacaaactaaaatgaaaactaaaagaagtaaaacacattaatattagtttaaaactttagaaatagtaaataagaattatttggtgtaatattttataatttttgtatgaataatgatatgtcattattgtacgagtgttgaaagagtttgtaattattttatcattattgtatgactgccattattgtacgaataattatttgtgtacgattttttttcatttcatgtagatggatcggcaatggatgtacgctgaccggcagtccaaagagtttattgacggcgtgcattattttttgagagtggccgaagctaacaggcataagggttttatttgttgtccatgcaataagtgtaagaatcagaaggagtattctgcatccaggactattcatttccacttgtttgagtcggggttcatcccaagctataactgttggacatcccatggagagcaaggggttgaaatggaagaagatgaagtggaagacgacaatatttcggactttgctcagtactctggatttgaaggaaatcaaacgggcgaggaggaaatggatgctgatggttacgacgttgcggatgatcttggtcagatgttgcaggacgccaaggaggactgcgaaagtgaaaagggggcccataaattggacaggatgttagaggaccacagaacgtcgttgtacccaggttgcgagcaggggcacaaaaagttggataccactctggagttcttgcaatggaaggcaaaaaatggtgttagtgataaggcatttggcgatttattgaaactcgtcaagaacattcttccggagggaaaccaattgtccgagacaacgtacgaggctaagaagatagtctgccatctaggactggaagttcagaagattcacgcatgttcgaatgattgtatcctatatcgcggtgaggagtacgagaacctagaagcatgccccatttgcaaagcactacgatacaagattagaagagatgatccaggagaagttgatgagcagctaacgaagaagagaattcctgctaaggtgatgtggtatttccctataataccacgtctaaggcgtttgttcaggaacaaggggaatgctagaatgatgcgatggcacgctaaagagcgtcaacagaacgggatgttgagacaccccgccgatggttcgcagtggcgaaacgtcgtcagaaaatttaaagacttttgaaaggacgcacgaaacatacggtttggtttaagtacggatggcatgaatccttttggagagatgagcagcggtcatagcacttgacccattacgatgtgtatctacaacctccccccttggctatgcatgaagaggaagtacataatgatgccgattattattcaaggccccaagcaacctggtaacgacatcgatgtgtacctaagaccactggtcgaagatcttaaactgttgtggaagaaggaaggtgtccccgtgtgggacgaggacaaacaggaggagtttaacgtatgagcactgctgttcgtaaccatcaacgattggcctgcacttagcaacctatccgggcagtccaacaaggggtacaaggtttgcactcactgtatggatgaaacagaaagtacgtatcttaagcactgtcggaaggttgtgtacatgggtcatcgtcgattccttgcagcaaaccacccagtacggaagaaaggcaagcactttgaacatacggtggaccaccgtacgaagccaaaacatcgcagcggtaaaacagtgtttgctatggtgaaagatcttaaagtagtgcttggaaaggggcctagcagccagcctatagagagcgaagatggtcacgcggcgatgtgaaaaaaaaactccat

SEQ ID NO: 41881 - DNA, 2424 bp, Oryza sativa
tggaaaaaaaactctatattttgggagttaccctattgggaattcttggacgtccgccacgcaatcgacgtgatgcacctcactaagaatctttgcgtaaaccttcttctcttcctaggtatatatggaaagtcgaaagatacactggaagcacgtaatgatctgaagcatatggaacaacgcggtgaccttcacccggaaccaaaggagaaatgaagccattacttgagtccagccagctacactcttagcaaggcagagaaggaaagtatgtttgaatgcttggagagtatcaaggtaccgtctggatactccacgaatataaagcgaataataagcacgaaggagaagaagttcacaaatctaaagtctcatgactgtcacgtgctgatgacacagctgctaccagttgtaataaggggtatcctcccagacaatgtctgggcaacaataacaaagctatgtgctttcatgaacgcaatttcgcagaaggtcatcgatcctgatagattagaagccctgcagaatgatgcggtgcaatgtcttgtcagttttgagttgatatttccaccttcatttttcaatataatgatgcatctgctttgtcaccttgtcaaagagatcggtattctcgaccctgtgtacctacacaacatgtttcctttcgagtggtacatgggcgttctgaagaaatatattcgtaaccgtgctcgtccagaggtaagcatcgccaaggggtatggaacagaggaggtcattgaatttcgcgtagaatttattgaagaccttcgccaatcggggtacttgaatcacaccatgaagggagactacggggaaaggggactctcggaaggaaagcaataatgacggtagacaacaatttatttcgtaaagcccatttcacagttctgcaacaatcttcattggtggctccttacatcgaggagcacttggctctagttcgtgccagaaacatcggtaagtccgatgcatggattacacggcatcacattgatactttctccgcgtggctgcgacaacatctcatgggtaacgagacgattaaccaacaactggccttcctggcgaggtgaccatctggctcgatcgcgacattccagggatatgaaatcaatgggtacacattctacacgagagcccaagacatgaagagcacgaaccagaacagtgttgttcgtatcgatgccatgggacacgatggtacaactggcacgtattacggtgccatcgaggacatatgggaacttgactatggacctctcaaggtccctctgttccggtgcctatgggctaggttgactggtggaggcgtaccgattgatgacagtgggatgacaacggttgaccttaacaaggttggatactcggacgaaccttttgtccttgccaatgatgtaacgcaagttttttacgtcaaggacatgtttagcaaaggaaaaaaagggcaaagggcctgacgagccgaagcgccacgtggttctcccaggaaaaagaaaaatcgtcggagtagagaacaagactgacgaagattacgatcagtttgatgggcaaccccctttcacagtgacgattgaccctagtatcctcctaacaaatgaagacaccccttactcacgtagcatcacaaggaaggaacaatagtcaggagaaagtacgtgcggtcaaccgtcaccgctgatgtattaccgtaattgttgtgtacacgatgtaaactatttttgatgtattgaatatccataaaatcaattgttgtatggcatatgttaattatgtatgattattagaatttttatcaaattgaaatcaaccatatgctagttatatatgattattagaatttttaaaagttttaaatcatgcacgtggtatttacatatgttaattagaattttcaacaatttattatcatgatgtgctaattatatatgattattagaatttttattaattttaaatcatgcacgtggtatttacatatgttaattagaattttcaacaatttcatatcatcatatgctaattatatatgattattagaatttttattaattttaaatcatgcatgtggtatttacatatattaattagaatttttaacaatttaatatcatgcatatgctaattatatatgattattaaaaattttaacaattttaaatcattcatgcgctaattatatattatccacttagtttactacagacaacaataatttttcgaaggttttgtcattaatttttcgactttaaataattgtaatgcattatttactattttagaaacacaaatgtaatgaaattcaaaattcagtgctattatctttagtcccggttcttaaccctaaccgggtttaaaaagaatttggaaatagcgggaaaagatctttagtcccgattggtgaga

SEQ ID NO: 41882 - DNA, 3178 bp, Oryza sativa
aatgcacttgtactaaaagtgtgagaacgaacgcgagcgaacgtgtacgaacgagataattaaacgattattaaacttagcatacatatatgattatatatatatatgttaaaacgtgaaatacaatatatgtaacttggcccgtttagactaatacattttcctggtaatgttgcagagaagacgtcgtcgtcgtccctcaagccgaagtggtagctagccatcaaaggaattcgcgcaggcaagtgatgtaaagaagtgtttgttagagatttaatataagattattacagttttaatataagattattagattattagagttttaatataagattattatattattagagatttaatataagattgtatatatttagcatatatatatatatatatgattattacaattttaatataagattagtagcgatttaatataaaattgttagacttagcatatatgattattacaattttaatataagattattagagttttaatattacgcttagcaaatatgacctatagacctaacaaatattttttgtatgcacagatggctgatcgcgatgaggaacagatactgtacgatacaatcgcagagggaagtagccagtactggaacgaagaagagggaaacgaggatccaaaccagtacttgaacgaggaggggaacatggagagggatgcggaggggaacgaggaggaggaggctagtggaagtcatccctccgctggacagaagagggcacgtggacaacgaggttctgtgaagaagatagagggtcggcacatcataactgaggtggacgaagacggccgacctagtgccccggcagaagcagccaagaattttgtacgccacagcggttgggttgtgagggacaacgtgcctgtcagcacggtgtactggcgcagaacaagggcacacggggataatgacagctttgtcccggaatcagagaaagagatgttgtggaccacaatgctcgagatgctcacgctacccgcgggtacggagaacatagtgaaacagtggactctacagaaaatggcagaacagttccagagcttcaagggagatctctacaagaaatacatcctgaagggactaacaccgaacttcgacgtattcccaaagctaagagatcattgggacaagttcgttgcttacaagacagggcaacaagggcaagcgatgatggccagaaacaaagaaaatgccgccaaaaagaagtaccatcaccacttagggtcaggcggatatagcgtcgcaatgccgaagtgggaggagatggaggcaagattgattgagaggggtatcgaaccggccaccgctaaatggccggatcgatcgaagttctggtactatgctcacggtggaacgcttaacccagttgatggctcccttgtcttcagcgatcagatacgcgaggctgccagtcgactaacggacgcagtgaaagcctcttctcagggcacattctgacccgacagagagaaggacgagctgtcactcgccctacagactcccgagcatccaggacgaacaccagggaaaggcgtgattccctggaagattggattcaaggaggacatccacacgtacaggagtcggatgaggcaaagattgcagatcttgagtacagggtatcgagccgagctcagcatgcaagaggaggtggcaaggaaggtggatgaacgcatggccgcacatcggtcccaggatccccagccgtacattcctcctgcaatggttagcccatcaggcaatcgtaacagctgtgccttaacggggcaggtaggatcatagagcatggacgccatgcaaacccaggatgaaaccacctgccccgttgatgagatcacgcaacggacaccatgtgagctgcatattcccttcaagaacttatcaatcaaggtatgctcatagttttatgattttttgacttgtacattccgcaagtttctgcttaggtcgattactaatagataacctctcatcacgtgaaggtggtgtcgggaatggccatccaacggacatttcagggacttaccactgcaggccgattccagcaggatactcgagggtcgaagttgagctagtggaagctgcgtatgaggacctcgagttggactacccaggaggaaacggtgagacgcatctacgaggcacaagccacgccattatactatggtgcaagcggtacatcatcctccctgggcgacaagcggcgtctcgtgcaccatctcctccggctccaccatctcctcctgcaccatatccttcggttcctccgccacgtccccctgcaccatctcctccggctcctccgcctcctccacctccaccgtgtctgcctgcacctcccaagacaaggtctcaccaagctccaccgcctgcctacacaagggcaacgaagaaggcgaaagttgacaccaccacaaacaaggagccgccgtacgattgcagtcaagaggagcttgatgcttatgtggcaggagaagtgaagaagcaactcaagcctcggagtaatgaaaagaagatacctattgacccaagcgtgaagaacttctttaagggaatgtccatagcaaacaaggaggccttaaagatatcggactatgaccgaacacttcagaaagcctatcacaagaagtccaaaccagtccctcagcttggagaacaaccaaaccaagaggtcgagccgttggtgaccggcgaaaattttggaataacggatttcatttcagataccggtctaactgtggatcagctgattggagccacaccaatcctaaaggcggaagtggcatacaagtttgaactcggtaaaccgcttgtcacgcctgagcagctgcagtccctaccgacacagatgtacaaattccatgaacggtacatggaaatgagcgccaagggtagagagatgttcggagcgaggatcagaaaccccgacttcttgcaaggagaagatgttctctggctccatttcaaggatgtcttcgatctgtaccatttggacgccctcgacgtctctcttttgagcgcatggattttgtaagtatctttgagttcgatttgtttcgttcaataactagctcctgtcatatatgtaaacaataacaatttcattttattgttgtagaatggagattcaaagggcccgacgg

SEQ ID NO: 41883 - DNA, 20331 bp, Oryza sativa
  unsure (1)..(20331): unsure at all n locations
tattaggtacgtggtatccataaccttgacaaagatcaggtacggcctatattatatactatttaatctgtaaaacaaattcatctgacaaaataaaagatactcttaatttgattatctaattatatatgtgttacttagtttgtattaaaaaaaattgatgagctttagatcatctccaacatagagaaaaaacgagttccaatagactctccatccgaatggctaaacgtagccagcctcttccattggccaaaggtgggtcccaccatctctcccatcccttcttccggctccccgcccccccccctctctcttgctctctctctctctcgccatgtactggcccccacccgcaagcagtgatgacaccgacggtggcggatcaattggtggtgacggcactgatggtggagcaaggagttgtagcagtggtggcggagcaagcaacgacgatgatagggcagggatggatcggagggcctgctgacctttagcggcggtgtcgacgaggtcagaccggtcactggtgatgaatacgttctggctgcgctttcggcttcatcacagtctctctcatgactcatcatttggagtctcgccatccaccacaactgcactgttgttgctcgtcgcggtctccaccgtctctgtccttgcacggcctccaacgcctctttccccacacggattcgactggcggccggcaaagaagaagagagaggaagagaagagatagaggagagggtgaaggagagaaagaagaaggggaaagaagtagggaggctgacatgtgagacccactatcagattagagaattgtaatagagaggctattgaaatgaaaggtaaatttgactatctttttattttttggcaaatcggtcaaatgaacatttggaaagtgagatttggaaaggatgttatcggagatgctctttctaggaagtgtacaaatgaagtgatgaatcgtggtacggtctcgtggatgcatccactaatgtttaaattttgatgtcacaaatattacacatacactatattagtgattcgtcgttgatatcggtctcttcgatcagcttgtgttggttaagagggtgtatgatcagttcacgcatgtatgtatgcatctagcttgtatcaataacaagctttataataagtattgcaatttactcttttggaagacgtacacgcactactacaaaaatcgtttttctgtacgagggggtcggtaggttccatgcgggccgcttgtggtggcgcctgcaaaaaccgcccccccggggcgggttgattagccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaaaagttaagtttcgagatgaatgaggcagagaattttataatcgaagacatgtcgcgtgaaagaatgattgtcgatgtttccaccgatagtgatgatttcgatggtggttttgatttaaaggatatgctacgccatgttgaaccagaggtgctagcgggcggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagtaattttcatgagttttcttagtgccaaaaacatttggaatgtataattgtggcgaaatattgggaaaaaaatatatatggacagtttacttatagaggaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccggcccacgccggcgccgccgccgccgtcaggacctctcccccctcgccgttgccgtcgccgccgcaaggacctctccccctcgccgttgccgtcgctgccgccaggacctctcccccctcgcngtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgttaattgtggattgttaaatggagatttatgtttaaattgggacttatgtttaaattgggacttatgttaaattgggatttatgtataattgggacttttgttaaattggcacctatgttaaattgtgatttatgtataattgtgatttttgttaaactgagatttatgtataattgggacttatgttaaattggcacctatgtcaattggagatttctgtttaattgtgacttatgctaaattgggacctatgttaaattgggacttatgtgaaattgggacttatgttaaattgggagttatgtgaaattaagttattgggacttatgtgaaaataagttaaattgtgacctgtgttaatttgagatttatgtataattgtgacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcagccaggcgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagcggaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatgcttactactccgaaatacgataataaatctctcaataatttcatattaattacgaatcaccaaaatgctagaataaatattattttagctattcggaaattgaatttcgcatgcggtctacttaagacgcccgcatgcgaaaatagatcttcgcatgcggtcttcttaggtcgaccgcatgggaaaatatatcttcgcatgcggcttcttatatggaccgcatgcgaagatctattttcgcatgcggccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgacgtatgcagtcataagtttttttttttttaacgaatcaccggaggggagagatttcccacctgaataatttttcattgctcaaattgtttgcaaggtatacagaggagtacagtagagtatagagttacagcgaggacgaaaaacataatccctccggtttcattttaattaacgttttggacaataacacggtctacaagatacatctttgaccttgtttttctattataagatatataataaataaatgcatgtttacttttattatagtactttaaaagacaaatctatatatgttgttctagttcctttaaactaaatatttttaaagtcattgatagtctaaattataaaagtttgacctcaaccttgtcaatgaaatgctacatgcctatcctcttccttcagcaactctgatgatcttgtcaatcgatgactgacgattattccaaagagcccaaaaccagagcaggtagacttggatgctgtttgtcgtttgagcgcgtgaatgctttgagcatctgagattgctgggctgatatcaatcctctcccagaagctttgggcgatgtgacagttttaggcaaaagtgggtggccgatcctaaattaaatataacatatactagctaataattaaataaataattaaataattactatgtagtattggacaccaggtaatttttattattcgtcacatggcgctcttggcacagcaaccaggtgaactaattagccgttcgattaatccattggaagcttttttgtttgtaacattccatcgatggaaagctaacacggtcgaagagattgtgtgaccagctcctgtgtgtttggccatctcgaccagcccattagaaaaaatgataaagaaaaaaaagcatattgactcagtcgtttcagctcgccgccactcccctgtttgctccagtattttggaccaactattaactgggcctaatacatgcaacccgggccaatgtaagtgtttttctttttttaattctttattcttttttttctaatgtaagttacagtaaatacacactacatcatttttttcgaaaatttatatcccaataggttctattaatatcatagtatttataagattttatttgatttttttatcaatttaaatttgaatttggatgaaactccctgaaatcttagacggtttatacttccgagcctcgtcggaacatcgaaattttacgaaatccgtccgtcgaaatcgtaaatcctgatgtcatgtttatatgtattattttttagacacaataaaaacaaattatatgatgaaaatcctaatggaaccaacacttgtgttggcgagataattaaggtcgtggcgacatgattgacggctaacacttgggaatcctcggaatgtggatttgacgtggcttgcattggtgtatggagatcgtgataccctcgtctcatgggaagccttgtctttatgtccctgtgttctcccttgttagggtagaactcgagagataagttgagatacaatctaagcaatcccaatctgtaggcagtcgtttttcttccgggatcactctcctcatttgctcaagagttatcaggaatgtaaaattttgacgtgtcacatcggatattatataggatatcacatggagtgttcgggtactaatgaaaaactaattataaaatccgttagtaaaccgtgagacaaatttattaagcctaattaatccatcattaattagtaaatgtttactgtagcaccacattatcaaatcatggagcaattaggctcaaagattcgtctcgtaaattagtcgcaatctttacaattagttattttttagcttatatttaatacttcatgcaggtgttcaaacgttcgatgtgaaagggtgtaaaatttttatgtgggatctaaacaggccttagatgtgatattcctgttcagatatgtccgtgtacgtggagtatcctatattttgtacactaaagattaagtatggtccttggtggagaatgttctctcattattttttttcatatatgcatgtcatatataatatgtaatacacagatgttcttacatgcaaaatatttccatcatgcatgggaatcaagcagaaaggattaaatgcatcctcacgtcatatcagacatctgtgagacctatctctagtgtattcccttagagcaaaaattctcgttcttcatctttagagagagaccttgggtggtgtttgaatctcccgaatataaaaataaagattaagattaagtgtttcacacagaaagaaagaggtggtaatagtgtataattaattgagttttaattattacaaacttaaaaattagattaatctgatattttaaaacaacttttatatagaaagttttcacacgaaacacactgtttagcagtttaaaaagcatgtcacttttatccaaaattttattctctactcgtagaacaaacgaacagggcctaacttatacctagctaacttagcttttctatttatagctagctagctatctttaactttccctgcataaacaaagcaatggaatagtcaaaagcaatgggcacatgttacaatgcgacatagctgggatgtctctcgtgtaaatttgcttctcaaatacaatactgatatttttttaggttaatcggatctatgccattacaaatttacatttttaaaaaaaaaactattactattcacttatttggacccaagacattacaattttacagttatctgagatatgtcattgcttaacccttcgatgcatttattaaaaattttagacttgttcctcctccttcccctatctcctctatctcatttccaattagcctggccaccatggccatccccctccacctccactccgccaccagccatctctccctttcccctcaacatggccatggctagtgcacccgttggagatagaagcatatccgatggtggagaggtcggagacgaagatgtatgaggtcaacgacggtggcaaagtcgccgactttgctctatctaaagtgagaggagatgaggagcaataaataaagcagaggagaggaagagagaggaaccatcggccctgacctcgccatgcgctgccgtcggtttgagtagctgggggagaggaagagaggggaaccgtgggccccaacctcccagtgcaccatcgacggagtgagttgcagatggaggagctgccagagtgagtagcactagtcaccagtgggaagagaggagagagaaggaaggaaaaaaaggaaaagaaagaagaaagggtaaattggtctaaaaattttaatgaatgcatcgaaggggtaagtagtggcatatctcaaatttctgtaaagttgtaatggcatgatttgaaatgggtgaatagtaatggtattttttaaaaatatgcaaatttggaatggcatgtatccaattaacctttttgagataatgataatactgatagttatggatgaacctaaaaacttttgataatgtataatatattgacatctaccaaactatcacgcacaaaaaatctcatgtcaaaactcgacctacaaaccaagaaaaagaaaaggagaaatatagtggtgaataatgtaattaagtattgttcacagtttagattcgtctttttttctcaatacgagagatgattaatttagactttgaatttccttgattatcatatgttacatagtaacaatgtcatctttttataagttttttttattaattttcgaaagtattttgagaaaacaaggggtcatccccttaagatgtggaaaacacttttgatccccatgacagcatgtacactcataattattaattcttttcaagagaacatagctaaatcgattaattccttagaaagtaaagtttattgggggactcaaaatggttttagtacttataaacaccctgcatcaattataaataccaaaattatttactagtaaatactctcaattaagtgagaatctttccagaatttacatattcaaaactttcaagtgtttaggtaccaaaaccattcgaattttgcaccaccataaaaaactgaatgatttcaatagttttggattgaaaaccaaacttgcgtgacaatccaaagttgtaaaatggaccttgttttttttctcaagttgctagtagcatataaatttttgaggatatatcgtttccctcaagaatgtgttgacaaccaactactaaggaaaaatgaattcggtgtgaagtgtgttgtgaaccatgggtgttaaaaagcagtaataatgaacaataaaatttatcatatagaggagaaactgttgacgttacaaccttcaacttttaccaaagtcctaaactgctacatattgtttcacagttgccaaatttatttaggttatagatagtccaaaagatagtgataatatttaagaatatttgaagtaatttaaaaaattcaagaaatgttttagcgctggcttacatcaattcaaatactcgatgtgctgtacttctccctacattgccacttggtcgtcatttcactgaaaacactctttatctagacaatggtttagaagttcactgttgttttgcacacatttatataaaagtttagtgttgtatagaatggacattttcctaacacatacataatagttgacaacttcaataatgtcataataactattccaaaatttaccattattcgctaattcattaggaggagtagctaatggttgttaaagctctctgttttcccacgacacaatagagtggggactagtatatatgtgtttatcacacaagatgcaactgatgacgatggcataactaatttagcaaatagtttcctctaggaaaaagtccgaatccccacccctcctaaaaaaaacactatagttgtcaatcgaattacccaacccacaaaaaaattcaaaaaacagacacacttcctccctcaactctttaatccggacaaattacacccgagcactattttgggctaggctggctgaaatgacatttttaaagtggctaaaaaaatatttaaaaaatacatggccaacttgtcagtgctccagcactcctctccccttctcttctgcctcctccccccccctcaatctctctctctctctctaccttgaaccgagcacagaggaggtggaggcagcggcggtggtgtgacaacgacagagactagacccccggggcgctagtggtggagcgtgatcagccggagaagcccagggaagcggcggtgcacggtcggccaaagaatcccaggatgacagcggcggcggcctcaaatccagaggaaaggcgagagcgacggggccaaggaggcgtcaatggtggaggcagtcgaagaagtccatggcagcggcagatactggtcccccacggcgccgacaacggagcgtggtaggacagagaagcccagggccacatctgcttatccctgctcgtgctacggatggaggaactggaacggcgttggcggtgtcctggggaggtggtggtggagatgttgtgcaggttagcaccggggccgcgtgcccacgtccgctattgtaagatgcggctggtgggccacaagtgcccacgttgtgcatggcatgcagccggtgaccagcctgtcggcctgctacctcgctgtagcgtctccccaccgatgccgcagcttggtctccacaccaatcccttcttcgcgtggcgtggttctctcctccacaagcatgtcaatcggcaagtagaagtcgtcgaccagaggaggtcgagtcacaagtgcgtcttggttcaccggtcactgccttgtagtcgttcatcatcgctgctgcagcctcctcaccgttgcctccgctcgagcttcatctccgcgtgagctatgcagagccggagtatgcgaggtggatgctttcccgctctccaagctccgtcgtccatcgtccaccaggggcagccacagctggcgagcacctcgcctccgcgggcatagctctctcctccaagatgttagccatgccttgcctcgctggggaaaagaggaagagggacggtggctgacgcttggttcgccctcatgtcgtcgacgaagctcatgattgaggccagaggggaaagagataaggtcgagcttgcctatgacaagtgggccccaccgaattgtttaataaaaaagtgctaattggattgccacatgtataccacgtatgaacaacggcaaaatttgctacaaggcatccgaaaaacgtgtaattagctgatggacaccgcaagacgtatctgctgtaggccgtaaaaaactgataattaactgttggacactcatgatattattttattattttcgggaaaattggagagagaaactaatgtgtgagagcacgattctaaccctgctcttcatgacacgatcccttgtgtccccagtggacggtgccggtgagtcagtgacacgatcgcggcaccggctgatcacccgacaaattaaaggagagtggccgagcacgtaaatgacacatgccgcgtcgtcggtgtcgtcgtcgctgcgcacatgtgctcgcgcacgccgcggcccaagcagccagaggcatcgtcgccgcgcatgccagtgccaccattaacgacaatacccgtctcatcccacacgacgtacggtctctcaccatatacgacgcgagcagcatggtaattggcatgccacggcgtgtgcgcgccacgcacggacgcgaatagggtgtgcctggcgcacgggataaagcgagcaggagattccacatgcagaggagaaaatctctcgcgcgcccgtcttctccacctgcgccattactgccctttggctgcttcttcctcctcgatcctgcactgccactgcgacgatacatgcacctgctgttataatccactctgatgctagttggtctatggcactaggaaatatttgtcaccaaaagacaacttgattagtcgattaaccgacggtgcagagaacgtgtaccctccatttggcaactgagttccgccgcgccacgcacttgccgccagtactcgtcgggtttgcgacaggcatcgatttactgcgaaaagcctcgtggctggtttgaacaggaaccagtcggattgaaataagttcggtcaggggcaaacttgtctttaattactatttctctctccaattctatcagaaataataaataatatcgtaagtgtccagcagctaattatcagttttttatagtgtcctacaatatatatgcgttcttgcggtgtccaccagctaattacgctttttttatgccctatagcaaattttgccatgaacaaaaccactccggattgaatgagagggttatttgtccagtttgaataattgagggttaaaatatctagtatttttagaggctaactcaaacgaccgtgatagtttaatggggtaattcggaccttttcatttcctttataacaagaagcagtactcctaacccatatataagagttgacaaaaattaatgggggtcaatagttaaaatgcataatcatgttctcgtgtgtgagattgtagttaagaccaaccagaacattttgaaagatgggatatcttccatgcatgtagaccaacgagctagcaacaaaatctatcttctctctcaaaaaaaaaaagggagctcgaacaccttgtaaacgaactaacttcacttttgaactataaatggctcgagatactctttacaggagttttaaattcgaccgatgcaattaggacagattagctgacctcaggcctcgttgttttcagattattcactggattatttaaaattaattatttgagttatgctttgaaaaatatgttttctcaaaacaaaaattcttctacactgcattgtttcgaccagttattctaagctatctgttaagtttatttcctaaaatatttaatttatttctatattatgtagagtaatccgaatactctccacagtaatcttaatcaaacaaggccctataattctgttacctctatgcttgttgctcagccatgcatgcatggatatataggataagatgatcaaactagcaagaacctagaggtatactccctccatacccataaaggaagtcgtttagaataatatttaagtcaaaccttggaaatataaatcatgaataactcttaagttgttgagtttgaaaatataaaaattatatgtatagatttatattgaaaaatattttcataaaagtatacatatatcacttttcaataaatatttttatagaaacaagatgtcaaagttgtattttggagaccatgtcgctgtcctaaacgacttcctttacgagtatggagggagtacaagaaaacacaagttcacctctttgtggcatcagcaaattaattaatggatgaggcatttattctgttcaaactaggaaattgaagggagtaggttgtgtacatgcatcccctgcaatctcctcctataaataccatgccatccccttcagaacccataagccacacattcaataaaacagtagtctatgaaactaaagtcacaagttaaggtcttggaaagcaatcaagagaatgagaggccacaccttttgttttgggcatgtgttttttttcctttttgctaatcaataactttcaagcatgatgacatgtcttgctgatttgtatacagggaaggaacaaaagagctagggagccgacagaagagagtgagcatatatagttctttccttgcatatgtggtcatatgtgtgttgactgaagagatacatatatatagagagagagagttcatgtgcttgaagctatatgtgctcacttctctttctgtcagcaaattatctccctccctctctccctaatatatacgcatgggtgcatacaacgcaaatatatatatatatatatatatatatgtgtgtgtgtgtttatagacatttctttcattagttagacattacgctactgttgcttttcttgctattcagattaaattagaacttggaatatataattatgccgtaacaattcttttttctttctagcacaagttagctagctagctagccagctagctggtgtctgaatgttgaatctggtatctttgacacacacacatgtgtgtgcgcacgcgcgtgcgtctttttttagaacttatagatatgtgtgcttggatcaatatatgctgcaatacatttttcatcgagaaatatataaatatggacatatatgtttttccactaacttgtttcttcatctcacattttgaccatttggtaggtttcgggat

SEQ ID NO: 41884 - DNA, 2384 bp, Oryza sativa
cgccctcctcgtcggagttgagggcgaacgcgagccgaggggccgaaccctcgaagctgtggacgatatggtcggcggcatcccggacctgcgcgcgcgccgtcctcggtcccgggagggaactcgtccagcgccgtccatggggagaagtcgggtccctggcctggtaactcgccagtacgagctccaccgctcctcgggcgaggtccctcgaggatgacttaatcgtcccctcgagctcctcggggagccgctggagagtcccggccatctccgagaggcgctgggcgaggcccccctggttggcggcgtacttcacagtccgcccgccccagagacccgcctgccgcccggcgcggtctaaacgggacacggcgtcgcaaagcatgctgggccctatctcgcctgccaggcgaagggcctcgacctccccggtggatgaatccagcgcgccctgcagatccgcgatggtgtgttcggcagctgcgaggcgggcggctaagtcgctgtcgcccgtggccgccccgccgctacgcgcccttgcatccagctcccttgcctgcgcctcgagttcagcggcccgctggttcagtgcggccctctcggcgcgggcactttccagattgcgacgcgcttgttcctcttgcgcagcttcgcggagggacgcgctctccgctagcctctgtgctgcggcctcggcctcctcgagggctcactcccgctcggtgagcgtatcctcgcggaggcggagtgcggactcttcttcggcacaggcggcttcgtgcaccgccagtgtgacctcccgaatagcaatggcggcctcgcggtccgccaagtccctctccacgacgcaggcacgctcttccagcgccatggcacgggcctcaagggtttcttcgcgccgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagcccccctctcctcctccaccttcctggcgatctcccccagcatcttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgttagcgacggccagggcctgcagaagaggctctgcgctcagtggggcagcggaaggcgtgggggagagccgcctcggtgaggatgctgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctccatggtcgccgcattctcggcctcagattggccggacttgaattggcaagaaggacgcgacgggatctcgctgaagcagaagaaaagccagaagacaaacaagatgggtgaatgaaaacttgtgttggaagaatgaatacagccacaatgggcgtgggacgaacctgcgagggggtcggttaaacgaccaccttggaggggaaatgaggtttccccgggatggttctgtccccccatcttgtggagccgtttcttcttccgctccccctcgggctgcggcgtcggcgcggccccctccgggcgcctgctgctgacacgcgccgccccgccccctcagggaggagatggggaggaagtaccctcttgcttcctcttccctcgggcgtcggcagggcggctgccccccgagcccccatcacggggcccggaagcacaaccccctcctggggtagattgatctcccttgcggctcctgctcgcaccatcatggcccttaggagctcgttcctctgaggccccgaccgccatcatgatggacaggatgttggcgcgatctggatcgctgcagagggggaggactccatgggggatgagggatgcctccgcggagctgaattcagcacccgttggatcattaccttgaagtcttcggggacccagtcccatttgaccccccggtgggtcctcatacagtcctcggacccggtgtactcccaggcgccccgggcgc

SEQ ID NO: 41885 - DNA, 6616 bp, Oryza sativa
ttcttgcggaggacgcagggaatgtatcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcgaaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatatcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggagggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaacctttataagcaagacgttgtatgaagaagggcgaacatgcagattgctaaactgacatgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagccgttacaaatctccgcccatttatgaagagatgacagggtgatccccgaggtcagacgaacgaggacgcgtggccacactcaaaaacaggcagtgtttcagcttccaaaagaaggcaagccaagttttactatagataggatgggcccccacccaaaaaaggagagagggagaagtggtgcatgtggtatccccttgagatataaaaggaggaccttgcccacttaagaggggaggctggaaggggggaggatctggagaggagatcccaggagagaaaaaaaaaggagaagagggtttttagaataagagctctctggctctccagctctttgtagcttcttcatacacagatccactagaacacaggagtagggtattacgcttctcagcggcccgaacctgtatacatcgcccgtgtcttgtgctttttccattctcgcaaactttccacagactagaagcttagaatctcaaccagggcccccggccgaaccggcaaaggggggcttgcgcggtctcccggtgaggagccccacgctccgtcacatatatacattctagttaactgatatactagctaataccctctatccgatgccctcctggtacttcgagaagccacccttaactgttgagttccttatgatagcccgtcatgaccatacaaccggggctaaatacggaggaataccctccccagggaattaacttaggactatataccggcgcagaggaatacccgtactgagctgtcaccatcagcggcccacctttcatctgcaatatataactccaaataatgatatcccgtaatctagacatcacgtctaaactaccagtgtagacccctgattttggaaatcggaaatcttctgtgtttatccgtaccaatccctggatcagtagttggtacacacatacatagttggatcacaacatatcacgaatgaattcaggctaaaagagttaaatacttacattagggccaggtaggccaacaactatcagagaacaacagcggaagacaaaatattataagggcccggttaacatgccacaggcagtcgactggggaacgagacctagaacaagaccgcactccgatcatcttgttggatacgcaagcgtaccgacaagggcttctcttcaacactctcctaaaagatatataaatagcaagggtgagtaccaaccgtactcagcaagccaccacaacaacaatgcgtatgatagaaggtatttcaaggaatggcttcaggttcttttgcataaagctagttttgcaattcttttcacaagcctaagacctagcatagactgatcaagttttaataccagtgttcacattaaacaacgacggttttgtccaccatccattgtgatctccaggacagcttcccgtcattaagtcgtcatggttttctgaggacgtccaccttccctcctctcaggaagtggctccatcagcataaaattcatcatgcaatatcccatcccacacaagttaagaattttgagtctagccaagtgtaatacacgtcccggtgctcaataaccgcgagcacggctattcgaatagatttggtttactcacactgtagtggatgtacactttacccgcactccgcgactgctcaacgcatgagcctcgtcccaacacatgagacgcgtcacggcaaagcttttcgataacctcgcattggcagtacctgctccatgaactttacatcctcatgcactctaggcgtacacggtttctagcagtgagaggagttctggcgcacccgggaagggaaaaacacacacattcctacgttgcttcttgtcgttgaacccagtccatcatgattgttctcttatgggtatcctcatgtagtattgccaagccagcctctgaccatccagaacgggcatccgccatctacctggccacctgaaccgggcatccgccagcagactgcttgccgcatcacacacctagagaaaaccactatgcatggatactgcctccgcgcagctatctactccgctaggtctatacccatacgagaagtgcggttgtacgggggtcgtttcatgcttaacttcatggctctgtccttaactgaccacggacggcactagccttttccggacaccacccaaatcctccagccgccctagtcgaaaatagttgtttcactttattttcctttcacaaatcatgtcatcaatatcatggcaatgtggcgctcatgtctccacatgcagcatctcaattaccttcccaaggtaattgcccaagcataaagcattttgatatatatgagtatgcatgattctagagtagcatttctaagcatttgtcatagttgactagggactcatacgtaatcatggttacaagggaataagggtaaacaataatcaaggcatggcatattcacaattaggatgttcatcattgcatgcaattttatttgtaaacaaaaataatttcgcaattgggatcaacatgttcaagaaatagtgatgacttgcctgctcagaatagtccttattcttgatacaatcttgatcaaccttcacctcctgtaagttgcagacgttgcctcacgactaaccgatacacaaggtctataatacgcgagaaaaaccaatattcaaacaacaatcaaatatgcacaacaaaatgtactattcgtgtttgctaatggattccaatcatgctaagggctaaagtttcttaatctttctattgtcatcgtggtctatttaggagttaaccaacttagcgtttatgatatacatatatatttggctaatcggtggtttagtctatcaaatggctatggaaggattatggctatatatgtatctatctaaatagcacgatttcataccagaggttctgttgttagatggatttaggatcaatcaaataatgaatcatttgtattattattttattgatggaggcgttactttgattatgaacatattttacttgtcacaataaattacaaaaggttaataattatccatgctttgtatgttagagttgtttaggttaatcatattatggttacagattatcccatcacataattttacaatgaataatcctaattttcagttgaactataattataattatatgaggtcaagatttataactagtatttatctaatatacatgtttgtcatatactccccctaatttaatatatgcaacacgcaaattaatactataccgtacaactataatgggatgtatagtatatgtgtaagcaacaatatcttattattggatcatatatttgagtagttgctttttactataagctatacaatacatgttgattttaagatggctcggtttggttaactaatggatgtcaaccgaatatatatatatatatatattctacttcacatgacattgtatcgactaacttttaagtggtccagctctgtgattattctcctaaacaagttaaagattcatctatgtgtttttatattttagttacaaaatatgaggctaaattttatgtaaataatttataagtcatggatttagttatatttggacatagaccagtagatggcactaatattttcctatacacccattaatttgaaggattgattataactaatttatgtggttgctacagtggcaaagcatattaaagataattatgctattgtacaatatccatttttatttattggcacactatttaggctaactatcatctaatcatttgatattaattaatttataattataaatatattttagtaaatagtgaattatataccattggaaagcttatgattttagatgaatttaggttcaagtttcacttaaatcggagctaagatgaataagttatgctagtgtaaagttcaaatttgaattaattctaataattgcgaaacagtactgttcctaattcatttatttttattccataatttacattgactgacctgtgggaccggcctgccatggacacaacatatataagtgaatttttatagattttaatcatagggaccccacatgtaagggacttaactaataaagatcaatgggaggattattatttactaatcacgtggggccactctaacctcccttctctattctcttttctctctctcttctctgttttctcctctctctctcggctctctgcctactcggggtggcaacggcgaccgaacgagggggagggcggcggcttaccggcggcggcggcggcgacggcggcgtaaggcggagcgtcgcacggcgcggcgcggcggcaccgagggcggcggcgcgacggcgcgaaggcggctgcgcggcgacacgaaggcggcggcgcggtggaggagaaggggaaaatggggaaagaggaggtggggtagtgtggggtggaatggcgaccggggggatttatagggcgcggggaggggtggccggccctaaaacgtcgacgggatggcgcggcggcgcgaggctcggggcgacggcgacgtgcggcggtgggacggcgcggcgcaacggcgacagtgcgcggcgcgggcggggcttgaggcgctgatggcgacggcgtggtagcggcacggggctcggggcgcggcagtggctgttttttttcggcgacgggactgccgcgcggcggggcgcaggcgcgaggcggcgagaggactggcgcgcggcgacgcggcgagggtgacgccgacgggtgacagcgacgcgcgcggcgcggcacggggcgcgacgcgatgcgacgcgcgcagggctaggcacggcgcggcagcacggggctcgggtttttttgaaggcgcggtagcgcgacggcgacggctcgcggtgcgtggcgatggcgcgcggcgcggcagcggggactggacgcgacggcgacggcgcgtggcgcggcagggcaggggcgcggggccgacggggcatgtgcgcggcgacgggacgtcgcacggtgatggacag

SEQ ID NO: 41886 - DNA, 5867 bp, Oryza sativa
aggagggggaagggctaggggaccacatcaaacacctaggccataatgaacagtgactttttcctatttattcaattttggggcctatttcctattaaaacttgtcccataaattctagattccacacaaatggagtttacccaatatatgttttaatttagatgaaagttgaccaaattttaatattacccatattttatttatatatcacacaaatgatttctttttatattcttggccctaaagtgaacttatatatttttgaagactttgggggtaatattctgtttaatataatgatgtgtccttaattatacaatggtagattggtcgagtctatttgtatagcaatacattttacacagataggtttaatccatttattctataaatagtaatttgagactcggtacaatattaatctaattgtttaattaaaactctcataattttatttatttataaagcttattttatttatataaccattattttatatgagtgattttcatgttatgaggagcttgataaggtgtttcaaatattaattatatattctagtgagatactctattatagatggggccattgatgtgatcatcatttcatgtgtacttatatttcatgtgagattggattcaagtgaattatattcaaccatgttgtttccttttgttaaatatgaaatcaggctatcaacatggtttgattatttaatatttgatttgtgatttatactacagggtttaataattaacttgtactttatttggcttggctttcatgtgcataaatatttatgggattgataataaataccgtatcgttgtaaatcgtaattattgctcgggtgtaaatctttagattgatttttccattgtgtcgatttatggtttggcaagcaataacaaccataacatccaacatgatgcaaaaagttttaaaaagttcaaaattttagtgatttttaatgttgggaattttcaggatgttacaacttgatactactctaatattatcgtcatgacatagagtaattgcataagcaaacactatacccgcaccaaagcatctcccagataagctagccgtatattcagtataacatgaacataatgtaaagtaggtactcatttactcagaaagtatttcaataccataaatgtatttagaagagtatctatctatctatctattatattattaaaacagctttgaaaggaggcaccacgttcgtcgtgggggctagaaattcccacattaatcagagaaaaagaaaaaaaaggaaaaggagagtccaagtagaaataaaatttaaaaatagcttaaattcggaattaaaattttacccgttagattatagtgggtccgaattataatggtatagattaattgatatagttgtatacaagatacaattatatctacataaatagaacttaagagttgtttgtctattaaagctaaaagttgtataaaatccaaatacacttctacgtataaggttcctataaaaataaaatttttcagaggcatgcagccttgcggaattgaaatcaaacatgatataggatctatacgtatgtaacggactcaatatgaattattgtctaatttctgttagccaaaagaagttccgtatgaattagattatacatatttacttttataagtcaagcacgtatcacaacaatattcaggctttgatatggacggaaacagatcaacaaatattagggggacgaaagctgcagcagcaggttaagcaacattaaaaaaagatttccgtaaaaaaaggaaaaaaagatttctgtaccaaaaaaacaagcgctaaaaattttaggaattactaactagcagcctccgataaaaaaaagtgcgaaaaaagggtttccgccttccgtaaaaaagaaaaaaaatagtgtgaacaaaatgtccaattctaaacaaaaaaatcccgtcctccgtgcccaaaaaaaaaacaagcgcgaatttttttttctatccgattaaaaaaagtgcgttcccgttttccttaaaaaggaaaaaagtagtgagaaaaaaagatttctgtccgattcttaaaaaaaaaatagtacgtataaaccggtcctcccgaaaaacctccgtgcccgaaaaaaaaacaagcgcgaacaaaggttcccgttttccttaaaaaaagaaaaaaaaatagtgagaaaaaaggttaatggaagaaaaagttttcgtgaaacgttccaaaaagaaaaatctgattccataaaaaccgatgcttttccaaaaattccttcaaaaaaagaggctgatgggaaaaaaacgaagagtccataaaaaaaatccaatacgagattagtaaaagttaggaataaaaaaaatcaaaattagaaaaaaagaaaagaaaagaatagttaagtagaatacaatttaaaattaaatataatcagtattgaaataagagtacatatcagaacccaatagtagatgaattaaattcggaatagaaaataataaaatctaaaattaggcaaatgaaaaagagagttaaagtaggaatacaattttgaaacagctgatgaaaataaaaaaataaaaataacaaaagaatacaataagaaaaataaaataaattctgaaattggtgataaaaaagtaaagactattgaaagaaaagaccatctaaaacatatgatgagattaattaagtaacaggcctatagaggaggagagtggtggcggttgatgggacatctaaaaactattaataaatcaccaaataaaatcctaatgactattaaaaggaaggacgacgggcatgtcgtgaagtaatcggtcaaggcggttggcgggacttctagaaagtaaaaaaataaaccccaatgaaaatcatatttgatttttaaaatctcaattacaaaaaaaatgagaggcagcgggcgggtcgtataggagtacaatggcagagccgctgatggttggtgggtcttgtagaaagtaaaaaaatgaattccaacgatagttatgttcgattttacaatcccaatgagaataaaaagtatgcggcggacgggtcgtagaggactacagtggcaccgtttgacgggatttctataaattgattttaaaatctcaatgacagtaaagaagggcggcagcgggcgagccgcagaagagtatagtgacaaagttgctgacgttttggcggaattctagaatgtaaaaaaataaacctaaacgataattatgttcgatttttaaaataatactccccccatcccattttaaatgcagacatagttttccgcacctaattttaaccgtctatcttatttgacaatttttttaaaaaaaattaaaaacattagtcacgagtaaagtactattcatgttttatcatctcataataacaaaaatactaattataaaaaaatcaaataagacggacgatcaaagttgggcgcgaaaacttatggttgcaattaaaatgggacggagggagtaatgacaataaagagaagatgcagtggacggtcataaaggagtataattgaagcgtttgacgggacttctaaaaattacaaaaaagaagcccaactggacaataaactctaaaagctataatttttaattcaatttttaaaggtttcaagaagaatgaatagaaacaatggtgaatcgagcaagctaataaagaataatatgacagaagtaaacggtagcaactagtgtgacttttaaaagctataaaattataaacacgaggatgataaggtttggtcttccaaaatcttaagacaacgagataactatttatgaatttttaagtaaaatcatgttaaaaaatataattttatatgggtgctagccgcgcaattacgcgggccacccagctagttctagtaaaagtacaaagcttacaaaagagaagagaaaagctactagagccatacccgaactcttccgaagactttcgaagtcctgatttctactctattcctattccaccagctagatagtactaaactaaacttgagagaaatgagagagctattgcttgaggtgtgtgagtgaagtgagaaggtgaagtccttatatagaggtagttatgacggttgtggaaggggaattgtccaaagtgccctccaaccatcattgggatgcaatcctggacgtccacgccgaaccctgcatccaacggtgccaggatgggtttggccgaaccatgggctgggccttcccggcccatcttcggctggtggcctcctctattgcttcactttgtaaacttgtgaattttggcccaattcatcgtgtcaattctgagttcttggcccatttatacataagtctggttctcgacatcatacaattgatttatcatctgagttaatgtcgattctcctccattctctgcaaaaggttagtatacctaatactagtggaatattattattctaacagatatatgcattgcaagcatcactagttctcctctattttagtaatattgacggtcgaaactgatcgataacgaccgtcaataaaaccccccaagcttgaacctttgctcttcccgagtgaaggacgaaaggaaacaaagacttggttgttgatcatgagttgctactatgctgcatatctcaaagatacaggtgcaaggtatatgtactctctctcatattaaataatctttggcacggtggcttacccttacccctgattcccacgagacactgctttttcttgccttgagcggttgaaagacagaacagtaattagagcaccaatcacccaatctttatttatctcttattccggaagttttcaaatgattttgcaaaagaaagccgagttcctcaaatgattcactcagtctctccaagtgtatcaaaatgaattcctcaccaattgtagcctttttgattcctactctgatgtaataccccgagattcaaattagtgtattttgggaaatattaaaataaatgtgcaaaagtttaacttttaaaccgttgctcgaataggcgatccgaaaccgtggatgcgtagagctcgctgagtagtgcaaaatatactgtaagtttatagtaatcggagtccgaacgaagtcccggggatcgatttaatgtgggccgttcgatctttattagcatctctatttaatcaacagaaaaaaaagagaaaaaaaaagtaacgctagcccaagccgcctccgtccctgcgcttgtgtcgccgctgctgctccttgtcaacggcgccgcttctacgccgccgccgctacagccgtggcggccaccacaaccatcatcttccgtcgccaccggtgaatcctttccatttctcttcttcccggtgaggtcttgctgctaccgatctgaactaggctgctgctctgtttgcttctgcttgttgctgcaccagggaagaagagaagaacaggaaggagagaaggacaaatttggggaatttggtggatatttctaaattctttgttttgcctacaaattagtactgctagataatccgttttaatccctagttttgtttctaatttatttataagacgatccgtttccggtagctcgaatttattttaccggccgctaggcagaaaacttatttttaaatctggtaattattcgtagagattcaagtttggtgacctaaataagatttgtggtattcactgttatctttccaacgccgctggtttcgttcgattccgataaacggttcaggagaaacagtagaaacagtgctgctgaccgggtccgaacgggtacagtttaacgttttgcttgatctgggatttataaatgcaaaatcagttattccgctcaacatgaaagttgtagattattttctgtag

SEQ ID NO: 41887 - DNA, 15098 bp, Oryza sativa
atgtgtgtggtatatggtggaaatgatatatgaagaataacaaaaatgcttctgcctttgtgcttactttcttctcccaaaaatcctttttttattgattaggagagggcatggctacatctttttttttcaacatcatgctcatgcttgatggagcataacttttttttttcataaccatgcctttccctccccctttttttcaaaaggatttttctttttaggagaagaaagcacatgaaagcatggagaatttattttggtggtaaaatggaaatggaatggaatattgcttagctcccagtgtaggagtttggcatgtgcatatatgtggatgtatgatcttgatcatagagcatgagaagtatctacacaagtcacaagagtttgacagagttcaatggaatgacaggtaaccaaaatgtatatggtttaatcatgatagcacatttttggctctagtaggaatttatatcaaatgaggaactttcaattttatcattttgaaaaacaaaacatccggaattcaagtcaaactagtatcaggatcatagcaactcatatttattatctcatatctcgcaacaacctagacttagatcagcaagtgcagctaatttacctcagattcccggataattgttggctacttttatttgacctttgagagagcacttaccaagaacccacatataagagatataaaacagagcaactattcatcatttcaacaaagagagctagcttgtcttacctagcatgactcaaatctatcatatcattttttggtattatgtattttacaaatttgtagcgtgttttcattttaataagatgcaattggtaagcaaatatgcaatttggtaagggatatatgcaatgtgatattagttacctcagtggggcgaagaaatgtcttccccccaagcttggctttcgcatcaaacaccttgataaggattgcacccctgaaagcggaagtacgcttgaaggtcatcgtgctgttgctgcatcatgttgttgaagttggcgaactgcgcatcagcagattgttgtcattcttgcgtttgagctatgtgttccgtgaggttgaactggatctctcccgtctgcatatcaagggtgtccattctcttagtgatttcacctaagtcccaatgagaggaacttgagtgccgttcacttggagatggaggcacaccacttgatctgaagggttggttgtccccccattggatgtcatgaggcgcacgccaccagtcctcactggcgcttgcccaggttgagactccgatactatgacgtggagcttgggtccatccgggtgcgtcctcagttggctcccaacctgcctcatacatctggacgggtgttgaggatgataaactttctcgttcatttcttgtcatgtcgtgcgtctccctgtatgctccacctgcacgagattcttctatggtttgtaggggaatggttagttcacggcaattgtacaaatgataccctgcatttggcaacgggatttcatttgtacaactggagaaaaaataatcaaagatccatctactccatgtttcagaatatgcccttgcactagatatgtctcatcaatacacggacgagcggctgagataaaagcaatttggtcgctatcgacccctagcccttttgctatccgagtaatcagagaagtgcactcaacaggagtagagaactttatactttctaaccattgtcttatcatacatttcacaggagtaattttgatctttctaaccatggcaaacatgataatcaattcatctcccataatgggcctcagatcacgtctaagcaattcatttgtgcatgagcctaagtgtaggattatggatatcattcgttctaggtttcttgcaaattggagcaccagaaatatcttcccaaaacctatttttcttgaacccagaaattcctttctggagattgattttacaggaatcttgaaaaccaagaagtgtacttaagcctttccatgtaagtgtaaactcttcacggaaaaaatgaaaggaaattccatcttctatttctttcaaagtgcacagaaaatgcaaagtaagcaggagagaaccaggctcatctaccacagcaaatctctgccaaccaacagctttacaaaatagtacgtaattcagcatccatacctatcttttttagcagcttcggtgagtattctcgcgtgtgagcatactcccggtcgctcagcatgtagtaggcttgtctctcccgatcactgacaaggtcaaggtcggtgtcgttcaggagtcgtcgcggagcttcggcgtcttccatcaagacatctgctgatgaacgagtactagactcgtcatgacaacttgatgaagagccggacctcttgaacagacgagacagtcgcctcctcattttgcacaatggagcaagaacggactaactcgacggaggttaggaatgacaagaatttcacccgccggttagtttcaccaaagcaacttgtatatatgcaactaattgtttgaatttgagggaaactatcaaagcttgaatgaacttgagagcaaactttggagagggaatgaaaatgtgttgaaatggggtggaattccctctctcggccggttggcttaagtagtgcacccacaacggtcaaaaccgacctatggggcccactagccgttgcctcaaagaaggaggcagccgaccgttggcctggccagttcaaccgaaccagtgggttcggccgaacccacggtgggcccaaccggccccactttcggccgttgggttccaacggtcagtgtggtcatggcacatcggattttcactgaaaattttattttggtttgctctaaaaattttatttaaagaatttcctcagaattaaaaaaaaacctaaatgcaattttgaaattcaaacatgtgatgatgcaaaaattcaaattgttgaaagcaaatatacggatacataccaatttacctattggcgaaggtcgcgtcatttaaaatccgacgtgcaagactgtacctccatctagttcagtttgcggattttctacccgtctccggagatgatggagcgggcgtctttggcttctccctccacaccttctttggttttggtgcggacagcggcttcttctgagctggctgctctagcttcttggctggtatgggttgttttaccaatgtcttctaataacagttcctgggcatcattgtttccttctccaggaaattctgcatgaatttcaccaggctgtccattttgggtggctccacttcgacctcttgaatattctgtgggtttggcccgtactttattttgaccatggagcattgttccgtcctcggttgaaactcaaacttctcttccttgtcgttgatgtggaaacggatactccccgttcccacatcaatgttggctcccatggtgctaaggaacgggcgccccaggatgagcggcgtctcttttcctgtgtccatgtccagcaccgcgaagtcaaccgggataaagaaatcccgtgtcttaactgacacatcctccgctatccctgccgggtaacggactaacgaatcagccagttgaaggcgcattgttgttggtaacaacaccgtgaagttgagcttgtcgaagacgtcttttggcatgacgctgacactggctccaaggtcgcacaaggcctggtcgaactgttgtgcccctatcaagcaggtgatcataggacaccccgcatctttcttcttctccgggagcttgtggagtattacgttgctgcattgttccgtcagcttgaccacctccgttgttgggagcggtctcttgctgttgagtatgtccttgagataacgggcgtatgttggctcttgcatggcgtctaacaatggcacgttgatgtggatcttctggattacttcaacaaaacgagcgaattgctcgtccgctgacggtttcctactccgttgagggaacggcagcaaccgtgtgtcgcagtactcctgcggtactgtcttttctggctaaacctccttctcagccgagtcactagatgacgcttctttggttatcccattagtttctgcagggttaggatacggcggatcacgagtggacttacctcccctcgtcgtgatcgccttgacattttcagtggaggagtcaggttgccccaggatcctcccagtttcatttgcatggactaaggatgccaattgagctagctgggtttcaatcattttattaaagctcagctaattttgaaaagcagaagcaaagccatctaacttgacatttatgttttctaggacattgtcattggccgcaagctttttgcttatcgcatcggtggttttagcttgtgcaaaaacgagatccttcaaggagggctggttagaaaaattaccattgttgttacctccttgataatatgggcgtggttggttccacccctgacctccttgtggacgatgcccgttgttgttgttgtttcccatgtacatcgcctcctcacgggtttccgggcagtcattcccagaatgacccgtgttgtcgcagacttcacatgtgacgtgagagtccaaggccttgacggtgccttgtggccgtttctcgtggtcgtccaatcacttcatgaggaggtccagcttggtagcaagtaactccatctccttgacggtatgcatgcctcgctgacgggtctggagtcgttcctcgctccaacccatattggagacctatttctctattagatcaacggctccttgaaccgttttagagaagaacgctcctccagctgccgcgtccaggtgatcgcgggacatcggggtgagtccattataaaagttctgcaggatcaaccagtcgtccatcccatgatgaggacaggcggctacgtactcctgcagtcgttcccatgcttccggaatagactcatcccttgtctgctggaaacttgaaatccttccacaaagggcattggttttgcccatcgggaagaatttcgagaggaatgtcgtagagtatttgtcccaggtattgacagcagcacagttggcatagaaccactgcttcgctctcccgagaagggagaatggaaacagtcgcagcctgacggcgtcgggactaacgcctttgatagtgtacgtgctacagatctccaggaactgttgtagatgagcattggcatcctcattaggcttgccacagaacgggctagcctgcgccattgtgatgaggctgaacttcaagttgaaatccacgtcccctatgttgacctacggcccaatggccacattgtcagcagagggagcagcgaactcgcagagagtcttgttagccatagtcttgaaggtcggtggcactggtacggctggtttctctgtcggtagagttttctgcggagcagcaactcatggcctaacgctccggaagaaagcttctggattttctttgaagttttccggcaagttgaaaccagtcatgcactaccctattttcacaacaaaagtgaaaacaaccaaggttagcttacaaaagaaaatgattatacagaggcaaatataaaatattagttcaagtagtctctattatgaatcttccccgacaacagcgagagaaatacttgttggtatttcttaacgacattactagaaatataattcccagcaattaatggcgcagaaatacttctggtatattatggttacagagttcatccgcaagcgcatggatataccattgtagcatttcacccgagagtattccaagggtattgtatttattttatcccgtgggaagatcatgtagagagaacttgagtaataatttatatattacttgtgataatcatattctaagcaggggttaagataatccaagggtagagtgacacacaagcattaactactcattctcataatatatcatctaagctaagtggaaagaaaagagaaagaaaatctattcttatacttctaatatacatagtatacatacattctagttaaccgatatactagctaataccctttatccgatgccctcctggtacttcgagaagctatctctgactgtcgagttccttacgacagcccgtcatggccatacaaccggggctaaatacggaggaataccctcccgagggaataccctccaaccgtcatttggatgcaatcctggacgtccacgctgaaccctgcatccaacggtgccaggatgggttcggccgaaccatgggctgggccttcccggcccatcttcggctggcggcctcctctattgcttcactttgtagactcgtgaattttggcccaattcatcgtgtcaattctaagttcttggcctattcattcataagtctagttctcgacatcgtccgattgatttatcgtctaagttgatgtcgattctccttcactttattgtcattctctgcaaaaggttagtatacctattactagtggaatattattattctaacagatatatgcattgcaagcatcactagttctcctctattttagtaatattgacggtcgaaactgatcaataatgacagtcaatagtggatatcatggatgccatagatacttgaattttgctttcgaggctttcatgttggtgttatgacatcttaaacttggttaaatgttgtcaaagatagcacaatttgacttttattaaagagtaaatttcacaaaactacaggtattttgcacaatttatcacaaaactacagatttaagagcttgtttcacaaaactacatatttagtgtctatttttatcacaaaactataggtactttgtataatctatcacaaaactacatatttaagaacttgtttcataaaactatagatttagtgtattcgtttgtcccataactacacatttagtgtcttcttttattataaaactacatgtttagtgtcttcattatcacaaaactacaagttttaacaatgctaaaacatgtagttttgtgataatgaagacactgaacttgtagttttgtgataaatgaagatattaaatctgtagttttgtgaaacaagttcttaaatctgtagttttgtgaaataagttcttaaatatgtagttttgtgatagaatgtgcaaaatatatgcagttttatgaaatttactcttaaagttaaatttacctacttgtcttaaattaatgtactatcacgattttagtatgcttgtgtatattattttttattttttgtgatcttgcaaataatccctcgtttccgtattttccttttttcccctgaatttactcttttatgcttttttacgttttatataatttgcatggaatttccgtaagccttttccattctatcttgtttaaatagatacttctgtgttttttctgttgtttttaatgtttttgttaatttttcagagttctctacttatctttctggctccctacgaaactccccctccccatgtttccaaagtaaggacggggtaaacttcgtagtagggaagctgaccgtccccgccccctagcggaaaaactcccccgttccctgtccctatccccgcacacggggcgtggttttctcccgtccccgtccccgtgcgggtactggacacccgctgggttcctcacccccgacggtgagaaggagaagcgtctgccatgctgagaggtagcgtcagtgtggtgcgaggagtagtcgagcagaggcggcgtgatgcggagaggcggcggtagcgcatgcggaggagcaaagcatcggcggggagatggcgacgaaaccaagcgctgtcgcgcggcgcggaggcggcaacggcaggagctgcagcgtggatgtgatgacggcgaagcaccacagagctggttgatccacgcggcgttgcccagcgtggttgattcgagaggcatcacctgatcaccggcggtcggcggagcatggctgatctgcgcagcgcagcgtagaggcgtcgtcgtctcgctgcttcgattggatctgagtcgtcgtcgtcgatgtggaatccttatccactcgaccactccaccgtcctgtgtgagcagacatatacgagctggactagctctagctagagacaaaacccatcagcccatggcatgttaagtgttctcactgtgtcatatatggacattcgatgttgggctagctgggcttttgttgcctgtgggctgtacacatgctatgctcggggccccatggggaagagcttgtgaacacccccgaacccggcccacccgatggggaggaaatttagccgttatcagccccatgggggataacatgcacccacttacagcccctaatagagtttttccccaacgggtttcggggtacggtccccattaccatccctacttcgtaggaagaaaattacacgggatcgaagtcttacacctcgtccgaaggacttgtccctctacttgacacttgtcttgcaccattgcacgaatccttgagtaggctaactcccttgtctctccaagggtgtgtttgcaagagcaagttcccaacacttccctctcgttttcctcgtgtacgcttttcaaactactataaacggttcgttttttgaaataagtttctatacaaaagttgtttaaaaaatcatattaatctttttttaaaaaaaattgctagtacttaattaatcacgtgttaatggaccgctccgttttccgtggataggagatggttcccaacacccacctccaaacatagtccccatccggttcctcttctcggtgagctcgcgtccgaccagcagccatggagctcacggccggctgccactgtcaccggaatcaagcggcatccgcaatgtgttccaggaactaagtattccctccgtcccaaaatataataatttttagcatagtgccaagactattaaaataaaaaacactaatcatataaatgttactagatttatcattaaacaaactatcaataacacgcaactctttttatttaaaacatcatacttttatagatgtcattagtcacaatagtatctcaaagaccgtgtcgaagtctaaaaatgcttatattttgggacggagggagtagcatccaaacttgcacacgagtagggggtggatatcgagctggctcggctcgctctaactcgttaggataacagctggctcggctcggctcgcttctcagcgcgagccaacacactggacaaaagaaacttgcgatgcaactacagattatacaaccaaaatgtccaagaatgcaattgtatcttcgtatcaaaccaagaaatcacgtgctagctcaagtcaacaaatgcatcattattcatggtagctccacctttaacaaatcataaactcgtttgctggtggcaatatacaagatcgagcacccacctgaatccatcgccctgtgccggcaacctcctagcaagcagcaacggcgaggattggcggctcgttgcagcgctccatctctatcaactcctcctgcccggccatgacactaggggtgaaaacggtacggaaactttccggattccggacctatttttgaaaacggaatatgccggtcggaatttttcggaaacggaaacgaattcggaaatattttctcagaaacggaatcggaaatgataagggcagtttccgtcggaactcggaatcggtcggaaactttccggaaattttctcggaatttccggaaatttcctcggaattaccagaaattttgtgactgaaatacccttgattcttttttaagcactaaatagtgaataccatggtgtttggctgttatttttttaaaaaaatatttgttatgcaaatctaaaattacataagaatatttttttgtgctacattgggatttatcaataacattactcttttaaacatagataatttattcaattggatttattagtttgaggggctttttattccgataaattttcgttaccgtattcgtgccggttcgttttcgctccgtttccgatttcgataatattcgattccgttttcgtatccggggtttccgattctgatttcgattccaaaaaaatatgaaaacgaaaatgataaagatggtttccgtccgtttccgtaccgttttcacccctacatgacaccactcgaccaagccaagaacaggagagacgtgtgcaggtggtcgatgcgcttgaggtgtcggcgcagccgccgtcgccgccagacctcaaggaggtgtgccggatggagggagcgtgacgcgaggacgcgaggcacggcaacaaggcagggcggcgcgcggcagaaggaagatcgatctggattgggaatttgggaatttgggatgaggggaaagaggaagatgagagctacactgaccagatagggttctggtctttcccttttgactgttttcttctttgggcctaccgtgtttccttcatatgggccttggcctgcaaacttgtctgcctatgcttccagcttgtttaagctcgtgagcgtctcgcgagccggctcaagctggctcgttagctcggctcgtttcaaaaagatatcgaaccgagttggccacgagccgagcgagctaacgagccacgagtttttcgtccagccatacacacgaggcactcatcaagaatagaacagtcatttttgtaatcctggaagcaggaagctggaagattcatcggcaaacagaaatcctggaaagctcaatcaacttcaaccaccagagcagtgcagtgcaccatacagactaaaagcgaaggaaagaaaattctaatgactgaacaatttcactgaggcaaactgtttgcgattcatggagatggattcgatctaatcgataacgcagcttcttccaacccaaagattttcctcgcggcaggtcgggagcgcgaatttgactccaatttccggctgtcatgagcttgatgcggcttgacgccgcagggcgcgggcgcgcggcgctcgccgcacggtgctcgggcttgaccttgacgcctcgccgaggatacgaagataaatgggaattggagagacgagggagagagaggctattttgagattcgtgcgggacaggtgtcgtgtagaggaataaagtccttccgatgagggtaggacttcagtccttggcaattttcttccaacttcagagctaaggtcgtgtttagtttaccctcgactaccccaaacttccaactttccatcacatcacgtcacatccaaaactttcctacacacataaactctcaactttttttcaaactaccaactttcctcaaactttcaacttttttcaggaactaaacacaacctgagaaagaaaggacggggtatgtcacctcaaaaaattcttttgcaggaatttttcctagggattttctcccccttccttccaaaggagccctttaggccatcctcaatccaaaaattatcaagaaattattaagtaattttcatacttatcatgttcactatgcatagaaaccatgtatacaatgaatggtgtcttcaaattaaattcttatccattcatctctctccttttattcacaaggttcttgtgtagaaatagtttcttgcatgagaaatgatttcttcatttttttttacctctcttctcgttaattcttttaccacataagatttttttttacttatgtgataatgtattttaatgctatcgacattggatgatacggagggttgggaatgaccatatgttttttcatctaaggccttgtttagatttaaacttttttcttcaaacttccaatttttccgtcacatcgaacttccctacacacacaaactttcatttttttcattacattgttccaattccttcaaatttctaattttggtgtggaactaaacacagcataagggtcgattttgaataggatctattaaccataaaataaaaacaaacacatttcgcatctctcaaaacaaaatgaggtccctagatggaatgatgggctaggcaagtaccccctccgtaaaaaaaaaaaaaagccaggaggagtaggaatagacctggttgcatttagcttgggagttgggcaatagacctagtcgatgggctggatgtgggactgagcgttgggccggggcccattaccaggcctgcccattgcctacatgcctagtactccccagcgaggtggaggtgatttagggttccaggccgccgccctccgccagcagttccctgaccggcgccgcgacttctccgggccagtggaacgaagttgccgcatcggcgtcccctgcatcccaccgcatcgagaaggtaaatccatggatttggatgacggatctgtggttgcgcctcccatttttctttcaagatgagttgcgagctgtgtgccaaagaagcccatcatcgtctccatatcgcacagggacagggttgctgagagcagcagcgccaccagcccaaccgtggtgatggcttcgtcgccggagaagaaggatcctcctagttgtggctctcgggattcccagcccatcccttgcacggacgatccccccttgtctgaatccccaacgacggacctaggctgccacgatccgcgcgacgaggacgccgaccacccggcaccacccatgggcaaaggtgcatcctcaatcctcctcttgctttcatgtatgcatttccttatacgatatcgatcgtcattcgtcacccaaggcactaattcagactgcaaattcagacttttgtcccatcacacttttttgtttttcaattctaaaacaccacattggttgtgtgcctctccgtagaggccagagatgtaaaccatttctattatctgaaaaattcagattcagatgacgtctttgcctcagccaactcacacaatatgttgataggtgacatcgacgaggatagtgatgatgatggttacgcagacgaggagacaacttgcccaggtaacactactaataatccagtagagagcttcgattccagattaaaagacgaacagatactatcgctattttaatttctcagggcagaacttcacgaaggagcaggcaaaggaaataattcgcaagtggctagaaacatacgacaagaggaatagagaattcatggtggcgtgcgaggagttccaaaagcagggaggggatgagacgagtgcttcttgtccagtatttcctttgaaaccgctcccggagacaacagatttctgtaccaccaagagtttgtgctatcaccgtgaatacaagaccaatgatacttctgagagtaagtgcttgtcgattcctattataaaggattcaatagttattaatattgtgtgctaccaaattaccaaaatgtatttgtaaagtaacgacttttcttttcttttaaatgtttgtagctgcatctactattgggtggcttgaacccaaggagatgctccagatcttctctttgaggttgtccagctccatgtcctatcctattagtgtttacggaatctttgcagtacgtgattacttggaccctttgaggaattatgtcttcaaccgtaccagagatgatcctgtcatagttgaacaggtaaatacagtctatttttggaagttaagttatatatcttggctgaaaaagataccctaatatgcctatatatattatatatatgaatgctaataagatttttttttcttggataggctgaatgtagtgtgttagcagatacatattgttgacaattggttttatggttcttaaaggcatcttttgtatggtttatcgttagcactgtttcaaaatatatttttgtttctttcagtgctccattttgatataagtgcatcactgttcgctgcaactgtagtacattctcctgtcatcccttatattttggttacaatgggtctattgttaagtcttttggaagtattttggtgtaaagattttctagtgtgttaattaagaggtatatatatacctctaacactaagaggtctatatcagtagtgctcaatatctcattgttacgatatctcattatatatgatgtgcatttttgtatttcattttctgattgtactaacacgctgatggtgtccgcaaaaatatttaactgtgtatataccatcgagtttgtgcaaaatttgcatgccattctatttatttattagtatgcatgtccagttgagtttattctattagaatacttttaaaatatgtatttgtatgttctaattaacacacttaaaattgcttaagctctagctttggattctaacaagtccttttaaattgtaggattccttcacattacctctttgcagcccttgtcgaggaatgtatgtagtagaatatgcattgtttgaggttgatctttgggtgaaaatggaaggtggagtatctaatgacaagcaattagtatccgcgtatgtcgagatttttgcccgtggcgtgtttaataaggagataagggggcggatattaagcgaccattgctatctggacatacactatatgtatctttcacagagtattgaagctgtcatacaagtatccacagagattgacagtaacgatcctcgtcatgtgagattcactgcattttgtagtggctttgaccgtgagattttgctgttcaatgggaaattctgcaaggacaagtctttccagcacattgtggcaatgaagtccaagggaaaactggttgttcacttggagtttgagggatccctgttttgctggacttttaacaatggtgagcttggagctgttaattctcccgatgattcagtcctgaagcaatttcatgtcagggtgttgttttctccaaaataatgtgtaccagcctataatagcttctttgggtgaaggagaggaagtaaatcagtataaaaagcttgatacaatgtagtgcttgtgttaagatgcttatctgggtaataaactagaccagtacttgcattcagatttgcaaattgcatccagggccgagattgttggaggcactgttcacaaggaggcttaatctttgaaacctggatgggatgtccatccatcattgtgctctagcctctaatccaaacattgatggcattgtacacaatttgtgctttatgggcttaattt

SEQ ID NO: 41888 - DNA, 4924 bp, Oryza sativa
  unsure (1)..(4924): unsure at all n locations
gtctccgtctcaaataagccaaaacgtttctccaacctagctcctggattatggattaacactgtatagctcatgactttagaaaagccaaacaaaaaagatcataagctaagcttataagcctaaacaaaagagggtctactatggtccttgaacttttgcttcgggatgaatttacccctgacgtgagctagtttccaaagaactccatataaaatttgttatatactccgtactagctttctattggttcctggatcgacctaaagcgtcatatggactttggcatgctatccttatatgcaagatcaatattaatatgttaattttacccttatatgtagcacagagaaacagaaagaaaaatcaaaggcaaaggcaaaccagaaaaaaattacggatcagactgatcatgtacgtatgctttggttggatgcataaataaaatagtcactctctacagattgataatacttatcatttttgaacaatccaaattgataatacttatcattttgattgtcaaactttaaaactttgactataattacatctaaaatatttgtataaattggtcttaaaaatattttgataaaatcatatatttattgatatttccatatatattataataaaaagtcatactcacaattgtttttaaagatggtgtatctattcatctatctattatattattaaaatagttttgaaaagaggcaccacgttcgctgtgggggcaagaaattcccacattaatcagagaaaaagaaaagaagagtccaagtagaaatacaattcacaaatagctgaaattcataattaaaaataagcaatattgaaataagtgtccatataagaacccaatacgagattaatcaaaattcgaaataaaaataaaataaaatctaaaattagaaaataaaaggagagcctaggtaggaatataatttaaaaataattgaaattcggaattaaaaataaggaatattaagagaagagtttatataagaacacaatacgagattagttaatattcggaatacaaatgaaaatgaaatccgaaattagcaaaaagaaaagaagagttcaagtaggaatataatttaaaattaactgaaattcgaaattaaaaataagcaatattgaaagaagaatccatataagaacccaatacaagattaattaaaattcagataaaaaataaaacaatatccaaaattagaaaaattaaaagagagttcaggtaggaatacaattttgaaacaactaaaattcaaaaataaaaaataaaaatattaaaagaacactatacggtattaattaaaatttgaaaaaaaattctgaaattacaaaaagaaaaaaaattcaattaggaatacaattaataaataactaaagttggtgataaaaaaaaggctattgaaaaaaaaagaccatctaaaacacatgatgaggtaaattaagggcgtgtttgcttgctgccctcagattcgcgcctggctcaggcgtcaatctcaggcgtccgatttcggtcgcctgcggtcggatcgacctgcctgagcaacggtctccaggcgagggcagcaaccaaacagcccctaagtaacaagcctataaaagagtagagtagtggcggttgatacgacatataaaaattgctagtaaaacaccgaatagaatgctaatgatgattaaaaggagggacgacaggcatgccatgaagcaaacgggcaaggcggttgccgggacttctaaaaagtaaaaaaaataaatcccatttataatcatattctatttttaaaatctcaatgataataaaaaggagaagcggcggatggggtgtataggagtatagttgcagagccgccgactgttggcaggacttctataaaataaaaaatgaattccaacgatagttatgttcgatttttaaaatcccaatgacaataaagagtatgcggcggatgggtcgtagaggagtatagtatattagtatcatcgtttgacgtgacttctaaaaaatataaaaaataaaacccaacaagataataaactctaaaactacaggtccaattttaaaggttcgaaacttctaacaagtaaaaaaaccaaatgataatcatcttcaattttaaaatctcaatgacaataaagaagggagacatcgggcgagccataaaggagtacaatgggaaagccgctggcagtttagcgggacttgtagaaagtaaaaaatgaactcgaacgataattatgttcgatttgtaaaatcccaatgataataaagtgaaaatacaatgtacgggccttagaggagtataatggcaccgtttgacaggacttccagaattataaaaacgaaacccaacgagacaataaactcaaaaaactataagatctaattttcaaaggtttcaaggaaaatgaatagaaatagtggtagaccgagcaagcaaataaagaaggatatgacagaagtaaggggtagtagctggtgtgacttttaagaactatataattagaaatacggagatgatacgagaatagctatttgtcgaggaatgatcctctctagcgggtgatcgtgagatcccccttttgtgagttcggccgggggaaaaggtgcgcttgacgagatcgtttatccgccctgagtgcttcgagatcgtgcacgagtgtcaagattatacaggttcgggccgctatggagcgtaataccctactcctatggatgggatttatggttgagtgttacaaaggttcctaaactccggagagcagtctcgctcttcttctcctagggtttaggcctactgggagtcatccccctttctcggtgggtaaggtcctccttttatagttcaagaggataccacatgcaccgcttctacctactctatcacgggagggggacccactctactcagaccggaccacggtctgtgccttcgcccggaagctaagcggccgtccgtcctcgagtgggacccagcgccacctcccgcctgacacgggggacagccctgtcattccctcttaaatgaacgaagacttgtggcggtccttctcacgtggagggagttctggatgatgctttgatgggacggggcatacctgcctccactccgccgggtacaggggcgaacgtgggggcacggctgcccgtccgaccggacgtgaccagcgacaggccggtcacagtctggtcacgcctgattgacgtgggtcaatcgggccgcaccgcacgtccgcccttaccgcattaaatgcggtgagggacggttggggcgccgcgcattgatggcggttcagcntgagtctcctcnccgcgcgctcccctcgccacatggtagctgggcgagggcctcggggcgaggcagcgcgagggcccaaggggcgtgacgtggcaccccgaggccccctggctgcctttgcgtcttccaaggtgtgggggaagggctaggctgtagggccacgtggctggatgggaaggtaactcccccgtacttcgcacacccccgggcccatatcaccgacactatttaataaattttaagtaaaatcatactgaaaaatatatgattttgtttaggtgctagccgcgcaattgcgggggccacccatctagttttattttatttatttatttttactgggccacctacatgattaggcccatagttgaaatagcccgccacgtataaaagtaggggcgcaggtgaggtgagcaaacgagattattgtgctcgcttattttcttttttttcccgctcgctgttgataggtatgttgtctacactattatgacccgaacatattatattgttaggggactagtggatggtatacacgagtagtactcccttagttacttttttagttttcttaatgacatcatgtaacaccctgaaaattcgactaaataaaatgaaacccgaaattaagtactttcaaaaacttttaaataaattgcattatgctgatgttattggttcttttattgtgcattgtgttaactaaaatagaacataatggataaataaatttttgagtgaaaataaatattataccaattattaaatacggtaaaatataaacatacatggatctagggcaatataaatattgaataatatttaatttggggaaatcacatttgattcttaaattagtcactcaaatgcttttgggtgaatacaacaaattttctcaaattataaatcaaccaaaaccctaaaatgggggaaaatagagaaattagaaatgtatataataaaaataaaaatatgtccaatattaaatttgaatacaagttacatttgaataacttagagtttgtgtattttacattgtggcaaaataggaggcagtagtttatttagtttttagaagagtgatcctcaaaattagccacgtaagcgccacatcatccaaaaccaccatctaaaccaccgagggacctcatcagcaccggtttcgatagttgagggacccgttgtatctggttttcgttgacaagtcaagggacctcagatgaacttattccatctaaataaggtcccaagacttagtcaggctgagtgatggacatgggcccattaccaggcctagccattgcccagaattaaatttgaaaatataatgttcattcattttttttcccaggaatattcgggatgcaaaattttttacagaaatataacgtcggtctcgctcaaccattgcgcgaaagtgacgtgggaatgatgctgcgggcggtacgcgcggtagaggcgcgagactgcgcggtttcgcggaatggaagagtgagaccgaatggtctcgcaaaatcaaacagcgacattgtccaacggctcgatttgattagtgattaattacttaattaataattaactaataataattagcgattaattttcctaat

SEQ ID NO: 41889 - DNA, 4445 bp, Oryza sativa
gagaccgcgcggtcttgcgccgctgccgtacgataccgcctgcgacgtcattcccacgtcactttcgcgtaacagttgtgcgagaccgacggtatatttctgtaaaaaaaatttgcatcctaaatattcgtgaggaaaaatcgaatgaacattatattttcaaatttaattcccgggagtacctatgcgtattttgaaagatttgtatgatcatatcacacatatttttaatatttggattaaaattcaatagacacagtaaaaggcaaaaagcagataagaaacaccataatggacactaaattatcattttaagaaaatgaccaaatccaatataaatttcaaaacttacatacgaagattaaaaaattacactgtaacttacgaaagttacaatgtaagtttcataaattacactgtaacttacaagaaaatacaccgtaaatttgagtgagaagaaaatacaatgttggcttgtttggtaacttgagggaaggggattgagagtttacacgagggaatttataatgagattaagatgggaatttgatttttaatcccaatgtcttgtttggtggatgtgatggaaattgacagggagtttagttggagattagctcattaataaaaacggatggctgagatttgcttagacaaagtaaaggaggaatttcctcccaattacctgcccctacccaggtattgaaaaggagggagtttcttcctcaactccccatcccaatcccaccaaaattcacatgtgtctcaaccaaacaaaacacttaatagcctcatccctctaaactcccaatccatcttaaaaactacctccaaccaaacgggccgtgtaaatttgagtgagaaaatcgagtgggagataaaaaaatatttgaagtgagatatagcaaaatcgttgcctacatgcctactccccattccccagcgttagggttccaggccgcgacttctccgggccagtggaacgaagttgccgcatcaatcgacaaggtaaatccatggatttggatgatggatctgtggtttcgcctcccatttctccttcctctctttcaacatgatttgcgaagctcatcagtcgtcatcgtctccatatatatcgcacaggttgttgagatgagagcagcagcgccaccagcggacccaaccgtggtgatggcttcgtcgtcgccggagaagaagcatccacctggttgtggctctcgggactcccagcccatcgcttgcacggacgatccccccttgtctgaatccccaacgacggacctaggctgccacgatccgcgcgaggaggacgccgaccacccggcaccacccatgggcagaggtgtatcctcaatcctcttgctttcatgtatgctgtgtatgcatttccttatacgatatcgatcatcacccaatgcactaattcagactgcattcagattccgacttttgtcccattgctctttttttaattttcaaaaaacaccacattggctgtgtacctttcggtagaggccggagatataaatcattttaattatctggaaaattcagattcagacgacatctttgcctcaaccaactcagacaatatgaatatgttgatcggtgacatcgacgaggatagtgatgatgatggttacgtagacgaggagacaacttgcccaggtaacattactaataatctcaatagagagcttcgattccagattaaaagatgaacagatactatcgctacattaatttctcagggcagaacttcacgaaggagcaggaaaaggaaataatgcgcaagtggctggaaacatacgacaagaagaatagagaattcatggtggcgtgcgaggagttccaaaagcagggaggagatgagacgagtgcttctcgtccggtatttccttttaaaccgctccccgagacaacagatttttgtatcaccaagagtttatgctatcaccgtgaatacaagaccaatgatacttctgagagtaagtgtgtttgtctaaaggattcattagttattaataatattgtgtgctaccaaagtatcaatatgtatttgtaatgacttatcttttcttttaattgtttgtagctgcatccactattgggtggcgtgaacccaaggagatgctccagatcttctcaaagaagttgtccagctccatgtcctatcctattagtgtttacggaatctttgcagtacgtgattacttggaccctttgcggaattatgtcttcaaccgtaccagagatgatcctgtcatagttgaacaggtaaatacagtctgtttttagaagttaagttatatatcttggctgaaaaagataccctaatatgcctatatatattatatatatgaatgctaataagatttttgtttttcttggataggctgaatgtagtgtgttaccagatacatattttgacaatttgttttattttcttaaagacatcttttgtatggtctatcgttagcattgtttcaaaatatatttttgtttctttcagtgctacattttggtataagtgcatcactgttcgctgcaactgtagtacattctcctgtcatcccttatattttggttacaattgatctattgttaagtcttttggaagtattttgatgtagagattttctagtgtgttaattaagaggtatatataacactatgagatctatatcagtagtgctcattatgtcacagttactatatcagaatttttattatacatgatgcacatttttgtatttctttttgtgattgtactaacatgctgatggtgtccgcaaaaatattaaactttgtatataccatcaagtttgtgcaaaatttcggaaatgttgcgcgccgggcgcccgacggcagaagaaaaaatcgggcgcccgcgcctcccgccgtgcctactagtataatgctaagcattttaaatagctttaaaacgatttttcttctaaactaattatccaatttatgatccgatcatgttgttgtatttattgtaattaaatctttacaaagatcacacatgattatatttcgataaaaaaatattttagcttttttattgatattttttgaatgttgcatataatctcttttgatgcttcaaccagtagttttacgatgtttcagctagtgtgctcgagatgtttcactatatacggatcaaatgttgcagtggattttgatattatggaatacgccgttgcaacaaatcatgcgcatattatggaaaccctctattaagggaatccgtttcattttttgttccacgaaaaatgtttcacctagtgtactcgtgatgtttcactatgtatagattaaatattgcagtaaattgaaacattctttcgttatttgctgaaacattatttttatataaggtgaaacagtacccgatttaaacgattgaaacatttttgatctaactgaaacaattccgatatacttggtggaacaacgtgcaacatataaaaataattcaataataatttaatttttttcatcgaaatatatccatgtgtggtcttgttttaaagatttaattgcaacgaatttaatgatgcaatcggatcatgatttggataaataaattaaaagaaaaaatactttaaaatttgcttacaaaacattaaccacccctaccacacatgcaattctgcatgcatgcatgcaggcatgcatatagctcgggagaagtagcatgcatgcatgtaggagaagttgcatgtagtagtggctgcgcgctatcaatggttaggatttaatcccttgatccgatggctgcggcgggtttcctattttttttgctcctggattggacgcccgatccgtagttctctccgcaaaatttgcataccatcctatttatttattagtatgcatatccagttgagtttattctattagaatacttttaaaatatgtatttatatgttctaattaacacacttaaaattgcttaagctccagctttgggttctaacgagtccttttaaattataggatcccttcacattacctctttgcagcccttgtcgaggaatgtatgtgatagaatatgcattgattgaggttgatctttgggtgaaatggaaggtggagtatctaatgacaagcaattactatccgcgtatgtcgagatttttgcccgtggcgtgtttaataaggagatgagtgggcggatattaagtgaccattgctatctggacacacactacatgtatctttcacggagtattgaagctgtcatacaagtatccacagagattgacagtaacgatcctcgccatgtgaaattcactgctttctgtagtggttttgacaatgagattttgctgttcaatgggaaattctgtaaggacaagtctttcgagcacattgtggcaatgaagtccaagggaaaactggttgttcgcttggagtttgagggatcc

SEQ ID NO: 41890 - DNA, 6414 bp, Oryza sativa
  unsure (1)..(6414): unsure at all n locations
agagttattcagattcctgctttatttagttgagtcgttagcggcaacattagcaagtaattagtatttttacttgactagaaaatatgcctgtgcgttgcaagggtaaatgctattttaatcttattattgttatacggtttaattaaggtaagttcactacggaatacgcttgaatatatattcttttagaaaatcaatcatgaactataattaggagtccgatcatctcaagttagcattcgagtttttttaaagagatttcttatacgactctttatgcatttccaaaagtgaacgaacttaaaatctgactcaaatataaatatgtatttaataaaacgagcaaacttaaaaattgacttatacacggatgacgtaccaaagtatcgataaaaacattttcaatttttataatagtagagattagcctgttgtgtattcgtctaagttagtatggcctgtgggcctgcatgttaattagttggcccgtgtgcttgattggagttggcctgtgcgccgtcatatatatgtgtgtctagcaaattagcactactagaaaaatcattttttaggtggccaaaaatcattttttcaagcgggggaatggtccatctgtatacaaacgattttcgatggcggcctagtcacccacctatgaaaatcttctcaacgaacaaaaaaaaatcgccgccacccccacctgtgctcctacccacctccggccgatctagggttaggattttgggagggaaagagagatgaaggataggtgaggggaagcacgaccgctgcaaggccgccaccgacgctagtggtgggggcgctgctgccgccactgccctcccccggcctccctccggccggatctgagagggaggggaaccgccgccaccgccgctgccctcccccggcctccctccggccggatctgagagggaggggaaccgccgccgccgccactgccctcccccggcctccctttgactagatctgggagggaggggaaccaccgncgccctcccccctcccccctccccccttcggccagatctgggagggaagggaggggagccgctctgagtgccgccgcccccacgcatcaccgtcaccgaccctgcgtgtcgccctggccgtccccgccactgagggagagggagaggatagctgagggctgccaagggagaggagaggtgagggagaagaaaggagataggacttaggaaaaaaaattagcgatgtggctcctatttatatgccacgtcaattttcgcagtccgcctacaaaaaataaagggtatttttgcaggcataccgcttaagtggtccgcttgcgaaaatagagttttgcaggcggacaaccatctcatcccacggttgtcattttcgcaagcggtcatttagctccgagaaacctacccgcctggaaaaaaaatgacatcgtcgggaaaaaatggtttttctagtagagtaggtctaggaaaaagattggtttttatgtgagttcgagtcgagcgatggcgatcccatcttttttatatgctattgaagattgctgagaaatgtcacgtgcacttggcatgttatcctggtatgcaagatcaatattaatggaggatctcctggggatgttcttaaatgcaacgtagaagtagaactgttggccatatgcttttaattgtatagacgcaatatcaagtttaaagtatgattttttgtacagcgggaggtgcacctgctagtatttctttttttcttttttgactgaaaagttatagatggcttgagaagtatatgtctgcttgtgtgaactgcactgtacattggaattggtgttcagaagacttcttgttgtgttgataggacgacaagaatgttaaaagaaatgcatgcactgctacttgtttgattgggttcatactgtcaatatcattttgttatatcattttgatctaggttcaacttatttgaactgcggatggttgaataaagttgtatgatattctgggtttttttagttttttaattaatttcttgagtttctatgaattttatggaattttctatgaattttcagaagtttttgtcgttctcataaaattttcttatggtttttaaggtttgtttttgaactatcttatttttcttatactcattatagatttttattatttttaagcacatatgttttctttttcctactatctctttgtccattccaagtcccaaattgtatatgggttttttcctcccgtgggagtaggttcccctaggtgtggggtgtctcacagggaaaatccccttgggggactattttctcgggtttcttctcccgaactttcagactagctggctcaatcccctccaattcctttttcacagagataaatcaaacaagatataagaagagtgggaactaaaaggcgtaggagtgcgagaatgagattgcctgtgcattaaccttttggctaattggcttgcttcgattgttttgacatcctaccccatttttattgactcgtataatgccacgtgttatgctaacaagtattccctccgtcaaaaacaaaccaagcacatatgtgatatatctatccagattcattgtattaggatatgtcacatctatgtcttaggttctttttttatatatacagagggatagggttgaaactggttcggatagtttctgtccgtccggaccatttttcagatttggatagtttcggttggaactatccggaaattctcggattcggaaacgaattcgaattttttttctcggaaacgaaaatgaatacagtaagggtactatctgttagaatcggaaaacggtcggaaactatccggaatttttttcgaatatctgcagacattgagcaaattttagaaaaaaaatacgtatatatacataactttttggcaaattttaatacatgagacccaaaatttgtgtaatttgctgatagacatcgaaaaaacgtgtcatggctgaaagacattctaaaaaactggtaatttgctagatgacacttttggctcaattgaagagatggattccaaaaaagacgagaatgcccctttgaccacatgcttcaaacatggtgttagagtaaaaatttggagattatgcaaccctacatttgccatagcccaaagtacatcactagcatacaccatatttcattttcattctagtctcggctcaaaaagcttttgaccctagggtcattattgtctttttgaaaaatttctctctccgattaagttggaagtgtcctccagcaaatttccatttttagagtgtctttcagccgcaacacgttttcacgatgtctatcaacaaattatacaaattttggctgtcatgtagcaaattttgtctaactttttcatacagaatcaaatgaagacaaactttatatcaacattgtagagcttgatgagatctacaactttcttattgactattttattatttgggttcatttaagggtctaaatattcattataatataccatattattttttacaaaatctcagatctacaattcaaacgacatctgatggagatgtgttccatatcaaagttgtagagctcaacgggatctaccactttgtagtttatagcatttgtatttgaaagcatttaaagtataaaacaaacattacaagtttcgaagatgtgaaataaaataaataacatctccagtttatacaatggtaagtaattaagttatacatctagtaaaaggtattgggaatagaaaatgataattattttttgcatatggatctcttagaggaacaaccatgaaaatcgattttcacatatggttgtgggaccatctacaaaattgacgatataaatgttggagatgttaaactaaaataataagcgatatctcttccttgatcaagaaactcaatttgaggggttttttatataccggcaaatattcactaccgtattcattccatctcgtattcgctccgtatctgtattcgataatattcaattttatttccgtatccgagttttcgattccgattccgattccgaaaaaaaatatgaaaacgaatatgataaagctagtttctgttcgtttccgatcagttttcattccttgggagtgtccattcttcaccgtcgcggagataaaaggaaaaaaaaaagagggaaagtggaaacgccttcggggaatacgcttccctttccattctgcgttctctccaccgaaaacccccatgcaccgcaagctcccgccattacctcccctcacactccgccgctcctcctcctcctcctcctccgccgccgccgcggcctctcctccaccgccgccacctcgccgtctccctcctccggttccgctccgtgacctcctcgcccaccgcctcccgcccacgcccacgccggaccggcctcccctctcgcggccgcatcctcacgccgacgtcctcctccgcggccgacgcccgggctgcgacgcctcgccggagagcctccacctcgaggtcgtcaagaggggcctcacccatgacctcttcctcgccaaccacctcgtcaactcgtacgccaagggcgcgcgcctggacgccgcgcgcagggtgttcgacggaatgccgggccggaacgccgtttcttggacctgcctcatctccgggcacgtgctgtccgggctccccgaggatgccttcccgctgttccgcgccatgctgcgggaggggccggggtgcaggcctacgtcgttcacctttggcagcgtgctccgggcgtgccaggattccgggccggaccggctgggcttcgccgtgcaggtccatgggttggtctctaagacagagttcacttcaaacaccacggtgtgcaatgccctgatctctatgtatggcagttgctccgttggtccgccgatcctggcacagcgtgtgtttgataccactccagtcagggacttgatcacatggaacgccttgatgtctgtgtatgcaaagagaggggatgcaatttgtacgtttactctgttcagggctatgcagtatgatgattcggggatcgagttgaggccgacagagcatacttttgggagcttaatcaccgcgacatatctttcctcatgcagcttgggcctgcttgatcaattgtttgtgagggtgctcaaatctggctgctcaagtgacctgtatgtgggcagtgctttagtaagtgcatttgcgagacatggcatgcttgatgaagcaaaggacatttatctcggtctgaaagagagaaatgcagttactttgaatggtctgatagctggtttggtcaagcagcaacatggtgaagcggcagcagagattttcatgggagcaagggattccgctgctgtcaacgtggatacatatgttgtgttgcttagtgcaatagctgagttttctacagcagaacaagggttgaggaaaggtagggaagtccatgcacatgtgctcagagctggacatatttataggaaaattgcagttagtaatggtctagttaatatgtatgccaagtgtggtgccattgataaagcatgtagagtttttcagctgatggaagcaagggatcggatttcatggaataccattatcactgctcttgatcaaaatggatactgtgaagcagcaatgatgaattactgtttaatgagacaaaatagtataggtccatcaaactttgcagcaattagtggcttaagttcctgtgctggtttgggacttttagctgcaggccaacaattgcactgtgatgctgtaaaatggggactatatttagatacctctgtttcaaatgctcttgttaaaatgtatggagaatgtgggcggatgtcagaatgctgggaaattttcaactctatgtctgcacatgatgtagtttcttggaattctatcatgggtgttatggcgagttcacaagcacctattactgaatctgtacaagttttctccaatatgatgaagagtggtttggtcccaaacaaagtgacgtttgttaactttctagctgctttgactccattatctgttcttgaacttggaaagcagattcattctgtcatgctgaagcatggagttacagaagataatgcagtagataatgcactcatgtcatgctatgcaaagtcaggagatgtggattcctgtgagcggctgttttctagaatgtctggcagacgggatgctatctcatggaattcaatgatttcagggtacatctacaatggacatctgcaggaagctatggactgtgtttgtcttatgatgcatagtgaacaaatgatggatcactgcaccttctccattgtactgaatgcatgtgcttctgtggcagcattggagcgtggaatggagaagacatgcttttggtttaaggtcacacttggaatcag

SEQ ID NO: 41891 - DNA, 708 bp, Oryza sativa
atggagttcataccttcataaggtggtgacaggtcacatccaaacaccaaagaaatctatgagaagctcaactttttgattcagaagataaggaatgcaggttatgttccactgacagaatatgttttacatgatcttgaagaagagaacaaagaagaactgctaagatatcacagtgaaaagcttgcggttgcttttgttctgactcgttcctcctcaggtggccccataaggatcatgaagaaccttcgggtttgcggagattgccatacagctttcagatacatttctcagattgttggtcggcaaatcattttaagggattcaatccgatttcatcatttcaaggatgggaaatgttcttgtggggactactggtaacttgtttatactgctggtaccaggaacaggcttttcctaactacacaaatttgaggtttgggtacttgattactaggtacatggttttcctggacttttcatatttgaggtgaatatcacttctcaccaggtacctatcatcccttaaccgttgggtactaatagttcatttccctttctccgagtaagttgctaatggttctctacctgatgaatactttaacctaataaatagtgttcacttgacttcgatttataccgagtgtcaaatatgaatactgacattgttggtgtggtttgctgtgatatgcgactcagagctttaga

SEQ ID NO: 41892 - DNA, 8886 bp, Oryza sativa
  unsure (1)..(8886): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagagatgcctatcctctacttggtcgtcgtcttgatcttcttctatctatcttatagctagctggctggatggcttcctctcaacaaggagaacagtagatctcttggacacagcagggacgactggcttgatctttatatagacgatgacgacccatcgtcccaatgcatccatcgatcgtgccaggctatattggctgtacctaggaaaagcacctcattggttggacttggcccaattcttctgttcaatttttttctccatccattatatttttatatatgtgtgtgtgttttttttactttaacaagatctttgagatgctatcaataatatttataaaaataagttgtttaaatgaaaagagttgcatagtatgttaatttgtttaatgctaagtcgagtaatattatccatatacatggttgttttttttttgctattgatagcaaaagttaaaaatatttgatttagctttatttttaaaaatgcttatattttaagatagagtgagcatttgatgtctctcatggctgttactatcaaacattaatcaatcattgtacttaacatctatcagtttcagttttgtgttataagtaaaatttttgtaacttaaatcaaatttacataaaatatgcaaacgtttacaatatcaagtttaactgaaatctactgtgaaacatgtcttgcatagtgtattcatttgggaatgtagatgttacttacttttttttccctatattttgattgaagttaaagaacttttaattcagaaaaaaactaaataaatgttacaatatggggaactttttttagaacttacaatatgtaactgaggggggtattttctaacactagcttccatgtgcagattagttaactatatggtcaacagcttcaccttaattcctgtgccaccggctgctgctattatgtagtagtagtatgtgatggttttcgttcgcacgtccagttgcatgtactttacaagataggcgtaccgcaacatgtacactatagactacttatcctcggtcgacgtgtcttctcctgcttcatatgtttccgccggttgatgcttttatatggactttcttctagagacaccatatttctgttatatcatgcatgagtgttgtctaagtttctatatttaattagtaaactaactggattttgctaagaaaattgcatggaccaaggtctaaatttagttggaagtaatactgtattaatttgatatatacctttgtttctatttctgtaaatatatacagctgtattttgcgagtaattttatcacctttgaaaagataggggatatcatattttttttatataaaacatgatattcctaggtacttaatatctataggtaccaaaatttttaattttagtgtaaaatttgttacctacatgtactttctataggtactttcttaagtaccttaaaatttattttgtttatatgtagagtggtcaacctaaaatgaacggtattaaatttttgtcctttaatttgttcttgttaacgtattaatttggtggattttaggagtagtgtacttttggtcttttttttaacaaatactataaacttacaaatggttagaatatgtcgaatatactagtcctactagaagttggatttgaagttagaataggtgtaggatacagagttagaatcggattcctgtcatatgttttctttaaatagaggggagcaccacaatgtaaccatgtcgactacaatgtgcgtagacacgtcatggactcataatggcttagttgccatgttgattggggagaagcatccataatcagagctctggagatatgggcttcggttgaacctcgttgacaaatatcgtgagttcttgtgtcttcatgtaatgtgtcttgggtgatcaatgactgaagtgattgagaatgttagtcgttgttccgctatatcaactaacttttataacaagtggtatcaaagccaaaggttttagcattttgatcaagaagacatgtgaaggaggaaacacgaggtgggatcatgcatcggaaggagatcatcaatcatggcaacgagatagatggtgacaacgaggatgttgtggaggcgaagcttgtgatcaaaccagggatggcagaacgtgattggaagatgaggctggacatggccgtaggtgttctgagatatcggaggggtagtgctacgaacgacatgcctgacgcacgcggcgatcgcagatccgcgacggcgaggaggctatagaagaagggcgaagctgacgaacgtgatgcggtgcggtggatgtgcagggcagaggacgatgaggtcgtggatggtggacacgagggctgcgactgcggtacgtgcagaggcacagactaatggcatagggtgttgtcctatgcatattgcttgcacaaagtgatcacccagcaagatgtgtggtagaggtgtgtcatgtgtgcagaccagaccgagctaggtcagagctagaaggttagattgcaagcaagcaatcataccgtgggtaataggacgttcggatcaggttgaaaaaaatacccgggcaacagtgggttgaattcgttgattcgtttggcagtacaagatatatctaagatatacgggtcggcatgataggatatatgaaaatatgtgtcattaaagaggaagagcaaaggttatcgtgataacttgttcaagtgattcaaggcaatattgaattttctcaaattatcatggatttggtctacggatgcagaaaacatagatgttggattttttagctcggttcataagataataagaaagaaatggtcatgacatcaattttatgcatatacaggcgcctgggtatttgatttggatttggaaaagcaagtgttctataaaatttatggtttttggttggcttctcttaatcaatcgtttaaattaatacctatgacatgcttgatagaagacattgtccttctgacaattctgatttagcatgtgtgctctgttcaacccatgcaagagaaaccactttacatattttctttcagcgtccttttagtgctgattgctgggctcggtttggtattgtctgggacatccctctcacctttgaagatatgctagctagctacatcaagcaaagacttcctataggtcttcacattttgttgagaaagttctttatgcagcgtggaacatttggaagcaaagaaactcactaatctttaagaatatacctccattagtttcttatgggaaagctttctttaagattgatctttcgcttttagtttttatattaaatgtttctgagagacaaactctttcacaatggataaacctcttgtaaatatttttttaatttttattaataatttttttactgtgggggtttcccctacagtatttctcctcaaaaaaacaaggaagaaatggttctcttcaatagtccaatgagtttgatttgtttatttagtgatgacaagagctatctagtcatggattagataaaatcaaatttaagacagaagataaaggtgaacatggcctttgaggagtctagtatgagccggttaaggaggagttcaatttgagttggcaagatgactaagatgataggtgggaaaatggaggactactgcaggcagagtccatatgaagaaattacagggataacaaaagtctcctaattgttatattgattggggcctactacaagctatggactcgtagcggcttagttgctatattgatttgggaggagcgcgagccccggagatgtacgctttggctgaatctcgttaacaaatatcgtgtgtttctgtgtctttatctggtatgtcttggatgatcaatgactgaagcgatcgagaaggttagtcgttgttttgctatatcgactattttttacataatagggttaatacaatgaattaataagttcattttacgatcttcaactggtgaagcgtggaaattaaatttggactttaacctcgcatgattcaatcctcggaaatttcaatccagataaaacaataaaaattgactgagatctcaaaattctgaaatgagtttcttgtaataactggtaaagtaaacttccagatgggaaattccatataattgacccacaaaacttaaaaatctttcactgacgtacacaacctttttccaactttgggaactttcacggaacacacacaaacttttcggttggccttatgagacctttttagttcttaagccatgaatgtcaagagattcaccttccagaaagcgcttataaagaagaaatgggaggggcattacaatttgagcccttggatcaaagttcatcagagcaaggtgttcttttcttctgaagatgaaaattaagttttttatgcaaaacgaggtggtattaacgtatggttggttaagttttaattattgcaaacttgaaaaatagattaatatgatattttagagcaacttttatataaaaagttttcgcacgaaacgcaccgtttagcagtttgaaaagcgtaccatgaaaatcttaatattaatctaactcttgttggagaaaagaatgggacaagcagtagacaagtttaatttgatacaagatgcaacctgttgaatgcaccatatatgcacagcaaggttcaagcatgcatgcgttgatctgttctgagaaacctcctcttgttttaattaattacgtggacaataccaactggaccactggtaataccactggtaatatgaactcaacacattcacaaacatattttaaagattatattagggaatttcacattttcaccttctaaatatcaattaaagaaatgataaatcatggccactaaatttttcttggtaagtacgtacacggaaatgctggttagagttctataaaaaaattgttacttaaggtaatactcttttcatttttataatatctgacgctgctaacctttttacatatgtttgatcaataaattttacacaaacacagcaagatataagtcatgcatgattaaaaaacctttaatgataagtcaagtcataataaaatataatataattatgttaattttttaaataagatgaataattaaacgtattttatcagtggtgttgtgtattaaaaaacgtagggattacatcatataataagttcaagttaatcaagggcatcatctggcattttcgcttatatatatatcttgtcacagagtaacatcccaagacaatgatcgactcaacaataagacggtcttcaattctttaattatattatctccatttgatcgtttgttgatcgaattatatcgcatgccctcctgctttggaatacaaatactctacacaattcgactaacgtgactgccaaaaccgtcaaatttaatttaaattagcgatccataatcgatccagacaacacttgcttgatggacaaccctacaattaactaatacattggacgagccgggacccaatcaattaataacttttgtctaactgagagctggttgcctttaagcaacgcgatttgtacatgtcacgctatatttgttatgaaatcatcatgagagctacgctctaggcctctagcttaagtttcgtctaaattatcgcgtaatcagaggttgacttggggcataattatagcccaaaggatgaaattagcttaccttggcacgtcattatctcagcatttgatagtactaatcattttagagttagaagcacttttctcctattacaaatagtacttcccctaattgttttggacaagcatctaatcaaaccttttaaagttagagtatcaatttattttaataaatatgtagattgagtatatgaaaatcatacaagatgcatgctctttgcctcaaaaaagtactttcattaaaattataatttaaatggattttataaacactttacaacaagaatcagtagttcagtagtcccagagtcatagaaatatattgttttgaatgtcttaaatcaattttttaaaaactttaaacatcaatgctttctaaatattgacaccatatgcatgaaaatcatatacgtagatttgtcttgaaaattattttcatagtattatgtgtttgtcatgttttgtaaataaacaaatttcactataggacatccaaagattatggtttttgctattggacactagtaaaacatgaatttggctgtacacaacataaaaatatggtaatttaattgctagaggacatcatgcacaaccattaaactgtaatatccactcaatatgtatgttgcccctttcgttcttcctcaccaccttgccacctgctaggtttttgagagtgagagagcatagagggggtagggatacagtctggttaaaaccaaacgtacttgcctcgttcacacggatgggagtggcattatagtcatcttaaaatatctctctgctcaaacatgttagaaatggtaaattaactgacacggtgttctccagcaagttatcatgtttttaaggtgtcctcaagccgaggctgtttggttgataggcataagttgccacactttaccatacttgaggttaggcaagtttgaccatgttaaatgagtgtttggttggctcccacaaatgtgacaagattcatcttttgtaatctaggtcccacatgtaagtgactctaaaagtgtggcatggtttcattttgttggttagagtgtggcttggattttgatggcatcacctttgacaagtttagctaagaaagtatggtaaatctaggcaatgttagtatatgaaccaaacagcccctacgttttgatagtaaagccataatctttgaatttcttctagaaaattttgccttataaatatttgcaatagaaattagtagtaatcttgttttacaagggtaagctagtagttaaagttgtgttttaaagatattgtcaaggtaacgaaatgtttccttgaccggagtaaatagttaaagttgccatgttatattatgtattgtcgaaataacatctagttgtgactgaagggactatattgatctgcactttcaatttgttagtccaacttccagcagacttttaattggaaaacaacagatctctggaccactgtatcgttgacaatcgatccaagggtggtcttctgttaatcagtcacgatcagaaaagtagccttttgggatgctatacatattccaagttttaaaggaaatttgtaatatcttactccaatttgcaagtgtcctcttgagtatcataatcctaggtcctagctagcttgtttctagcaaattgcatatgaccaatcaatttcttatttgtcaacgaggccgatgcacctttatcacctcaaaaaacagatttgtcaagatttcatattactgccgagtaatagaaaaagtcaacgcaaaaaaaagtcaatgtgtcggtgtcggttagcgtttgatagtatactgtcattaacctttttcttatgggtttacgtcagatcatcagacaaagaaaaacacaccgagaaactgaaatatactgtctttattccgacaaattgatatttgatacaagcaatcaactaaccacaaatataacccaacctttcagctgtatatatagaaatgttatttttttccactgtaattaatctttctgtgctgttcatcatcagatcatagccaaggggtgttgtagagaggggtgaccaccgccttggtgtggaggtacttctcaagggcgtccatgcccatgtccttgccgaagccgctcatcttgtaccccccgaacggcacgtcggggtcgaagccgaggtagcaattgatccagattgcccctgcccggatcgaccgcgaaaccgtgttcgcgacgtcgatgttcttggtgactatgccggcagccaggccgtaccgggtgctgttcgccttctggatcgcctcctcaaccgtcctgtgcaaaaatgttcaggatccagtggtttcaggctttcagttagatgttcatgtgatgttagtcaggctggaaatgttcagaaaaagatgcctacttgaatttcatgagggccatcaccggcccgaagatttcctcttgcgcgatcgacatttcttcctgcgcaaaaggggtctattagtttttcgcacgatttggaaatgtgcatttttgttctctttgaaaatgctgctggtcatattttagcactgaggagtgaagagcacactggtcatgttcatgccttgacgtccgtgaagatggtgggctcgatgtagtacccgttttcgccgcagggcttccctccggtgaccaacgtcgcgccttcgcgcttaccgatgtcgatgtacttgaggatcttctcgtattgctccttgtcaatcttcgttgtaattgcacacaagtggttattacagcttgctgaacatctttggttctctgaatctgaagtttgtatagttgaaaaatcagagcatggttactgatctagcatatatatatacctgagggccttgatgaactcgcgggttgaacggatctccgaccaccgatttcttggccatctcggtcgccttcttcacgaacgcatcgtagatcccctcctggacatagattcgcgagccggcgacgcagatctcaccctgcaacagaacaggattgttgtggaaagctgatgagattttcacaatatgttgtgcttatgccagctagatggttttctgacgacatggccggtgagaggccgaccttgttggtgtaggaggccatgtgg

SEQ ID NO: 41893 - DNA, 15992 bp, Oryza sativa
caaatgtcacatgacaataacatatcgtagcttaaaaaactaaactattgcacgcttgcacgatagctaccacacatggcgattctgaatcaactagctagactgatatttgcatgtttcttaagataaattacccatcaggtctctgaatctctgatcaacaactttcaattgcttccacgacacaaacacttgtaactaaaaaaaattatggaagaagacaccggcatgacagacactctgaaggaaatattttggacgatccccagtatgaattccaggatttgatcatgaaacttgagagttaattaggagccaaattattattgttgcagacgaaccagagccatataatattcggctaccataatcagattaattatctgatctccgatgacatacaaggtgttttttactgacttaattagtgtttgagagccagcagacccagacctgaaaattgttcagggacacctcaatgggcattgtctacagtacttctggtttattagcagtcactggtttattagcctggatgcttgcttgttaattaattaattaattaggttgtcaccatctcaagattacatatataatctctcatatacagaaccatccaggctaactagagctttctcggaagatcagataaaattatctatttatcttttacatatgtatgtctttttcttaatgttaatggatggatcagttagcctctagcttttttatgttaggtccaagtagattttccacagcatgacaaatttgcattgtttttttcaccatccacttgtctggtttgctcattatgatggtgatgaatatagtctaatcccactttttgaatgtcattatcaatttaatggggtgtataattgatgcttacttagtgacaagatgtcaaagtggaagggcgacatgtcatacatttttcttattgctaattaattaacacgtgaacttttttacatttgagcctattactctagagatatcataatattgtgtacacgtatgtcttgcgagataaaaataaatactaataaagacattgaatttcaaagcactttcaacctactacatactagtacttcatcctttagtagtacgaactagtctaatcgcgctgggatgaacagctcttttcgaacgaaagaattttgtacgcttttcgtagaagttaatttaatttacgcaacatttctttaaaatttctccatttcaaagtaggcctatgttttaaattccttgcaaaatattaccaggcaatgaattctgctcaaaaacatcctattcatcatttatatatccaaatcagtacttggctagcacgaaaaataatattattatggaggatggatggtcaatgtcgaagtacccaaatatgagaaatatgtgatcagatatatatgtacttaatttgtactcctataatttatattcagaaaaaagcaacacgtaattgagtgttgagcccaatcagagcacaataatgcattgaaatatttgcaggcgtcgtcccctagcttagcacaacaatgcaattttcctttttttaagaaaaaagctagcacaacaatgccagttttattggcgtctgcataagcgacgttgcaagctagtgttatctgccatagtgatagtggcatgcttggacttattgggtcggacggcccggccgtgtctaatttattgaaaagaaaagaaaagaaagaaaatgtacggatgctttatgaaaaataaacctaattaagcccctgaaaacgctagataccgaacagctcagtctcaacagtcaacaggattcatcactcgtgtgtgtgtatatatatgtgcactgatcgttgcacatacattgaacttagacattgcctggtataactgtcccgtaaaataggataagacccttgtaaatcaacggctcatattgcttctactacgaccaatagagaccagaaaataatccacccattctcaaataatttacgctgccactatataattttaaacttttgaccgctcgtccttttacagaaatttaataaacacttgaaaatatacttcataaattcataatataattatttaaaagtaatttgtaatcaaagtgagacctctatagttaaccgtgtcagttattcgagaacggagggagagtacttagttctaactaaagctgcgtgctgtcaactcttgacctgactaaaaccgtagtatgttactgtcaaaattaccgcgttttccatgtgtcccactaccctgccttttctcccggacactgatgcgccacatgatatagctctagtgatgcatattactccatggtaccatgtggcattttgcaatgctgccacacagttcatcatattactatcatattcatatggatacatctcgccatctgtgtggatctgcctgtccttctcaagctctctcccacccttcgttttcttcccacagtgccaatgcctgtctcgcaacgctccataggctcaccgccactagctaattaagctatagcttggacacacgcatcattcccaggaaaaaaaaagaattgatttcatctaaaatttaatacaaagctacaggcagtgacgcctggaaattctggccgagtttagttccaaactttttcttcaaacttttaactttttcatcacatcaaaactttcctacatacacaaactttcaaatttttcgtcacatcgtttcaatttaaacaaaacttctaattttagcgtgaactaaacacaccctctgttgttaatttcctaacttcagttcagccccccctcccccgcgcatagctttcgtgtcgggcggctcgggggcgcaaaaaccctagccacccgcgccttctctccctccctccccctacctcgccgccgctggagcccgccggcggcgaagccggtagcaggcagggaaggcggcggcgaggccttcttctcttcgtagcgtctcccttctctgcgcgaaggacgaagagtcgaagacgacgaagctccccgccggcgtggtccatggcagctacggcggcgaggaggggaggaggcggcggatccggagcccccatggccggatccggccctccctcgcctggatctgcgcggcggcggcgcgaggaggcctggggcggcgcgacgacatgcggtcgtggtggcggccggcggcaaggcggcgaggcggcggccggctgcggctaggccggcccggcacgggcgcggaggcggcggacgactgcggctcgacgtggaggcggctcgtcagcggcaggcgcgggcggcggatggccgcggctcgtcgtggccggccgggtcgcggaggcggcgggcagcgcagcctgcccggagcggcaggggcacccccgctcactcgctcggcctggtcgcccggcgccagcccatggcgcggtgggtcgtccaggcctcggtggcggctcggcgtgggggccagcagccgggatgccgtcgcggtggctaggggaggagcgacggctggacttcggggggccggcgggtggtgccggtctggagcagcagcaccaccggcggccagatggcagagcaaagggagttggcggtggtgggtcgtcttcctcgttgccggtcggcaccctcagccttcatggagctcctccccttctttgcggggagtttctaggttggattgaggcggcagctcgtcagtgggggaagctcaggctgccgaagcaatgccacctagtcccgggttctccttcggccaaatctggcgaggcggccggcgggtggtggaacggaggagtcctgggccagctttcaggggtggtggttcgttgaagtcgaccgacgaaggggcatcggtgcggtatggtggatgccacgtgctgccatttgtctgtgtggtggttctgagttggtggatggcgatctgcagtcaaggttgtagggtcccaggcgaaagcctagtccggtggttcaccggaccggcagcggctacgtcttcggacgtcgtaatctccttggagcgttgtcgagggttaccctccccctttcttggcgagcttctctgggtgaaaaccagatctttttagatgggcgatggcggcatcctagatgtcgtgaccaccatggtggcatcgttttcggagcctcgtctctgtggtgttgccgtaggcctagcgggggtcgtttggtgctaggtttcaccctcagcggtttgtgcttgggtggtagcgtgtggtgtgtggcaatgcaccttggtgtattttgatgttttttctcttgtaacttttattccttcttaatatactcggttggcctccttcggccttcccggcgaaaaaaaaaataacttcagttcagagtttcacacggagtcgacactctgtttttcttttccccccttcttcaggctctacagtttcagattttcagtctttcacacgcaatatgcagctgtagtgttctcgctctcttggaagtacatccactttcagctctccatgacgtgtgtttctctcgagcaatatcttcttgaaagtgagatgtttggggggggggggggggggttgatgacgtgttctatacgtacccatccgctcaagatctttggtgatgagatgtatgtagaaatgtgtgtggtgtgtttgatcatcttcttgcgtttgtttaaaaaagctagatcttggtcaaaaagaggcttccataatttctgctgttttgatcagtgatggatctttcaaaacgaaaaaaatatagagtgatggcatggcacaacttctgtttggaagtacctaacatgtaagcaggtttagctcttgtttctcacaaccacacaatcaaacaaccaatatcagttaatttttttgatatatcccaaagatgcccgtgtccaaagttgtcttcagcattggcacaatcctggaatatttgacttgatccctagctaagccccaaaactagcaagttgtccagtagtagtaattaatatattaggcctcatttgatttacctccacatggaacagggtggaccatgcaacatgcatttaaatatgcatatttggtagtaatattttaagcctcttttggaatagaggtttttttttaatgaactttacaggaattatacctatttattcgaaaattcggtgaaactcatgcattcattcagtaaacaaattctccgaagcaatgcttaaatctagataccatactaccattgtctcatcctcacattcggtttcttctatcttttttacacgataaatcaccctcacttgcgtactatgacgtcccgcacttcttaacacgctatagatactactcggctatcacatttatctaacttggtgttaaaagcgcagggtgtcgcacgtattgtgactaatcaatactctatatccgtctctgttttcgttttgattttttttctaatcaaacttttgagtttgttcaggtttattaaaaatattagcaacgtttacaacgctaaattagtttcatctaaaccaatatttaatatattttaatattgcgtttgttttgtgttctaaatgttgctatttctttaaaaaaattgttaaacttaaagaagtttatgttaatttctaatacgaaacggagatagtaaaaaaagaaagttgcaaacaataaagaaacagaagtactaacagatgcttcttgttgctaactttcgtgagtcaaaaaaagcatcaggagaagaataataattaaaaaaaaggtgaaagatgcaagagggaggattaattaggaagcacgcagcgacgtaccggagacggcgtcgacgaagcggccattgatgaagagcttggtgaacttgatctccagcttcggcacctcgaaccccttgctgtcgccgccgttcgccgccgccatcgccgcgagcagaggagaaataaaagaaacacagagagatgtggagagagaaattggaagtttggagatgtggaggggagtttagagatgatgcgcccttttttaaagggagggatgggaaaccccaaggcgagacggcttgatttgatttaatccttgtcgcacgtcgcgaggatagcggcttctcctcgcacgctcgtccttataaacatacacacatcttatccggctatcactataaacacctataaaagattagaccggcgtatttttgattgatgaagccaccacgagtatctccttatcgacgagtatattatctatcactaaaagaatattttatcgtcgtgttaaatttagcattttaaatattggattgattagtttcactgtaagaaacctagccagttaagctttaatcatacctattgtattgatttattttaattggcatagtaataaacatttattgtttccctcttatcactgtatggcctgggtccctgggactcgggtgatctctgtatggcctggatcctgggacatgggtgatgtggtgggcgccgatcctctgtactctgtagtggtgagtggtggcagtggctgatctactgcaggctgcagtaccgtagacaatctatatcggttgtggtggtggctaattcctcaaagaaggggattggttgagctgcaattataatccgtagtttaattgggtaaaattagcagtaataagattaaatctcaacatttagtgcccgttctaaactacaatttgaattggttgattccttgattttcattagcacattttttaaacgttaaatgatacatttcgtgtagatgttgattttaaaaatcagataaatctatttttaatattttttttaataattaatatttaattaatcatatgtaaattgcgtttgtgcgggtaatcatcctaagccaactaaaaaacttataaagctacggctgataataaagcaagacgaaagacagaaccgactcttgtaggttattatttcgcttacgctgattataagccgtactgttttatcagtccaaaacatagtttgcgaataaaagttactggcgatttaaaagcaaactgcgatgaaaaaaacttaaaaattagaagtttaattgaaattggaacgatgtgacggaaaagttaaaagtttatgtgtataagtaagttttaatgtgatgaaaaagttaaaaatttaaagaaaatattggaaactaaaccaggcctaagtcttaaaatttaaattttggcaaacgaatcataaggtgatcgtaaacagagagtggcctgccaagctgggcagtgttgcgcctcgtcggtttctgatgtaccgggcggccacgtcaggagaaaggacgagtcctgccgcggacactgacgggccacgttgagggcgacggacacgacgcagccacccacaaagcctggactctcgatatggcatggcatggcgtggaggtgtcctctcatcgacttgtgtttctcatcgacttggcacgaagtccttgttcgctttcgctacccagcatccaggtgcttgcccccagcagcgccgggcgatgccacggctcgccggcggcggcgtccgtgtccgtgtcccacgttgcagtgcaggcaagctggcatggcacggcgcggcgtcgtgtgcgtgccctgaccagaccatcacaagtcgctgcagacgctgcagttgcagcagcgggccgaggtgggaacaccgaccgaacaccgggccaaaggagtgcgacgtgacaccgtgaaggaaaaaagggggtaggggttgttccacatgtgacaaaaagggcactggcccagcaacacatgtgtcaccagacaccagcagcagtcgagactcgagaggacagatttccaaatcgccaccagatcggctttcgctttggatttggatttggcttccaaagccaaaagatggaaaaagaaaaaagagttatcgaccattgcaacaaatattctcacggtatgcagtttctttgtcgaatcaaaattcctctcgctctctgcattttgaagattcaaatctgtaacagtgtatgcacaacatttttcaggaagtcatggcaagttgcaaacaggacaaacaggcgccaagtgccaaccctactatgtactttgtcaggctttcaacggaacttcaggatacagagatgtttaagtaacatgaacaccccagcaaggatacatcatacaagcatttggaaggggcatatatggcctgctttggtcattgttgtgtcactgcgacatgagtcgcaatgcaattcctcatgtatcacacaactcacaatgcacaagttccatctgctacatcaaccttccctagattcaatgctattgtacattacatcgggtgaacgtaacagttatgccgtgtcaccaccacaagcattatagctcagcttacagaagatttatggtacagatgagctgaaggcattctgctttatatgggaatgtccttgcgcctgctttctccaggcttgggttcttcacgtacatattgggaggggtagagtcagcatgatcatgtactcatgttgtatttctgaaaaatggatggtctagagcttcttgggcagtaagacgctctgatggctcaaattttaaaagcccatataacaagtctgccagcaccgcccttgaatgatcagccttcctcgccactaagtcctgaagtttcagtccataatgtttgaggtgtgtaagttgaatcttcttcagaacagatatttcagaatatgtttctaatactttctcatttcctcttagtggaaatttgaaggaataattttactaaccagcagaataatactctgaatttaccacacaaacagcatagtaaatcactaaatgaaacagatactacactacaagaggaccagttcaccaaagaaaatggaactttattttttctatctgcaccctgacaaaactgaaataagctttatatcaaacatttacaaacataatatgccttcattcagacaaatcattaactatagatgcatagttacattaaaaaaaaacagcttctgcttctactcttgatttgtatgtttctatgcatggtatttcttttacttgtagcagacaggagatagactgaagaacaggaatatgcataatattgttttgaattttagagatataatttagattggggataaacgtagcaaaaaaaaagagacataattgagggaaccaaaacctttagccgatctagttttttgactgctctgatactctctcttgaaacagcaccttcaggccaatttagacgcgctcctcgtctaaaatatttctgagctgatgaactgcatattccagttgacatacacgatgcaaatatggaaaatcagtataaaatgaagaagattgatcattgcaagacagtaaatggtagcataccatagccaaagttaacatgacagccacatgacgtactcagaaacagcattcgcatgagttgcatctattattattactttatatgagaactatggataaatcaatcaaaagaaatataagactcgagtattagtgagttggagtaactataaactgttaaaaaaaaccctggatttaaggttgggtctacacatgaacaaactgttgttaaattacaagctagtataagaaaacggacatattgaggggttcaacttggcagaatagcataccactaacaagtcaagttctatagaaaggaaaacccaaaaaatatttttaaaaagtgatacaattaaaattttccttgtcaaatgccaaattaaacagtaaaacatagattcgtttactacttgctatattgaggacaacacagaaaaaggtaaaagaaaatgatcatcaaagtagtgtgcacactgccacaatgtacctggctttccttatcatgtgttctgggagtggacccaaaaccctctccatcattgctaagtgctcaaggttctcatgtgtttgaaacaatgcttccccctaaaggttttttatggttaggaacataggctaaggtaaaagaaaggaaaaatatgcatgacaagatatcaaaccgagcatagctcaacaatgatgcatccgacactccaaaggtcacaagggaaactccaccctaagcctgtcataggaacatattcaagaatatcagaattatctagggaggaatatatgctccatctctaaaaataccaagttaataaaaacattcttctcagtcaaatgcctaccactttactataaagcataatcagatagtacactgaaaaaaatgacgaataagtagaccaagtgctatttcttctgccaatactaacatgattatagtgatggcaagaagttttcattgttttaatgagttctgtcatttcgaatcactaaaaataagagttctaacagcattatcaattattgcatccaaggattttgaattgcacctttgttgtgctccattggagcatactcgaggccacattaaccttcatcacaaggatattccaaactcaagcaagataaaataaaagcaaaccttaaaagataaccaatttacctaagattatttcaggtgctctgtaatgccttgtagaaacaatcgagctatgttcctgattatcaaaggcggtactaccaaaatctatcagctttatggcactggactttggtaagcacttgaaatgcatctcatcttgtgaattcttctgtacaaccccaagggatcattcaacataactgctaataccgcatgcctagtttcagaatagcagatgatcactacaaaactgattgacattaccttggaacctggaacccttatatactccgaagacacaaggagtatgttttctggcttcagatcagtgtgaataaggcgtaattcatgcatatctattttagaagaaagaaaggaaaagatggtcaagcatgctccttttcagcaacagaagaatgaatcagcagctaccgaatttgttaagaattgatatgcagaatcaaacaatcacacacatgctacagattccaacagttgccgtccaaactcccgcacaagttccacagggaaaggttggtatctatttctctttagaaaatcatacaagcttggcccaagcttctcaaaaacctgacaaaaccatcgatatccattgaagaaaaattatctttgatttgtttccatatcggcaaacctttatgagcaaagaacgacaactgttttataagcatggaaatcctattcaagcacattaccatatcgtacatagcagcatgtttcactgcctacgagcaaaaaggtgaatattcggagggccagcaaagtaaattgccaacaaacaaaactttgaactaacagggaaaagtggaatatggaatattggaactgtaaatgcgcatatcaacaactgacatttggtatagatttttagaactagcataaatgaatgaaattgagacttacaatgcatatatgattgcgatagtcaaaccatccttgaatctggacacagctggccagtaaggaagactgatcaggagagaaacagaaaagactaagatttttgggatcaaatattttgaggtactcacagtgatctgtatctctcattttctgcaaggcggttgagcacatcgatctcaatcattgcagcatccctgtacttgcggatgctacgaacaacttttattgcgacatattcatgtgtttcacggtcccagcattccaaaacacgcccaaaagtacctattaaaaatttaaaatgattcctgttgctttacattacaataatagcaaagacaccaggtactagggaacagattgcagaaaatccaaccttctcccattttgctcaagattttgtctgcatagccaagaagagaagaatatcaacgaacaatctcacagaacctaaatagctataaagccctacggttattgcaatttcaactaaaattagcatcaataaatgctgggaacaaaagcaaggaacaagggcatatatagtttattaacataacagaaagttgctaatccaaacgggaaccttgtttcattcacctcccttggttttagaacacagatacaatattatactgtattacactaggtaatcaatgtccaaatcactcatgcgattattgcaatgaactttcgcagtagaattctacagcaccacataaaactgaacaaaactactgcagtttccaagcaggcaggatctaagaacacacaaatctcctttcagccaaccaagagacaggaacggggtggcgctcacatcgtcggttcaagttctcgccgaggtcgaacacgtagtgcccgtcgcggtcgtcgtccctccacggcggcgacgcgccgcccctcgccacctgcaagcaccacaacgtcagcacaggagcccccatgaaccctaggaacccgaccacccccatcgagcaaagcagacagagggatgaacggacggacgtaccaccgcccgctccgccggcggcggcggcgcgccggcgccgtcccagtcctggcgggcccgcttccgcgaccgcgacgactccatggattccgattcgattggagagagaggagagagagagagaggagagagagagagagagagaaaccctaggcagaaaggaagcgggggggaggtgagtgagacgatggggtccccgcgggccaagcgggccggggcccatgtgtcagcagctaagtgggccttgggctttagtgggctttcaactccgcgccatttctcgcatcgaccggagatggcaaaattggttctatggcatcgaaagttctcgattttgattctatagcattaaaagtttatgattcactttaatagcactgaaaactacatccattactatttttagcattccgtcagcagttccgtcggctcaccccatcctacctctatcttcttcctcctgcgctctccctcctatggttgaccactcttcaaggcatcaggcgagctcgaccatgacagtatagcgctgagcgagttggagccttggatggtggcagctggttctggcatgctagaggcggcggctcttgggtcggtagacaacggatccagggcaaggaggagtgggtcggcactcaggagagcccgcaacgagcgcgagggtggtgcttcggggcgaatttgagggccgatggatgagctcgatcgagggcagcatgtcggagagagctcaagggcgccgacaataatctggagggctttgcttccgtgcggtcccgacaatgccggcgacgagctggacaatgacacttcgggcgttcatggattggatgagcttgaggatgacgcatctaggggagaccgagggcagtgcacacggacgaactcggaagcggcacggccgcggaggaaatggacctggttgagcacgcaagatttgaacaagctctagcatggccatggcggcgcggcagacgagatcgatcgacgatggcgctgtccgggcaaagctagaatgtggatagatcacacctagcaagcgcggatgaacacagcggcttgcggatgagctcgtgagggctcaagtattacatgacgagctcgtggagccagcatactgcgttcgcaccatggctgaccggcctgagctcctgtatgactgctgtttcgagatgagaaggaagtggaagagggccaccattggtgtttgatctaattttttgttgaaaaataataataagaaaagaaaactaactggagtttggatggaatgctaaacagaagtaacggaggtaacttcaggtgctatcaaaatgagccttgaacttttgatgctataaaaccaaaatcgacaacttccgatgctctagaactaattttgtcttttttgtcccctatattttggtcacccgccgccggcgccgccgcgccgtctttcgacggctgccctcgctggcgattgcggcggcggcggcgcgccggtcgatcgagggaagcagtggcggcgtcgcgtgggggcgtggctgatggcatcttgggaggatgaacctagcggtggatctcgggaaccctccgagcccagcggctgcacggatctgatcatgccgccgttgcggcctaaatccccgccggaattactagaccggctgcttctccacgacgaggaggaggaggagacgacaagctatgttgcctccgctcacccagcgcccatagaatatggtacgtacgtacgtacactttggcatctccatatacgtactagtatactctttccattctaaaatataaaaacttaggattgaatgaaatatttcctagtgcgatttatctggacacttattcaattttaggttcttatatttttaggacggatgaagtatatgtttctttctctgaattcttttgcaccacaacttgtgcatgtatgcatatgcaggttcagacgacgacgccggtttaaccaggtttgtcgatgacatgtatagctgcgtggaactggatgatgtggtagacaaggagacggtttgcccaggtaaaaatacaacatttactatgggaaagtctttttgtctcggaaattttaactattaattttgccactataagaaacagccactattcaaatgcgactttcaagattgtcctaaaaattttcccactcgatcaatcgtgagagaaatatcgttaatattttgccttttttttttgcctacgtacaatgttatctgatcgctaatcgatcctgatcgccaagggatcgaccaggatgagtaatcgtcgatcagcctcgattaattgacctgatcggtactatgtataccagaacctaaatagtataatggatggtataaagcaatcagtgcttataattgatggcagaatgatcacttacttgccctagtacgtataaagcaaccaacagttgtagcacacattcagatgtgctcaaccctaagacttgttctgaaagtgatcgataggtgctcgatctgatcgcacctgactgacgattaatcaaatgatcagatttctgatcaagctgatcgaatgaatgtccctaatcggagtcaggggactgatcaggatgattaatcgtatgatcagataacacttacttacatggcatgacacataggcatatcagcatggacaagtgacgtgaaatgtccattctacacttagccgtcctctttgtgttccccgttgatccatttcagactttcctatttaatgttggcctggaatcaattaaaaagatcaacaaccatattcatttcttgcattgcatgcaacgagttgaggtgaatccatcctcctcggtactaatttgggccatgaaatagatacaggtttatgaaatcaaggaaaagggagttaaaacagggagatgaagagtgtcaaagcgaagatgtttcatgtcgattacaacaaacatttatcaagaaacataacagaataaccatgaattttctctccttcttaaactttcccgaatctaacctaaataacaaaaaaaaaaaaagcagcgaagtaaccaaaattgggaaaaagtggcaaacagagagtggtggtttagaagagtggcaaatagttaaatatctcttttgtctaagatgtcttattgttttaatttttgaatgtcaaccaaaaagttttttcttaacaaaattaacaatatcgatcaatatgtgatatattgctacataagcttgcatgtttaaatttaatcaacacaagtaaaagaacaaagtaaactctagatagtacgttactatttacaatcatgtttattcttttttacaatttgtataggtcaaactgaaacttgtatgtttgttaagcgatatgtcacacattaatctatgttctatttttttatatatttttataactatttagatggtatattagaaaaaggggagggggggttgaacttaagagaaaaaaaccatctcccattacagttatgttaatccaaacaggagctacaaattcatacatgcaaatacatacggttgataccttttttaacttaattaactcttcaggtcagaagtacactagggaccaagaaaaggaaagagtgactttcaga

SEQ ID NO: 41894 - DNA, 1159 bp, Oryza sativa
gcgcacgtgacgacgcacccctcattttactcgtgctcgctgcggcagtgttcctcctctttcaagttcagaggggcagctcgtcatgcacatgcaaaggcaagcatcgcctgttctgttttgcatcaactgatcaaactgtacacatacttcctatcttctaatacaaagcttgtgtgtgtttgattaaacatggccaggacctgacaatgtttctgctcgaattttttgtaagtaggtcgatcaccaaggtgcctgacactgtgttcctatgaaaaaaaatgaaaggaaaaaactgacaatttctatgcattaagcagaacaatggagcaagcgttataaaaacatcccatgtctgaataaaagcaccatagcaacagttaatatgtgacccattcaggtccagggcataggaaatttgcaaaacgaatccatatctgaaatatatacattgtgaagcagagaaaatacaacctatttgccgagaaaaaaaaaagaggaagccatgtctgctcttttgtgaagcagaaaaaattgttgcaggcctttaaatgttaattgtggttagttttatatctgactgcaatataatagttgtaatacaatagtcttagacatggttcaatctacatgctttttttattttaaaaattatagtccaatgataaaaagcaattttgcaatgacaaacagaagaacgattgcatagttgtaatgccctaacaataatgggttcctctaaattacattttactagccctaattttttgacaagccaaacatgatcaaatggctggatttaattcctcgtcaaagaaccatgaagcagagtgtccttgcaaatcaccaaccagcatgctttggagtcaattcatatgatcatcacaagaaaagggatgaacgttacctgctaggaatggtacccaacaagttctcttcctctactcttcctccagctaggtcaacatcacgatcatcaccggaggccatcatgcaagagatggttggggaacgtcgccgccgcctgcgtgcgcaagaaagacgggaggcaccgcgtcgtgtgcgtgggaacaggaaacgcgcgcttctattctcccgcgtgatcctacctaataggccacgtattgacctgccaggtgcggccagctgatgtggagca

SEQ ID NO: 41895 - DNA, 2276 bp, Oryza sativa
ggtactttttgctggatcgaagcaaatctcttataaatataactgcaggattccattaccttacctctttgtagcccttgccgaggaatgtatatactaagttttgcattgttcgaagtcgatctttgggtgaaggcagaatcagaaggtggcggatcagatgacaagcaattgctttctgagtatgctgagatcgagaaccgtggcctaaaagatcctatgatatatggacggattccaagtgatcgttgcctgctagacgtagactgcatgttccttctcaacagtgttgaggctgtcatacaagtctttacaaaggatgacagtgataatcctcatcgcgtgagattcaccgccttcagcagcggctttgatcatgagatcgtgttgtacgatgacagattatgtaagaaggggaagttgttccagaatgttgtcgcggtgaagtctaaggaaaaactggttattcgcttagaattcgagggatcgacgtttcggtggacttttcaggatggcgctgttgcagctgttagttctcctgatgattcggtctcgaagctgtttgatgtggtggttcttttttctccaaaatcatagttggtatctgcgccctaagttgtcctctttataggagaaagaacacattgatcaaatgaagaaaaagcatgctgcaacaaagcattcgcattaagattatgaaaatagcaaactagaaatgccattgcattatttgtttttactgatatggtattatcgtctaagtacaaccactttgactgctatattttgacttctttcaattgtggttgagatgtaccccttccccccaaaatacccaaaatataaaggattttggttagatgggagcctgtccagattcgtagtactagaatgtatcacatctgaccaaaatcctttatatttttggacagagggagtattaatcagcgacagacctacaatgttcaacgtatgcttggcaatatattatgggttctcattatttgacctacaaaattttgcaggttcaaataattcaacaggaaacaaaagataaactatgttggaaattcacaaacaatggtatctgcagtacaaagagtgcttacaaggaggtttacaaaagagaaatttcaaatgctcatcaggttcactctcaatccctttctatcttgaaataaatctagaagaacagatacatccctcccaaagttaaaacttttgcctggagactcatcatggaggcccttccttcttcccaaaggctaaatcagaggattcaagacattttagcagcctgctgcagatgtggtcaaatactcaaatagaaacagatttccaccttctcttttcttgtccttttagtaaattaacttggatgatctcagaagcaaaactctactgatatttttcctgctaatgttcctatggctcttattattgcttatatcattaacaatggctcttccaattccaccctaattcgaactctgaatatcatgtggtagctttggaaagctagaaatgatcttaagtttcagggaaaaatcaaggagccaactcaagtttgcatggaagcaaaagcaatgattaaaacttatacaaacttcctttcaaatgatttgatgcaggaggatcttgatgaggaagatacaaacagaagaatggtgaatttgcctaattgaattagatgctactcagatgctgcctggagtgataacgaaacaggaattggcattttctttcacataccttcctctcataatgccatttttattagagccacaaccataatggctcaatcacctttgaaggggggagctgctagcatttcaactggcaatggagattgccagattcttgaagttcactttctcacagatagtgccatcatcgcgcggacacttgcaagagaagaaactttcaagaagaaccagggcattggagcttaaggccaatttggagccaaatttgtatgagaaggttggagaatcttttgcaggttaactggatcccaagggagctgaacaaattagctgataagttagctaaagaagccaaatctcagctatgcctaaatccaacttactcttgtcaaaatatatcccatattgccctatcccaacaggagatgttatgctaatcatattagagacaatttcagtatctcgaattttgctatccaatatgtacaatgctattgagttgaataaagagtttataatttttttaaaaaaataactctacatactccctccgttttttaatagatgacg

SEQ ID NO: 41896 - DNA, 1297 bp, Oryza sativa
tgcaaaatggcaaaagaaagctgagtttattctccgcccgcacctcagccagattgccggaggggacgacgagcggccgccggctgatggccacgaggaattgggagcgatccctattttcctggcaaattttcttcgaacgggagcgcgagcccgtttggccgcctcactccgcgcgttcgtccgacgacgcagctgcgtcgaacgtccatctgagtcagaggatctggatccgaatttaagtttagggagcaaccaatggtagatgttcatgttaaatggcttataagctatttcttcaagataaattgcttttcattcacgattccaatcaatcgggttactgcccctcgcagaattaattaaggtaagcaatgctttacatttgtatttagttaaagcttcaactaacagcaaaaaaaaaaaaacatattaatgccctaataagtgaaatcgacgagatgttacagataaggaggcaaagacaatagtcccggcgtcacttgcaaactctgcctcatgaactcactacagcactgagcatatgctgtgaacaatgtgcaaagaacaagagtgacccatgcattagagatttacagtacacaggcggaaataatcctagcatcagaaatatgagatgctgcacttgcacctagctctattgtttctttctaactaaagaccaaattaaagattatcaagggcgcgcctagctagcttcttgagcacaaccttcatgtgccaccaagaaaatatgcatccatattgcagagatccagattacaaaaaaggaaaagtggacaaaaaaaaaagagcagtcaccatctgttcgccttaatgtatcttctgcccttttatgcagcaaatgttacgaccaattaactgcaagctccttatcttggaaggtaatctgtggttctcttttgtagggctgcaccaccttgatgatctcatctgcattgagaatttctttctccaatagggcatttgccacagcctgcagctgcatctcatgctgaagaaaaaaaaaatcaaatagctacctttctttttctatgttcaagtaatattcattgtgaggcaaacccctagtcctagttaagagacaaaccttcttcagcaaacgcttcactcgctcacgggattctcctaggagtttcaacacctacaagcccacattattagcacacatgacacattgaatctcttcacacgtttatagggacctatgaaatagtacctctgcattaatcgtggcctgcatttgtacacttggccatttttccagatgcatacg

SEQ ID NO: 41897 - DNA, 2354 bp, Oryza sativa
ggtggaatcaatagaatgggtggtatcaattccttccatggtaagaatacatttattcaggcgacttacatgttttataagtcgatgagggttctgtaagttatgggtcaagttgaaaggacgacagcacatcttttttcgaagattcaaacacgggtatgattctcctagcaccaacaccagaaaatagtcacaggagaatatgagggttagttcagcataaacaagaagtcatgattaagatggagaaatgttaacggtgaagtgtcattcaagacatatacagaggtatatattgtatatttatgtctttgtacaacaagacaaacaattgctaaattgaattagtactacatgaatcaaaagggatataaagagaagtataaagctcaatccaattgtacaagtgatctcacatttcctcaaattcagaggctgtttggcaaaagaatggtacaccagctcttgcagaagtaacctaaagcagaagagaacctccagtaaggtgaaaggtacatgattacaaggaaacaaatgtagacgaaaagaatgtgcaaaaaagtgacatatgtatgtagttttaccttatatcccacagattcttcattcatctcttcttgatggtctggtgagccggagtactcatcacattcactgaatgtcatgtaagcattctcaatcagagtcggttgattttgttcgttgttgttagtgggtggaaattttggggatcgttctgtgagaaagccccaagaaggatcatccaaaccgtgttcacgactccttcttagctcattttcagtccatgcaacatctattgggccatctatggacagatgtacaggcatatcctttagaagaaataggttctctgccttatcaaaagtcctgtggataagccgtacctcttcaagaaactcctttgcttctgcttctgtcacatctttcttagaacttttttctgtggcatcatggtctcttctacctttttctgcaatttcactttgtgcaccatctccttggaaaattgacttaacatccccacaagttttactccatgatcttgccttttcaatttgtcgtttcccaaaaacatgtgctggtgatgccctgaagttcttgtgaattttatcaagaaagagattgtcggacttagcggcttctggaaagtgtaagatcataacttcaccagcttctcttacttcatcatctgagggcataggagcttgaccatcaacataccgatgaagaataagaaatgacttaagaagagcattatctccacattttgcttgatgggcagtcacatatgcaccatcccagggcagcttttttgcatgttcaatgaattctgattttgtgacccccaggtatccattctccctaatacgaagatcatcaatcttccctgtgcttctagtaatataaccattgaggtatccagaaataccttcaattagagcacaaagccacttccctttgtagtgcatgtacactaggaaatgaccttttggtgggagagcacaacatcttcgatacgggtgaccaaattcatatcgtgcgtcagatgtattgtagcaccatagacgataatctagcaccgactttcgccatctgtttcgcacttgtacttgagtacctttcagatccaccacggtgtagttctgttttagtaaaaaaaaaaatgtccacaaattaaaagaggcaataagggggaatcatgtctgaaaaaaggtcacgtagcttataaatagaacagcttgtgatcatgttacaccacaaaacatttgagaacaaatacgagtagttgatatattacacatttgataaataaggaaaagggtaaataaaatactacatccgttttttaatagatgacgccgctgttgacttttagaataatgcttgaccattcgtcttattcaaaaagttactgttaaaatatgctaacgtgtaagtcatactaaaaatttctttaatgataaagcatgtcacaacacaataaagcttttgaataggacaaatggtcaaacgtcgtgacaaaagtcaaaggcgtcatctattagaaaacggagagagtatatgtaactattatactttagataatcccatgaaacacatttttcataaaactatacagaagcattctgcattcacaagaataaacacaccacaaaatttgaactccatctaaaagaaagttcactcgcaaactgccatgaccaactgaccatgtggactaatattaggcaaaagatatgaaaaggtatgttttatttgtcaccaccctcacgctaccccatagaacgtatctcctcctcaggcccaccttcctacctcacatcaagggcctg

SEQ ID NO: 41898 - DNA, 10865 bp, Oryza sativa
ttatgcgggtagcgggactacccacttgcatccctacttgttcccttttacacccgtgaaacacatcttcttcctcggttcctccaccacctacaccttggcatgccttcgccgaggaagacatccctcatcaactatcggagtacaatttgtgcgataaaggaaagtcactcataaccaagaaaaaagggcagattatagtattataagagaagtatattgcattattgcagccctgcttgttacatggaaggcatatgtcaggcctggcaattcagaaaaggagtctaaacaaaccttacctctatgaacacaagaggagaaaaatcatattctacctcatagatctgaacatctgaagttgtatatttgaaagaaagaaacccaaactacaaacttactaggtgcaggacaacttttagaaaagaaatcccaaccttgggcgacccaacggacgtaataaccaaaacaatctacggcacactattcatcattagataaatctgactacagtttagctaagtaatgtatcttgtatggatactgtaccggagatggtcgatccagaggtggtggtattgtatatgggatccgcgctttttcccgagcgacgcggccctcttctactcttccgccgccgccgccgccgctgctgctgctgccgcctacaagcatccccttccctctcccttgctccattactgcttccccttctgtacggatgtacccttcttctagcagcgtactgccggacccgtccccctcttccaccgccgcaagccggcaaccacacctacggctgccgcacccttcccttgatcgtcacctgcatgcgcggctatccccgccgccgcactccaccaccaccaccaccaccaccgccaccgccacccccaaccccaaatccacaacctgctcgctctctctctctctctctctctctctcgcgtaaggtttaagctcagtgactaaagtgaggtggtttttttttttcttacagcggctgcggagctggacttttttttttacattttaacccttcttttataaacttcttttgctgcgagtttttttttattgtctttctggtcattcactcttttcttttttatattttataatccgtgtacaaggcacatatgagtatgactgcgtggcttcgtttgagcctcccgtgcatgcaaatcacactcaaaatctttcatctgctcttacgggtatttatactatagattgaagacataacattatatttcacgaattttaaatagtaccattatcgtttataggtatttgaaatataccattacttatcctttctacgcttaccaaaatatttagatcaaattatctctctactttgtccatccccttcctccttccctcctctagggtggttgcatggtgacgggatagcaagtggccacgtgcggcggtgggtaatcataagactacaaattcagaaatatatttatcaaaaatctataaacttaagccattatatctcataactatagttctagtgtcatcttttttcataaaactatagatggagcatcaattttctcacaaaacaaaaaaaaattaccacgataataggtatagggatagcacatatgggtttgaaaaaaagatgatactagacctatacttaaatatatatagctttgcattaaaatcattcctaaatcaataattttgttataccatggattaaatatacaatttttttgataagtttattgaagtatcaattaattcattgaacctctcatgcatatacataataaaagaaaacattgcatctaggaatggcaaccctgtgccatgtatatgatcttgtttagattgttatattgatatctgaacttgtttgttatattgatatctgaacttgtttagattgttatattgatatctgagagtcatatgagctcggtgccaagagtcttggtgcgaccatcggggtgcaaccgtgcgagctctttatacaaagatattactaagatctattttatgataacttcttttaaagatttatttgtaaaattagtttttgggaggagctaaaatgtaaaaagaaaaaaacaatgagatgcaaagtgtggaagggtatttactgctggccacgtggtttgtagtccaccagaccaccgtagacagacacgtggtgaacccgtggtttgcaatggagcatggactggtgaacccggtgttgcacaaatagcagagctagtggatgccgggaaggcgggaacatcggagactgcgaaatttcccgccaggaattacaagtactgccccttcattctaaattgatctacatatatttcatacatctatttcaaattgatctatatatatttcataggtacaccaagaccaagaaaaactaataactctctcatactatttttactctagcaacaaactcaatgcatgcaccatcgccactactccctccattccataatacaaggcacaaccacttttttttagatgttccataatataagacatacatgcatgtataccattaactatgacaattctccattaaattactacttttctaaatgcttcactctcacattctctaactctattggatgcatgcattacatttattaggatgatccaaactacaaggtgataataactatttcttggtctttgagttaagtgtggttgtgccttatattttggaatagggtggtaataaatacttgtgtgcatggatgcatgcatcaatgtccatttactccaatgcacaaataacaaatagacttaataaatgaacacaaatatgtgatcatttaggaataacctaaaaaaactataagtagatcaatttggaatggatagagtactccgtaaattctatttgaaaaataagaaaactttacttggcctcaaaagtcaaaaccaatattttttatttatactattttacttataatatttgaaaaataaacccctccaaattttctattattacaaaatagatattgcttctagtttttaaaatatttttattacaaaattgcatgcctaatgagcgctttaacttgaccagcactgtgctgtgcgaaaaactgatagttttaacttttaactagtagtcgcataatgcccatgtgaattgggatcacatgcaggactacaagttaagctattgcatataataggagtcatctttttttaatgaacggatcatattattagctacagtgctaatgtaaaagcacttgacaatcttctacattgagctacagtatccataggtattttgaccatgggatccggatctaacagccggaagtggactgcacaagttgcagccacacttgctctcaagtatagttgctatgaacccactcatatcacacttgcttattgatatgggaaaatgggttaacccgacacgtgatgtcggcaagtttacgaaataaaacatgtttacggaaagtaattccttgcggcttccatctaatcattatatggtacgaccacatgggtgatgtgggccctccaatccttaagcttatgtataattgcccggaggtttattttgtcgcatgtcgggggcatttttatccataaacacaacgacaacaacaaaaaagtcatgtagaggcaatttttaaagcgagacattttaaatgttgcataaaacacttttaatctagatatacttttagcataactagttgggtgcccgtgcgttgcaacgggaaaaagaatatgcctcaatttcaaatcacaccaagtgaaataatcactcggtgtaatttgtccccaaagaacatgatataaataatgttctactatataataatactactaagggtacacggcatcaatgttagccaatcaaatgtctgaaaataaaaaggcctaatgcctgtcatttcatcaatgagcaagcataaaagaaaagctgatcaatccctttatgcaagacccatgtagcttcattgagtgacgtcaacattgccccattacgagtcctgttaacagagttctccattatattttgaacaaagttaaggcaaaagcctctgaaaatttagtacctaatgtgtattccctccatactcgcaaaggaagtcgtttaggacagtgacacggtctccaaaacacaactttgacttcttgtttctataaaaatatttattgaaaagtgatatatatatatatatatatacacacacacacacacacacacacttttatgaaagtattttccaagacaaatctattcatataatttttttattttcaaattcaacaacttaagagttattcatgatttatattcctaaagtttgacttaaacattgtcctaaacgacttcctttataagtacggagggagtatcattacagtctatagcggtgggtaccttcatttagcgaggttaacttcgttcgttcaatcatgccaaaatcaatagaagatgaggcttgctgaaagctggagaacgccttctgaatcaagaagaaacaatactgtctattccctgattttcgcatcactatcggtaatatcataagttatgtggtattgtctagttgttgggcacatccattttatcttgtttgttctaacaggatcaatagtatgaccatggcacctgcacaaccgtttattaagctacaaactgcttaaaagacaacctgcagtcaagaacttcatcaatttcagacaactatctttaactgcagaactgacccaatggcatgatgtttgtccttcgaagctcatttgtgttactcacacgggatgactatatctcccatgtatacatctcagccagttgtcaaagttgcgcagaagaaatgatgtctcacccaatttctttattatccactcgtattcttgaaaaagtagcaaagctttacatatacctgcaagaagcactcccccagttaattacagttattatgcacgtgtaaaacaattagcaatccatcataagcatgcacacaagcattatccatagaataatagaaaactattaaaaagtattcagtggctgaaaaaaatgaaaaagatactgatttaatcatttgagctcacagccaaagttcagacaagataaaaaatggagctacctcagaatcattccaaagctcgctatctcctattcagagttgatggttttccatatccaacttgttatgagaaatgtgagaaaataaagctctgttgagctgtattttatagtcaacggtagtgcagaaccaaatgttccaagcaaatgcacagaagatggctagaagggatgacatcgatgcaaacttctgatgagctgaaactatttcctgaatttgttgaacaagaaactaacccatgtagatagtcagaactcttcatcatcaacaatcaaaatcaataattgctagttcccaaaaacctcatgccctgcctgttctaggattggcaatatcgacgcccacgggtgccgtttcctccctggaggtgttgccttgtggactccctcccccctgggtgaaaaccagcccagtttttggacggacgtcgacagcggcttatgtcgttattcacctccttggagatttcatcttacggtcttgctcatccctcggcctccgacagttcgtagttgtcttgtctcaggctttttgtgtcttctgtgtaaggttttcgctggtttcactttagcaaaccgggcagttgtatgttttttgggcccggttttccttataaacagggtgaactctattcgtctaatatattcggcaatgctcttgccacttcaactcaaaaaaaaaactcatggccgttttgaatctatcgagcagtactcatcaaaaatcaaaatatgtgcagtcaaatttagcattacaaggaaacatatgttttcaattttgccttagatgaaaaaaaatgtaagtaataaaattagtggactacttggagatttttgaaattaccattggcgtattcaaaggcaattggagaccgctgaagtgaccagccgctgccaggttgtggcctctgcttctgctaagtaacggagtttcttcagaagtgacggatcaattctgcgctcattccaaaatactggcattggttatattctgcataaaatttcagaacaaactgaaagattgatttcaaatactacagactgaggatggttagtataaaaatttcagaacaaactgaaagattgatttcaaatactacagactgaggatggttagtataaaaatttcagaacatgaaccagttgctaatccacggctgaaagccaaccagcaaagtgagggttcaccctggaggaaagcagctgtgaatcattagttaccgtggtacaccctcaaaactgagtataacatattcccacgctacaaactggtatagttcagatagattattttcctgtgctctttcccatactattttcataagataagatccgtagattattttcaattttcttgagtctgaaatcattcattcagttaattaggccatgacttgactcgggttactaacaggtcaaagccccctgaataaatgaccattctaattctaaataacacaatggatctaaacctagggaactgatcacagatgaacgccaataatcatatatgtatgtactccaataagcaggaatataggatcactgatgcactgcaaactaatttttcttataaaaccaaatacatttatttgttccgaggatgtatattgtacctgcttggaatggactctataaactgaggaatgagacgagggcatggcctgacgaggcttcgcttgatcccgcagcaattccaacctcgacaaatgatctgaaattgagcaatgaaatgaaacctgagtatttgttgtagctggaaacattttaactggtaagaaaaaaagactgcttcatgagaaaattgaccattggttgcttagacaagttccctaccgagttcatggatgaactaaccgacaaccaaagcaagtggcacaaaatatccttatagagaaaaaaaaatctaattcacctatgcatttatttgcttcaatattaatgctaaaaccgatccatccagcgacaatttttgacaaactgatgaactgattttttttttaattgagactgtttgagataaaaattcattttagaaggagtattaattagcatgaccctgacctgttactctgacggtagaaaccattttcttgagggtgcaggtatctatcagttcagaactgctattacacgccatgggatcatattaacaatgcttacttataattgcagcaaaatcaagaaaataaggggaaaaaaattaattctgcatgtctgatgcttcacaagttcgatcatattgtccatatggaatatatgcccaggagtgatatgatatttcttcagatgtaacaatctacttgttctgaagctattatttgtgggggttatgtgggtgatcgcttaccttaatggacacatcatgcccaactaaatccatatttgggttttcaattcttgttgagaacacagtacgtacttgcactgatttaaagataaccctgtctcaagagagaggagatccagcaacagtgttatgcaacagtgtcattcagtctctacacaagcagctgtcctagtgttctcatttgtccatttagcataatttgtacaaacatggcaggcaaagacaaaatccccgatctctaattcccatgtttgaaatttaacacgcctaaaaggacaaaatccccgatctgaaaacatgtagatggatttgtagaaagagatggggaaattttagggtttggggggaagataacatgcagccggttgggttcgtcatgtggcgtcgtcagctgcactcaccctcagtcgccatgcgccaccgtgctcgccctcagccctcttgagttggagggcacctgcaaggcgggagaagaggctgcggagatagggggccggacggaggaggcggactactcacagaatggggtggcgccgaggagattggcttccggcggcgcgcgtgaaggcggtcgaggcgggagaagaggcggcggagatcgggggcggggcgtgcgtggaggcggtcgacgagccggagattgggtcgtagtgtgccttcatcagctgccagcctgccctcaccctcagccgccatgcgccggcgaggcgggagaagaggaggcgaagatttggtgcggggcggaggaggcggacgcgaaggaaacagagatgggagacggcgttgagagggagagaaaatcgggggaaaggggtgtgtgtgcgcgccgcgtgcgatcaacgatgcgtggggcgcgtgcggaagattgaattgtgatctgatctgttggattcaagaccacgaggaggcgacgcagggaggagggcgaaggacgcggcgtggggaaaggagtgggcgtggcgcgtgatgaggagaggagcgatgggaggagatttgacgccattggatatgaaaatcggatggttgagattagacgtgtttgttagatgcgtctgctatgtcaggaatcaagaccaccactacagattttttaagtagtagagatttattaaatttatcttgcagagacactcttttggcactttaaaatttcaatctctatagagacacttatagaaattttaatctaagctgattaactagataaaagtaacattgggctcatatgtaagagtgtaacatgaggttgagatggtaagaccattctagttaaaaatggtatattcaagatgccttgagttcaaagattggcagttgcaaggaaagtgatattgttttttttattatttttttacattggtttgatatggttctggtaggttaatgcctttagaaaatgcctatactcccttatagacataaaaaattcctatatgaatgtgctagaaagcatagagatattttctaaagtatctgtcacgcccagaaatttagcccaaaattttcagactattttgtgtattaaatctctatccgggaatcaagtcagggtacacaaaacgacaaattaatatacatatacaaacgaaaataaagcgtaaattatttacagacaaggcacttagtcctcacaccgaaaagaaagcagcagcaaccgaaaaatacgatcctagcggggcttcagctccaccccacatcaaaaactcaactgaggtataagccttggtcctctaacttcgtcttcagctcagaagcactacacttctgaaaagggagaataatagcaaggttgagtacaaccaccgtactcaacaagtcgcaccaatgatgtagacgtgcaatgggagtcaaggacggttttataaaggcggtttgtaaatattttgtagctggaaacagtaaaacaattggttaattaagacaagattatatatccactgaacaaggctacaccacgttgaacatgccaaccaaaccacctgaaccacatcagttcattatgtcaagttaattaatagagtgggactaatcacggtgaagctagttgattgcccataaccgcggacacggctattcgaataattttactttgatcaaaggtgtacaattgtacctacaagacatagccccacgacatgtttccgtgcgccgacatgtcagcaggatacaccggaaagagactgtgataagacccttcgcataaccccctttaaccaagtgtaccacacctcagatttcgcccccactcctcagcaggcagcgggcaaccctttcttgtgcctaggtgaatccggcagccgtataggccgtcacagggcccatccaaactccatcacgctcgcccttgcctggaaatttacactacaagcctagccgttgcccacgctagcttgtggtaagcacggtagttcttcgagggtttcccgcgaaccgatccttaattgccatgggtgcgactagcaaaaccatgcacccatagcccaccattaagccacattttagttggataattatgacaaaaaaaacatggccagatgtctcgagctcacagctcatcaagatgctaagtgtaaataatgtaattatcccattatgtgagctagtggtaattaagcatgactaagcatacataaatgattcttgcatacataattgaccatatttatcatttaaactacttactgtcgacattaatacgatgaaaaaaaaattagaaaaaacaaaatctaaaaatagccaaaaagggtacggtcagaaacggtaccccttatacggaagcagcgctcggttgattgggaatttccgtgactgttttcacccctacggtcagaccatcgggtcagtcggtctgacaaccgcaacacctgcggtctgaccggcggcacccagtcggtctgaccgctagggtcagccgaaaacaccaaattcacaaaatcaaccgtctattaaactccaaaatatcatcaacaaacaaccaatattttcatcacaaaatctaaattagctccttgattttacattttgcacgagtggatgttggtatttcttaacgacattactaaaaatataattcccagcaatggcgcataaatacttctggtatattatggttacagagttcatctgcaagcgcacggatataccattgtagcatttcacccgagagtattccaagtgtatcgtatttattttatcccctgggaagatcatacagagagaacttgagtaataatttattttacttatgataatcatattctaagcaggggttaaaataatccaagggtagagtgacacacaagcattaactactcattctcataatatatcatctaagctatgtggaaagaaaagataaagaaaatatattcttatacttctaatatacatagtatacat

SEQ ID NO: 41899 - DNA, 5286 bp, Oryza sativa
cacagatccactagaacacaggagtagggtattacgcttgctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcatctggcgcgccaggtaggggactctgcgtgtgtttttctaagctctcgcattctttcgtgtgcgccaagcttttcctgttcagcccaatggctgaacaagcaaaggcgcacaacctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccagagtctccagcccaacgttggctggacgacgtggccaacttggtcatgacggcacggcagcgcctagatgctggtgggcggtcctccgccaccaagacctctggtactgctaccaccggctccgcgtcgtcaagacggagggcgcggcgagcggcggccgctgttcgccattcggccgccactccttcgtcagcgcctccgacccgggaagatctgcgtggggggccggatgcctgcatcagtatcgagcgccggcgtaatggccgacgtgctgcccacgcaacggagggcgcctcctcgtccggagtgtcacctcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggacttgtgccaacagttcaccatgaactttcaaggcacatatccacgtccaggtgaggaagcggacttgcacgcagtacagcgaagggatgatgagtcacttcgctcatacattcagcggttctgtcaagtccgcaacaccataccatgcatccttgcacacgcggtgatctacgcgtttaggggggtgtgcggcacaaccgcatgctcgaaaagatcgcctccaaggagccccagactaccgcggagctttttcagctcgcggaccgagtggctcgtaaggaggagtcatggacctggaacccctccggttccggtgtggcagcttcggccgcccccggatccgctgctcggacagggcggcgtgacaggaggaggaagaaaaggtcagcccattccgacgacgagggtcatgtcctcgccgtcgagggtgcttcgcgggccacccgaaaggggaggcctgcgagcgacaaaaaggaggccagcgctcccagcagggagcgcccaaccggcaagtggtgcaccgtccacaacacctcccttcacgacctcgcggactgccgtgcagtcaaaagtttggctgagcggacgaggaagtgggaggaggagaggaggcaggagcgccgagagggcaagtccccggcggttccttccggcaatcggcgaagagaggccaaacagaaggcccccgccgaggacatcgatgacggcgatgatgacctgggtttccaagagcctggggccaccattgccactgtcgatgggggagcgtgtgctcacgtttctcgccggacctcaaggccatgaagcgagagcttctggccgcggcccctactcatgaggcgacgcgccgggcgcggtggtcggaggttgccctcaccttcgaccagaccgaccacccaccgtgcgttgcccggggaggacaggttgcaatggtggtttcccccactgtttgcaacgtgaagctggggcgtgtcctcattgatgggggagcagccctcaacatcctttcccccgcagcctttgacgccatcaaggccccggggatggtgctccggccgtcccaaccgattatcggtgtgacgccggggcacacttggccgctaggtcatatcgacctcccggtcaccttcggtggatccgccaacttccgcacggaacgggtaaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgccgccccgaggcagcggatagtcacgtgcgacgaggtcccggtcaaggaggttgccctgggcgacggcccgtccaagaccacacgaatcggtggtcttctggatggcaaataggaagacgcgctcgtctccttcctgcgggcaaacgctgacgtcttcgcatggagaccggcggatatgcccggggtccctagggaggtgattgagcaccgtctcgccgtgcggccgggcgcaaagccggtccggcagaaagtgcgccagcaggccccggaacgtcaagctttcatccgtgaggaggtggcgcgacttctggaggccggattcatccgcgaggtcatccatccggagtggctggcgaacctggtggtcgttcccaaggcgaacggcaagcttcggatgtgcatcgactacaccgaccttaacaaggcatgtcctaaggacccttacccccttcctcgcatagatcagattgtcgactccacagcggcgtgcgaccttttgtgttttctagatgcatactctggttaccatcagattcgcatggctagggaggatgaggaaaaaactgcgttcattacccccataggaacttattgttatacgacaatgtcattcgggttaaagaatgcaggtcctacttttcaacgtactactcgaatttctttgggtagccaaataggacgtaatgttgaggcttatgtcgatgacttggttgtgaagacccgcgaccgagaaactttactttcagatctggcggaaactttcgagagtctccgctctacctgcataaagctgaaccccgataagtgcgtgttcggtgtacctgcgggcaagcttctcgggttcttggtctctgcccgaggcattgaggccaaccccgagaagatacgagctatagaacggatgcgcccccccagcaagcttagggatgtgcaatgcgtcaccggttgcatggccgccctaagtcggttcatatcgaggctgggagagaaggcgctacccttatttaagctcctcaaacgctccgggccgtttacctggacggaggaagctgaacgtgccctcactcagttgaaggcgtatcttagctctcccccagttctggtcgccccggagccaggtgaacccttgctactctacttagcggtgaccccgcaggtagttagtgcggcgttagttgtggagcgcgatgaggacaaccctcattccgcgcatccccaccctgtgttggcttggcccgggagagagcagggaggagaggctcccgagccgaacggtggcccaaggcccccgacgaccggagctggccctctgcccgcttgtcagacggtgccaggtgcccccgacccccaggatggcccgggggccactgcgggaaagccgcacctatcgccctctgaccccgaggttaaccctgtgccgactcgacccgggagagagcagggagaagaggcccccgagccgaacggtggcctaaggctcccgatgaccggggttgaccctttgcccgcttgtccgacgacgccaggagcccccgacccccaggacggccctaaggccactgtgggaaggccgcacctgtcgtcctccgaccccgaggtcatcagcacagaagacaagtgcgccccgcgaggccgcttggacgaagagcgccccagggatgcggcccctggcgaagaggatcggccacaccgaaaggtgcagcggcccgtctactttgttagtgaggccctccgggacgccaagacccgataccctcaggcccagaagatgctttacactattctgatggcttcgaggaaactgcgccattatttccaggcgcatcgggtcacggtggttacgtcttaccccctcgcccaaatcttgcataatcgagagggtacaggacgggtggtgaaatggacaattgaactttctgagttcgatttgcactttgaaccacgtcacgctatcaagagccaggccctcgccgattttgtggcagagtggaccccggctcccgagcccgtctcagtccccgaggccagctcgggcccctcgcagctgccccacaccgcccactgggtgatgtagttcgacggctccctgtctcttcagggcgccggtgcgggggtcatattgacctcgccgagcggagacgtcctcagatacctggttcgccttgactttcgggcgaccaataatatggcagagtacgagggactccttgcgggacttagggtggcagctggactggggatccgccgcctcctggtgttaggcgactcccagctagtggttaaccaggtctgtaaggaataccggtgctctgacccgcagatggatgcttacgtacgccaagtacggcgtatggagcgccatttcgacgggatagagcttcggcacgtgcccagacgggataacacgattgccgatgaactctcacggctcgcttcctcgcgagcccagaccccaccgggcgcctttgaagaaaggcttgcccagccgtcggcgcgacctgaccccttaggggagacggacgcacctgaccggcccccgaggcccgtcggagtccaggcctcgggacccgaggggagcgctcccagctcccttagattgattgcttggatcgttgagatccaagcatacctcacagataagactctacccgaggaccgcgaaggaagtgaacgcgtccagcgcatctc

SEQ ID NO: 41900 - DNA, 1380 bp, Oryza sativa
tagccggcccaggcactgcagatcataccactttcatggccgtttgctgtctgggggctcgatatcttgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggggtgcctaaccgtattattacggataacggcacccaattcactagtgagcttttcggtgactactgcgaagacatgggcattaaactctgcttcgcctcacccgcccaccccagaagcaatggccaagtggagcgcgccaatgcggaaatcctcaaaggccttaaaaccaagaccttcaacatcctcaagaagcacggcgattcgtggatcgaggagttgccagcagtgctctgggcaaaccgaaccacaccaagccgagcaaccggggaaacgcctttcttcctcgtctacggcgcggaggcggttctcccatccgagctcaccctgaagtcccctcggaccaccatgtactgtgaggctgatcaagatcagcttcgcagagatgacctcgactacttggaagagcgaaggcggcgcgcggccctccgagccgcacgctcccagcagagcctgcggcgctaccatcagcgccacgtccgggcacgatcactctgcgtcgacgacctcgtcctacgccgcgtccaaacgcgtgctggattgagcaagctctcaccaatatgggagggtccgtatcgtgtgatcggcgtcccccggccgggctccgttcggctggccacaggcgacggcacagagctgcctaacccgtggaacatcgaacaccttcgtcgcttctacccctaatggagtttgggtgtcaggtttcgggctcgggccaaccccgcacccccttcaagcgtgcagggttggccgggggctaccacatatgcatattttttcttctatctgtatttcaataaaagcattttcgatttcctaaaggctgtatctgtgctgttgtttccctttgaaaaatcttgacttgaaataggtcacttgtgctcaatcctgccctcgggggctcgggtcggctaaaatcgccaaaaggggcccagaaccgagccgtgccccggggcgtggtgaactccgggggggaatcggcaaaaacccacaatcgggtcacccataaccctcggtcaccacgctcccggcctggccagtctcgacacgtggatctcccaggcactagccccgacccgcgccttttgaggactgggacctgggcatgagcccttaatcaagtgaagacataaaaggaccacggcacagatcatcctcatctcatac

SEQ ID NO: 41901 - DNA, 770 bp, Oryza sativa
aacatgggcaagtatcacctagccaagtggcgacaagatacacgaagcgtgcattttttttcatttttttaaaaagtatattcttgcaaaatcgtgctatgaaagttaaaatgctatacaatcggctgtccatattgtatagcataatctctataagtttcctgaacatctgggaatcatttgaaccctcttcgcttgctgaaccccacgtagcccatatgagacttttgggcaatcagtatgaccagagaagtacgatcatttaatctttaacctactatttatattttttaaaaaagagcacatagacattgattaactatcatgtgtcaagaccccaatataagaccccaatattgtaggcctgaatttaagggatccagatcctcgctacagagggacgtccggcgcagctgcatcgttcgttccgcatcggacgaacgcgcggagtgaggcggccaaacgggctcgcactcgggccaagtcaatgaaataggatgggccgtttgagcagaaggctcgtttccttggccagaaaaatcggcgccgctcccaagtcctccaggacatcagccggcggccgctcgtcgtctcctccggctcaggcgctattggagcggatcccggacaaagcccctcccctcgtcgccgccctcctccccatccctcgccccctcgcgccgcgcgagagccctgcttcatccgggagatctgcctcgtccaggtctgtcttgacgacgatggcttccacggcggcgcccttcaccacc

SEQ ID NO: 41902 - DNA, 732 bp, Oryza sativa
ttcagcaactgctccaccaaaacaaacatcaatgcgggccaagattttttgtttgctaattgaagtatttcctggtgaagcgacttgtgtgaccattccaagagaaagaccatgtggaagtacagttgcttggtgtatgggatgagcaccctgagtgtggagtgcaacaatagcatgcccactttcatggtatgcgataagctaagaaaaaaaaataattagtgaaatggaattcacattctgttccaaagattggtaggtcaatgtatctgtttgagctagtagaattgtttgcttgctctaaaggaaaaggttagaggacatgcctttctggattcactcgatagtaacaatggcctcttgtgatttcccatgatgtgacatttggcaaactccttatgtgcggtgtcctgtccttcagcaccttctattgcagccttaattgctgcaatgatcacgagatttgctaaacggagtgaaataaagcacaggtagaatattggtgataacatcataaccatttgcagtacctttgaaaggttacaacattaatgtatctgtcaaaaatggaaattctgtggaacaactatactcaaataaaggctataactatgtaggaataacaaaagggaacaaataggaaaacatgactgatgaaaaaagttgttcggtctctataaaatctctgaagtcatcacttgattggttcatgcttccaaaaggggatgctat

SEQ ID NO: 41903 - DNA, 4776 bp, Oryza sativa
tggtcaagcgaagtcatgaaatagtagaattgtagttggaaagacatgtcgtatgagctgtgctaatttatggacatggctttaatatgacaagttggtggtggtgttttagcattacattacaactaattagcacatgctgcagtcattgtactctctgttcttgttggattccaacattgggtataagaatttgaactagtcactatttgacagtaaaatgcactcgataggttgcattttggagacatgccacacgtgtacatcttgacgcctaaaaattactcttcatctgtctgcctagcatttgattttgaaggtatagataaatctaggatctgccacaggatgtctgcctaacatttgattttgaaggtataaataaatctacgttctatgccacaggaagggaaggaatgtcattgcttacagattcttccactgcatgtgtctcccatccatccttcaggcttctaaggaccacgtattccattcccatctgatgaggggctgatgcttcaatgccattctcgttctgaattcacctcaccatggaacattcaccgactactttttccttcaaatcatctctcttgttgctttttcattcaaatcaatctctcttgttcccttgttgtatcagcatgggactatttttttccttcaaatcaccttttccttattggatcagcatcgcgaatccaacctcaagttgtagctcgcgttaaccatgccctgcgaaagctgaactttctgatgaattcagagtttcagacgacccagctgcatcctggtaagtgttcagagctcttcccgcctccggcttccccacctcctccgccgccgccgccgctgccgccgcagcctcgcagcaatctctcgtagttccagccgccgccgtcgggctgcagcgctctgagctccctcgccgcgacgctcccgatagagcagttcttgtgagccaggcagcagtgcaggagcgtcgtccacgccagcgcgctgggcgcgaacggcatgccgaggagcaggccgtgcgcgtcccgcagccgccccgcgcggccgaggagatcgatggcgccgacgtagtgctcgaacgcgcgctccaccccgtactcgacctccatggcgtcgaagtaggccatcccctcggcgaccagctcggcgtggctgcacgacgccaggatggcgacgaaggtgctgccgttgtagagccccagcgccagcgcgcgctccgcgaacgccagcgctcgcctcccgcggccgttctggccgagcccctgtatcgcggtgttccacgacacgacgtcgcgcgccgccatctcgtcgaacaccttctccagatcggctgtcgagccggagcagctgtacatgttcatcagggagttgccgacgaagacatggctgcgcgagaggccgctcttgacggcgcgcgcgtggacttgcctccccagggtgagcagggacagcaccgagcagatgtgcaggaccgtcgtgtagattgatgcgtccggcttagcgccgccattgtcgcgatcacccaacctcagcagatcgatgaagaggcggagcgcgtcttctcctcggcggttctgccacaaacaggatatgatgacgttccatgtgaaggcgtccttgttcttcatcgatctgaagagatatagagccttgtcgatgagcttgtgccgcgagtatccatccatcatgatggtccaagaacttgcatccttgaagcgaatcccgtcgaacaccttctcggcgtcacacaacgcgccgaccttggcgtgcacgtcgatcaaaccgttccacacaaaggtgttatctgtattctcctcctccaggagcttgagtgccagggcatggagctgcgttgccatggcgagcgactggagagccacgcaggccttgagcaacgagctgagcgtgtgcgcgttgggcagcaccccgcgttcgtagagctcgccgtagagcgccgcgaacagctggaccgcctcgcggggctccccgttccggacatggcaggacaccatggccgtccaggtgaacacgttgtgctttcccagcggcaggtcgtcgaagaggcggcgcgccacggaggccgccccggcgcgggagaggcccccgatcatggtggcgtacgaggcggcgttcttcccgggcatctcgtggaaaaacgagagcgcccgctctatgcgccctgcgccgacgagcatgcccagcgccttattccaggcgacctggttcttcgggggcattccgtcgaacaggtcgagggcctcgttgtccgcctgcccggatttccccgcccccaccaagatctctggggttttcagggccaaacggtacagcgacggaagctcgtgggccgccttggcgatcggccgcgccgccatactccgccgccgccgccgccgacgaggcgctcctgcgtgttggccactcctgctggccgaggggatgaagatttgagaggtatcatcggcgatggggactggggaaacgacattgatatgtgttattttacatatgaacccttcgagttatcatattttacacatgcgagagtatcctgtttcatgggattattgttacagattacttgctggacgtttataaaatacgttatctcaaaagaaaaaaaaaaatcctctactcactccgtttcgtactaagtttttatttttgaccccgcccttttgttccgaaataagtccattttagagtaatcattatatcagagtttgtgaaagtaagaaataaatgtattgagagtagataaaataaaaaatgattgtattgaaatttgatagtgtggatattctagatttggttttgtattgttatgtgtgggatcggtgaaaaatgaatttgttttggaacgggggtagtacctaattgcttaaattacttgttctaggctatttattaaatttatttaacaaaatatttaattaattcataaattcacagcaataatgtatctatagatcctacatccatgtgtaaaccctaaattacaagactactgggctattaccactattccattgacatcgtgtcaaaaaaaagcatatcatattattggaatgatcagtaggagtatttagtactccctccgtcccaaaaaatagaattttagagttggacacggctatcaagaacgtaagtagaattaaatagaaatgtattggaatggtcagttacaagtatttagtactccctccgtcccaaaaaatagaattttagagttggacaattttagagtttcaccattcacaacataggtagaattaaatagaaatgagttgtgattggttaagaagtgtaggtaggtaggaaaagtgaatggtgaagggttgtgattggttgggaaggaaatgttagaggagaagttgttatattttaacacaaatcctaagtgctaaaagttattatattttgggacaaagtagctgttttatttggccacgaggatcttttggcaaggtgtatctccctccgtttcttaatatttgacaccgttatctttttaaaatatgtttgaccattcgtcttattaaaaaaataattattaattattttcctaccatttgattcattgttaaatatactttcatgtatacatatagttttacatatttcacaaaattttttgaataagacgaatgatcaaacatgtggtaaaaaatcaacagtgtcaaacatttagaaacggagggagtagaaaagtgtgacaattaaattttggcccttgtgatacggttagttaaataaaatgagttctttgtgaatccaatgtacaaaaaggtgagataaatttgtgtagcagtgaagcaaatgactatctaacaaactatgcgtgacagaataaggcaacaaacaaaaaacacctcatcgttttgcttacgctgatacggcttatcagtagaaaaaaaattacgataaaccttttatatgttcttaacaattttaaataaaatattggaaaacagaccacaataaagacctttaaaatcaacttaaaattaaaatttaaattttaaattttggttagggcttataagttaggcacaacaatcaatacccttattgatagacgttggttgaacttttttttttttttggtgctacggtagaatgacccttaccaaagttgggtggcattttcctttcttttttttccctacccttttcggctttgatggccaagcacagcttcctctctccaggtctccatgctttacagaatacttgcatcaaccggctatcagtatatcacaatgcaattttcatttacattcaaaatctttaacacgaagtcacgaacacagttggatataaagtattcctgatggaacccacgaacaacttgatttctctccaatcaggcttcaacaaaaatagaaaatacaaaagcttaaaagccttaaagagaaccatttcatctgtgactacaaggccgcacagatgataaggttttaggaaaatacataacatacagcaacaggagacaacactggtattgtgttgctgcctggttttgcatgcagcatctcaccacaatccagttcagtagtattcatctcaccacaatccacttcagtagtattccttctcaccacaatccacttcagtagtattcgttaccagcgctgtccgaaaccatgtccattgaggtgtcattggagcctccagagttggtctccctattctgtcctgcagagtttgtttctgcattccggcctccattaccagatccttgggttaaatgatagctct

SEQ ID NO: 41904 - DNA, 955 bp, Oryza sativa
taataataataataataataataataataataataataataataataataataataataataataataataatataataataataacatgacgcggaggcggaagccaaggaaccaatcgaattcccgacgaccgaaccgcgagaggtggagggggagatggggggaaagggagggagggagggaggtgtacggacgagggagtggcgctcgccggcctggaaggagagcttctgctgggccatggcctgggtgtagagctgggagagggagttggcggcgccgcagaaggtggagtagagcgtccggtcggcctcgtccagccgcggcgccgcgtccgtcttcctcttccgggccatcgccgccgccgccgccggagatcgtgggggaggagggaaggcggcggatggcggaggagcagggtttgctgctgcgatttttttttctcctcctctcttgtgatttttttccccctcgtcttctctcttctctctctaattttccacgggtgggtgtatacgaggggtgcgtgcccttttcaaatgaatcgtgtggcgtttttggctgttttttggtcaaattcgggaggagttttggggtttttttttttttggctttttgggattgggtttggtgtggaggaggtggtgagtcacgtgacacactgacgcgtgatgatggtgtggaggggggcagcagtagagatggtaccccatgacccaagacctgatgagcttttacactattatgagtcacatatagagatggtaatagggccctgtttaccttttcccgcggtgaattcacctattaggtgtgacgggaatggttaatatgtattcaccatggagaatgaaatggttacaaacctctcaccatcaaggatgacgggggctgggacggtgaactattccccgtcctcacccccacggtgactcgactttactgcatatagt

SEQ ID NO: 41905 - DNA, 1281 bp, Oryza sativa
tccataggacacgtacactcatgaattcatggtacggtctacacaatattggattttttttaatctcattagcattgtcttagatcgcagaattggatacacaaatggacctcatatataacaattaattaatagttttatctagcactttggatgatattgagacgtataggtgtatctctagtgccagaggtaattaattaacaatggaatatctatacctcacaataccttgtatggactaaggattggaaatggtcatctaataaaaataatgagagcagaacattacagtgacagccaaagcaagtgatacactcacatacgtgaacaaaaaaaaatactattgaaagcaacaaactaatatcctaaaatgctagtatgcaactgcaaacatagaaccttattttcatttagaaccataaaaaatgataagtatttgacagcatattgggttcaatatatccaagcgagaaagaaggctaattagtgtttatttatgtcatacttttgagaatctattttagccgaagtatagaattaagttcctgaaaatagaaccctacctgctcaatcaagacaggattatctcttgtgcggttaaagacataattccgtagcctgtccaattcatcgcgtaccgcaaagatcccatagacactaatggggtatgattcgttactggataacttcaaagagaagatttggagcgtatcatttggctcattcatcccaatagttgatgcagctgcaaatatgtactctcaagaaattaatagcacgtataagaaaagaaaagttgcaagagtgtactctctccgttacataatataagactttctaacatctatatgtatgtggacaacgctagaaagtcttacattgtaaaacgaaggaagtacatattggtagcaaagaagataaattgatcaaataattatcaatgaatcctctaaacagttggaatataattgaccaacacttactctcagaagtagtgaaggtcaggtattcgtgatgatcacagtaaatgctttttttgatgcagtgatatgatgtcttgggaaacagcctcaaaggatatcgtagaagttgagcataatcatatcccgacgctacaaactctttatatgcctccgtgtgttctgcattcctcctgatgtatgttgctagccacttgcgacttatttcctttggagtgaatttcagaaaaccctatgttttgaggctaatgtaacacataaccacaggttttgtttattttctcacataaccccgtgc

SEQ ID NO: 41906 - DNA, 937 bp, Oryza sativa
ccttgcttgttacgtgtgcaattaagtataaataaagtagctagatgcattattatcgatccacattatccacttgggtagtaaggctacttctcagttctcacaagtgtactacatgcgactatgtgagaatctctgaatattattgtccctttccctctagtcaaacccttgttttacaatttattcttacaatttgtgttcagaatactaatttaatagggctaccataatatgtacttttagcacttttttcctttaaaagtacaatagtatatatcgatatatacgaccatatcagttgacaagttatttttgctcttttaaaatacaataagatgttctattatacaatcatacgggttaacggatcttttccctttatttgcaggcaagacattcgaaacccgtgacccgcgcaccggcgaggtcatcgccaagatcgccgaaggagacaaggccgacatcgacctcgccgtgaaggccgccagggaggccttcgaccatggcccctggccaagaatgtccggctttgtaagcgcgcctctctccaccatcgcccgaaacccgtaaacgggttggatccaaacccgttagttaataataccaggcggcccatctagttataccgcactaattgggcctaattaagcccagcttaactttgaatttttggcgccaattaatggctgcaggcgaggggaaggatcctgcacaagttcgcggacctggtggagcagcacgtggaggagctggcggcgctggacacggtggacgccggcaagctgttcgcgatggggaagctcgtcgacatccccggcggcgcgaacctgctccggtactacgccggcgcggcggacaaggtgcacggcgagacgctcaagatggcgcggccatgccacgggtacacgctcaaggagcccgtcggcgtcgtcgg

SEQ ID NO: 41907 - DNA, 1933 bp, Oryza sativa
aagcaactgtgctactcccaatgcttcccatgctgactagctaggcagttcactgtgtgtagagtttccaacagccctacagattacaaacgtgcactcacctgttccattttcagagcctgtctcaactctcttttatggaccagaaaggatatttgtgatgatcctctatggtgtccgggataggtaaatgggaaatagataaaagaagaaccaatttagggataatttgtaatgtagttcaatgtgcaccagcctactattgaatgtttgattaacttttaaaaaattcagatgtaagatggtgaggccttccagttgccttatgggatcaggattattcaattgagcattaaaaaggttgcgatgaaattaggtgagagaacactgattaatatagggatgtttcgtgtcgtcaagaattcgtggatgactatatctgacagaaattcagaagctatgaaaattgctgttaccaataggaacaaaaacatgcgagctcagctctcaaaacatgccagattcaaaatcctatccaaattataaaaacctgtgaaatacgactataattgatcaagatgctgcaatcggttaagaacactggcattccatttgcaaccatgtttaagccaatgcaactattgaatcaagatctccaattcaaaatcgaggtaacatcctgcacaacattgtcaatcaactaccagttctaccactgttcctcataggcaaaatgttggtcattgcaagaacctaaatcagctacctagtaagacataatttgccacatgctcacatgagatcacatactcaacatccgtactcaattgacccagccaattcatcacttcaaatttgaggtcttcaatttagcaaccatgcattttggtagaatcaaagcttgaccaaactagcacaagagttcccgatgcctcctaggcctaccacagacaaaaccacaggagctagcaaactccatgggctaattgtttttttaactttcattgcttgcaggttgcagcagttgtgtgattcttcaccctgcatgcccttttatggaccaaaacagatcatcacgcatatcacacaaggatgaataatgtactatttgattccgtgcagttattcagttgatcaccttttctgtcacatgtgccagcaaaaatatatagttcacccccatgttgaataatatatagttcatcatcgcttcgcttccattgaacttctccatcgtgtgccatcgatgccatggatctgagatcgatcgcgccaacagctagcgttgaactgaaaggaccagccatcacaataatgcctctgctactcgtgcagcgtcgctgcgtacgtaggcgaaagaaaaatctgttgtttttggttagaaggctttgtaaactctggctttcagaaacagagtacagaatgttatgtgcgcagttaagtaaaatccagaaaatcactgatgcagcaattcgttgagaaatttctcagtagttgcctcatacgagttaaacactgcaattcttgaataaactgtctgttttacacatcgagctcatgcgctttcagtttatgacacacaactacacaagtcaactaccagttctctgcataatccagtacatttttgcagtgttcttgtcgagaagatgacctctgacagcaggccagcgccacttagcattctgggcttatattccagccatagctagtatttggttcagtgtatatactccaatcatggagctattgtcattgcaaacacttgaaagtaagtctccatttgatcaaagctatgactaaatgaattatcatgattgagacagggcaagtagaacatagatagatctagagatcaaatctagctagtagcaacgctgaacatatctactagattagccaaacaaatggagtggtcatcacacctcgacaa

SEQ ID NO: 41908 - DNA, 2043 bp, Oryza sativa
agaactacaagagagagctgctgttcttctctgtccctctatgcttgtaatgacttgatccactacctcaacctctagtcgtgagtggagagctcccggtgcctcctaggcctacttccatgtgaaccagcactgtttgattccatgcacttatacttactgtatgaaagcttcatgatgcatgtactaattaattaattaatgctgtgatcgatgtttagtttttttcctttcacgttgcatcttgcatgttttcggcgaaaatacaattcactatgctgaactcaccgcacatgtgtattgacaattgcaagggatggccgtcgtcattgtaaacgcttccctaaaactgctcttccatctctttctgtgtctttctttttaagatgttggaacaattgtagatcgcaactcgtttaatttctttttcatctctttaggcatataattccttttaaaagaatagataataataggtttggcactttcaaaagctccttagtgagacggctaacctagacagttaacgttagcactccctggtgtagtcttggatgtgtgggtctcggtggtgggagggcgggggtcctcctactttgtaaatattttgttctttgttttttcttccccttgaaatgaaacgcagttctcctgcattttttagaaaaaaaaaagaataggtaaatgggtgactgtgtgaaagctttacaaagtcgaaaggcacattattttttttgtgctaaagtttgccggcctaagaagaaaaaggtagatcattacaaaatgctccacacactaaatggtgggcaatgccagatttcttccaccaacttgcaaattctttggctatgccataaacttaattaatgtaatttgtccatggaaagatttcagaccaaacttctgccgcatatatacatgcatcgaagctgaaggtccatagctacatgcatgtttggctgactaccaagcttgtgaaaccttcttatgtggtcatcttcctcaacttgattcgttggttggtgtcaacatagaggacaaaaaaattagaagttatccaggagagagctagcctatatctgcatcagcgtagcattatttgtttccagcctatctacaagttggaaggagaacatgatactgaaagttcatgtaacatgacaattctcgatgccttccaaacctagataagtattttggcttttgtgtatgggcatccatatgcatatatggacatgaagtcaccacgattcactatcactctcatgtttcaggcttagagttttctcatctctcatatatatggtccaaaaagatattgtatatatggttaaacattgtcaccttattaattcactacatgcaactatattaaattgggaacctagctagctacagggttgccagctgaaagtgagctgtgtaggttcagagtattctttaacttcaatccttctaatttttggcccaactgtgtttccttttcattaccctccttccattttgtttgaatgcgggaagtcacctgcttagagagaataaacttgctgttgggctgattttgccccaattactagtttggcccagctcaaaacaagaatgtaccccatccgttccatgaaaaacccaatcctacaactataaatctagataaatgtgtatccaggtttgtagctaggattgtttttttttaacagagtagtaaactctgttatgcttatcaatttgatattggagttgttgttttaacatctttctaaaatttgaatactatttattcttgtccaaagtttctaagtataaataaagttttcattcccgatgaacgtttgttagcataaagttatacaatttagaatttttgtggtagaaagttttttattcctttagaaaattgctagttaaactgcttttttactatcgtataaagtttctgaacatatattttttatttttgtagaaagtttatgagtaaaattctatttattatttgaatagactttggattgaaatggaagtttcataatgtagtaaaaaaaggtt

SEQ ID NO: 41909 - DNA, 10841 bp, Oryza sativa
gcatggagaatcctcttgtgggtacgtcttcgtgccacatgtgacaatatgccaatagagtggagtaatattaacccactctttctagtgttaatttatacaaggcactacatgatacactagctagtacaaagaatgttaatttctagtgttcaaagaatgttctttcacttctgaggtgtggaacaaaatctgcacttggaaggggttaggtcaaaactacctacctaacaatttggatttaaaaaattggtggagcgctctctcagccattcaaccgaagcccttgcaaaaaagaattttaggttgtctgataacctcctggtggaacatttagttggagcggaataggcgtattttccaaaaaaactcccacaacggttgatagggtggctaccctaattcttcaagacattgatcaaagacttttggctttccaacccccttgatgctgcccttgtttttttcccttttgctccattttttgttattgtgttttttgtgttttcttgtctgtaaataacttttatttcgtctaatatattccggcagtccttctgccgccgtttccctaaaaaaaaagatacactagctagtatgaatatgttatgtattataatttgatatctcatgacagtatgacattggcctccttagggatccgcaggtagcaaacttgatcaatccaccaatcttagggaacagatccttatatatcatgcagccatggtgcaaacttgtatcggggggtgccgatatactgaaattttgaacaaaacttggtcaaatttgaacaaaatattgccaaattcaaaaaaatgaataacaaattaaaaattcctgccgaaataatatcatgggggggggggtccgatagaaccgaaatttcggaaatttctttccaaaattttgaaccatggttatgtggatcagatcaacaatcgccatcgacaataaagccacagctgatcaacaaaatttgtttttgtttttgtttttttttcaccggactgacggtgaagaaaaggcccaaaaaattttattaagattaagaggagatgttgcatctaaatatgtggcatccccaaatgttatcgtgacaacactccaatcttgggcaatacaatggttctgttctctacgatgcagcctcctccatcgagcaaccacacacacttgtcactcataacacttcatccatcatctttggatgaggctgttgttcgattcaacttctgtcgagcactagtttggagggacatcacgtcggcttctccatcattctgcttccgagagggaaaggtgctcaaatatatcgaactattcgctacgacatgcaatagctaggacactgtagtagttcatcaggcaatgtttaatatgttcaggtagctagcgaccatgctccatatgttttgtgaaatcgtaggttgcccaatcaaactcaatgtctcctggtgcctccaaggcctatagcagcctccatgaacagacctagctatctctcattgcttgcactacttgtgcttatccatcaccagctcttttatagagcaaaacgagatcagtacatatatatcacacaaatacacaaggatgtacaccagaggcatgtgctcatgtacagatgttcagttaaccaacttttttccttcttttttttgaaataataaaataacacctacaaggcatgtattgatgtacacactttcagttagcaaactttttttcttcttcttgtcttttttggaaaaaaaatggcaaggatggacttagcattcattattgataaaaaataaatgatggggggaacataacgatcactcttgtcaatagcatactcttaacaactctcttccaaccaacctatgcatccttctcaaccacttttttttctgaagttgcagatcaaatatttcagttgatccaaaaaaagttgagcgatcaaatattttagttgatcaattggtgaaacattaagttatacatggtgaaataaaaaaaatagtaattaaaacatttaaaaattttgtggaatacaacaagaacacacattgaaatatattgctatcacttatgaaacaatgagttttagcgggttgaatcatttgtttttcttcatcaaaatataattatgtgatagcttgttgtaaaaaatgaattacaacaaatacaatgttgcgtttggatcgtagattggataaatagtttaggagaaaaattattttgaagatcattacatgcatgcgtgcatgcatggagtggagagagagtaattagtatggtaggaaaaagaataagagcaggtagttgcctaaattttatgaaatataatgaaaatgcacactgaatcgtatgatatcttatcataaatatttaattacaacgaatacgatggtgtaatcagatattatatcatataagcagtttagaaaaaaatactttaaagattgataaatgtatgtatggatgaagtaatgtagggagagcagtattgcagatactgcaatactatttttcttccatcggtagacccatgtgaagcggtgtccggcccaatcacttgatgtggcagatagatgcaactatttgacaccttacaaatggcaccttgtcaggccaatgtcaaaactctagtttctcccaatgtcctgagattcatacctgacaaatttatttgggaatacgcagaaaacttgttcatcattgtatcaagatggaatgggtctatagtacaaaacacaaaatgaaaagagcaacaacgaaactagaccctggtaaactgaacacgcacaaagtcagaaatgatcggccaaaattgactggttctttctgttcatgaagtgtactttaataagtgaaagaaaatcagtgatctcggatacaaggtttttatatactctgtctttcaggaacagagtacagactgttacgtgtgtgtgcagttaagaaaattcagaaattcacccagatgcattaatccattgaggaaattctcattagttaccagatatacgagttaaacactacaattctttgaaaccggctgtattacacatcgagctggtgtgctttcagttcatgacacaaatcaactgccagctctctgcgtaatccagtacatgcttgcgacaagatgaccttttccagaaggccagcactgctgagcatcctaggcctatattctggcaatatcttgttaggatataatatttgattcgatgtaattaattattcagtatgtatgtgccgatccattgtgcaattgtcactgcttagagttgtatgtagctcaccattcgattaaagctatgatttaataatcagctgatcagttcatttcaatttatggttgaaacaagggaagtaaaatttggctgcaatttcaaatatatatctccaagattaggcaaccaaatggagtgtttgtcacaccaccaggagaaagtcagggaccagtttagtataaatcgccaagattcagacgtaagatgtacatcagagatagtccgtttctttagttttgaagtatatgcaagtttaacgaacgttgtatttagcgattcaaaactatatatccactttggtatttacattcctgtacacacaacaaaatgaaccattaggatgagagcgaaatgctagttcaaatttatgctcgcttagctatgtactaagagaactaccaagctccagttcatgaatatgaatcatgtccatgattacggaaaatcctcttttccaatcaatggctcaacaaggtctcatccttgggcctcatgattatacatcatatcgctttgtcctacagacaattcccatgcatctttatcaggtaagagtatgatgctggtgttctgcccccctcaatgctctaccgaaaacacgacccactgtctcagcatccacacatattaggaaagctcccggtgcctcctaggcctagctaccatgggcaagcgacagttcacaagacactggagccagtttcacttctatgcgaagttgtgaactaacactcattatggacgactctgtcccttttcagctcatagctcttggttcctcttttataagccaaacgaggcctttatgtgcatataaggaccagtgagtgaatggtgaggcctttgtgtacataacccaaaaaaaaattatgtagatttctgcattttggtttctagaaaactgcagtagtgataatcaattaaatcacagcagcacatacataaaaccaaaacgtcattctttctggtagtgacagtaagcttggaacagtggattcatatgtacttggtactccctctgttccataatataaggcacaactacttttctttgatgttccataatataaggcatgcatgcatgcatacaattaactaggacatcttctccattgaattattattttttaaatcccccactctcaagatctctaattctattagatgcatgcattatatttattaggatggtccaaactaggagatgataataattgtttcttggtctttgtgttaagggtggttgtgccttatattttggaatggaggatgtaacacataaacgacgcatccaagaaagagtgtccatgctgctctgaaaatacaaggaattccatctgcgtagctactctcgttactctcatgtgttattttcaatgggtcatggacgatgtagactcagcaaagacagggatagtcgaactcccaatgcatcccatcctgaccatgggaattgtttcaataggatcagtgagcagagtttccaacatccatgcagattatagacatgcactcaccagttttaccgtgtctctctctctctctctctctctcactcatcagttaacagtgctagctctcatgccattcatatatggaggatgagaagtgttctctatatctacacaaggtcacaaaatgcacaattattcaagggagcatcaggtgctacagtatcaccatgctaccatgtggcaccatatatttgatgagtgagggagagacagtaaaactggtgatcatttttgtataaatcgccaaaattcagacgtaacatgtacatcagggatagtacgtatcttcagttttgaagtgtatccaatttcaacaaaatttggagttaggaattgaaatctaaatatctatgttggttttagtattctttgtactcacaagtcacaacagatgaaccattaggaagagcgaaatgctatattcaaatttacagtcgcccaatgtaccgagacaaagcctatgcttcagtaccacaatatgaacaagtccatatatcagtactgaatatcacctagtccatcatcagctcagcaaggcctttgtcctgaagagaattcccatgcatttgtatcctgctgaacatctacaagattcagatgctggtcttctgtccccctcagtgctctattcaaaacttgatccactatatctctgagtccacacatatcaggaaagctcccggtgtctcctaggcctagctaccatggataagcgatagctgacaagtcactggagctactattacactgttacttccattcgagcattagctgacaagtctctgcttctcatctcttgtgatttttcttttataggccaatgaaggtctaacaatttccgttgcattttgaggcgttcatgctttagcttgactagaattttcctgccaatatatatggttttgcattgcatcttgactccacacaactcgcgaccacatggaatgcacttgctcatcaccgcggagctttcttctgttcaccatgtcaccatggctagatgcattcagttttaaattgggagaccggaactgcgtataaatcaaaatattaggcgaaatttatttgaacatttctggccaactcaacctaaccagtagactgtgatctagaggtgcttgtggacattcagttggcagtaaccataccaaatttaattaaatggcatcatatttggacgctttgacacttcatccatcatttttggacaagagctaaatgtgtttcaagtaacatctgtcaagcactggtttgatggcttcatcacatcagctgcgacatcttagagggaactgtttgaactgcatgtaggacacagttaatgctcaagaccttttggtaaattcagggtagcccaatctaacacaagggctcctggtgcctcctagtcctaccacagcaaaagtcagaggagcagcctccatgaacagaactagctatcacccagtgtttgctctacttgtgcttattcatcacaagctattttatagagaggaaagagatcaacatatatatcacacaactacacaaggatgtacttctatttgattacaagttgttagttattcagtgcctatgagaggcatactcatgtatagatgttcagttaagcagttaaccacctttttccttctttttttttcgaaacgaaaatatagcacctacaaggcatgtattcatgtaaattgttcagttagccactttttttcttcaattcttggaatgatgaatcaaaatggactggtcggttgatttgacagttctctgttcatgattcttttttcttttttgcttgaacacatggacatgcaggagtgttcagcttccttggtcacatgaagtgtactctagcaaatgaaataaatcatctgcttgtcttggttccaaggttttacatactctgccttccaaaaaacagagtacagacctcaacgccttgtggcgaacgtcatctcgtcgacgacacataacatgaacacagttcacacataatttatttttaatcactaataaatgttgataaaagggaagtccatattcggtgaataagcagacatatgcagttgtcagagaagacagatggaggcgagatgagatcggactatcctatcatatcaagtcgccactagaccacaaaggagctggttttcccagtacgtactgcactctggggtaactcctcatgatgtttcccttgggttccatggcttataccgagcactccaaaattcgtaaaactctcattgaaaatacagcacttgtgataacgtaactctcgatgcctcccaaccctacatagccacaaaacgaagtaaatgcattttcagtttggtggtatctaaatgattctgaactcactgctatatatcggcatgtttgtcttagcctctaatatctttcatgggccaaaagagattgtatatgatatgcatctgaaatcgaaatgtactacatgtattaactcagcagcagatgcagtcatgtcagattgggcacttcatctgttggggcctatccccactacttcctttgtaagacgttttggggttcaaatagattcatgtatggatccatttgtatgcttcatatatgtgtctaaattcatatggatattaatgtatctagatgacggatggagatgtccaaatgtcttataatgtagaacatagggagtatatatgtttattgaaaaattaccgatctcactataaattaaactgcccatgctgttgtagataaatttcagttcgacccaatgaaattaggtgacagtgttgaacataaccgacaaatttcagtacagttatgaatttaatatcctaggagtcttccggttagattcacaaggtggtggactagctagcctcggttcgaagcatcatcctttctaattttttgatattaggtcgttctctaatatttgtgtttttttagagtgttattttcttagatatgggataacgtaactaaaattccagcttatgcatgatgtgatattttttttatagaaaccgttatacggctaatcaataaaaccacagcagcaacagttattactagcacattacaacagcggagaaactcctggtaacttcaaaatgatccaaagaggatgagtatggtgatgaaaaacaaacttgatctctgtctagcacaaggaacaatacaaagagaggaaacattccacttctgtagtacatgtttgtacattattgcttgcttttcaaagctacattggctcctcctcaatttgacatgctatgagcctgcagtcatcagtgttggcatgttttgctctgtccatgttccattaacttgtctaaaaaattagttgcacattatcagcacaagggctcagaagtcggaactcatgatgtttgaataactcttggacttcttgttaacagattacagctatattgtgcattgttgcaatttacacacggatcatatgagctcttaaaatcaagtattgagcaccttatctttactcatgcttctttgacttctcttttatggaccatgacaccatagtatgtaaggatgtattaatatttgattcaatacagttaactatgaaatgtctacatgttcattgtgcttgtgcatacagcagcaggactagaaatagtatcattcaagaagtagttacaatggcaagagaacaaagaaatgtagtgatgtacgatagttcgaaattcctcagtcgaggatagcatatttttacaaccttgatctttccatgtctgcactctctatagtataagcaggggagttgcactatgacgctgtgggtaggggcctagcttcctgtccaatttcccggaaattgctagagttgctagacaacatttttccaatacctcctaggcctcatggcaaagtgatagaagcagtctccatgacagatgtatatctaactatccatctgttactgctagctagctattcatctcttatagctagctagatatatggaccaagagaggccatgatctatcgattgaaggatgtactatatatttgattccatgtaattatatatgcagcatctataatccagtatcaagttatgtatagttcattgtgcaaccaacatatgcagagtctaccgtatctagcagtaatgctgagcatctcttgaggaatttagctgctaaatgttcatgaaggcattttcctgcaaatatatggcaccttgtcaggccaatgccaaggctgctcaaagcaattaggttcaaagttcagacttcagacttcaaacgtgacaaacttttgattgacgcatcattcattaggaaggagtgtaattttatcatttttgaaaaggtacctagaggtaccatatttctggtgtaaaattcagtacctctaggtactaaatacctcaaggtacaaaaaattttagtgtaaaatttagttacctcaaggtacttttttaaggactataaaattctttcctctaggaaggaaggtgtctggttagtacaaagcacaaaatgaaaaaaaaaattgtgatgacaaactgaataggcatggcattttcatcagtcataagaaataaggttgtttcttcatttcaaggaatgatcaatcaaaattcactggtctgtgttcatgaattgtacttgtgtaagtgaaataaaaacagatttcttggttacacggttttatatactctgtctttcagggacatagtactgtgtgttgtgtgtgcaattaacaaaattcaaaactcaggctggtacatcaatcagtcaacaaaattcacagaagttagctggtacaagactacaagagtaaaatactgcaattccttgaagagaatgaaactaactattttacacatcgatcaagctcgtgggctttcagtttatgacacgagtcaaccacaaattttctacataatccaagctagcatccaattaaccataaagctcatccttgcaatgccatttatcataaaaattcagttgactaccaacaattctctaaataattcaatacatatatcatatccttgcacaccaatgttgtacatggcctttgccagaatgcatatggaatctccaaaaagcacatcctttggacgtgccaatgttccagttcattgatcaaccgccacacgaccgtgtctctaatcaatcgaatctatggctgaataatttgtcaactcgctctattccactaagaagtcccgtgcatgtgtatcctgctgatgatttgaaagaccaaaatgctggtctctagtctcctgcaatgcttcagctcctggtgcaccaaacaaggaagttcctggtgcctcctaggcctaacatagcaatgcactagatctaattttactcttccatctgaaccagcactcaccacagacgactctttatctctcttagcttggagctcctgatttctcttttataagcctaatagagtttgtcggtatggaggtttgggtctttccatgaaatgtactatagcatcgagaaattttaaaaagcggaaaaaatctagaatgtccgatcttgtttcgtattatcgtgtatgcattcaactacattgtagttcaatgcatgtgcacctaccatattgtataaatgagttaagtgtgcctgaatatatgttctgtagagatctgttgtcatgtggacatgagtataagaaacatttttgtttgcatggacatgtatttaaaagataaaaaatgttagtaacagaaaacttgcattaaaaagaactgacactaatcgtattggtgtccaactatagttgctcaaaggtgctggttctatatttttttcatcccgtgaagaagagaaaagaccaataggtactgaatttaaattaaccggcacctatgagctggtacctagctattatgggttttgtagtagtgagtccttccaatgaataactaaacttcgtgctaattgatacaaaaacacagtgaactgttataacaccaatagcccatgagttatttattcatttcacgtcagggtagagaagttatttttttcccttcacatgtgcttctatggac

SEQ ID NO: 41910 - DNA, 5797 bp, Oryza sativa
ccattggagttctcttctatatgaccatatgaataatatgagctcgatctctgcctctctgctcttgtgacatctttttgtagggcaatgaagaacagtattatctcttaattgcctgcaaaaagtgtagtccctttgaaaatgatagactgaaagcacggatcatgattcatgaaaaaaatgatcccgggatgcagagtttttattcagcaattagaattttagttggggtttgtcccatcaccttatggcttgattttcatataacaaaaatcattggttctgtgccttatggtggagaccagagatgtaaatcattttcattatctaaaaaaaattcaacaaatgccaaatcaatcacctcaacattaatttttcctgtggaatgcgattatgattattcaaccttttacaataagctaagtgcaggagcattccactggacaactattgactcttgatgtccaacggagactgatgaatgaagatcttgatctttcaacttgagaaccagttttgtaccctatgcctcccaggccaattgttgtccatggcaagaagacaggatctgccaccttgtcttgctcatcctctctatcagatcaatgcctgccatagttctccgatcctcctatctgcacttctttgtggccaaaagagctcaaatgcatgctcccatgatctcacgtacgtactcgacatttgtaccaaattggcatggcaaattcataggatcaaaatttgaggtctacactttgggggtcatgatgttcggtacaatcgaagattcgtagatgtaatagaagagctcatgatgcctcaatcacctgcatgttcttttatggaacaaaaagagaccacaccaccatatgtcaccactaagtgttgaacactcacggccgtcttgttgagccaattaatttagataaaaaaaaggataggcaagaaattagttatgccctcatgtgtcacaaaaaataaaggttcgctgtaggattatagattcatgaatggcgtgatatggcaacatatgtaaaatgttccaacatggtacatggatgacatataaaatgtgggagaatttaggattagttggagaccagtgtgcatcatctctgcagtttacttataacaattcaaggatttccacgatagatgattttatttttcgaaattcctatgaaaatgcttgtgcaaaaattcaaacttctctttggtcccaacactttatatagagtcaaaataataaaatgggatcttggagtcacaactcgcaagcaagttcgaagggttgagcgggaccagggtcagagacacatcaacatgctcgtaaccatgtacttgttcatttacaaactttttatatcattttttagagaattcttctatttagactaaggaagcttgttattgaactcgtatgattttctagagattttttgtatgatatattcatatcacacaaagtggaaaacattaatttgaactacatatgaaaagatcaaggactaacaaaccacatgatttacatgcacatgtcacactgtctggtgcatgccgtttaaaaaaaagaacgaaataagtggaagtcatgtcgatttataagggattcaattaacaataagcagacactgaaatcagctcactctgtcccaaaataaccgcagagagttttactgattggcccaaaatttaatgtgatcagctcaacaatgtgcaaggatatatctcacgtacaggacatggcagttgggatcacctagccattgtagattatgtgcaccaaggagaatgaaatccaacaaaggctagtagtaagcggcggtattgctccatcgcaagagtcaggtttacttggcgatggtaaacctgatgctggattggggggaatggcaactcctttcacctcttgggcagcgccttgcggcatcaccatgtctgtcccgttgtgagcaaacagctcctggtgcatcccaggcctagcatagcaaccgggccactggtctgatccactcttatcatttcactctatcagcttgcagcacttgccacttgggcttttatgtctcatcttatatggagcaaaattggcagcaaggtatttttgtttcgataatggataaaatccagccttttgcttcaacagaagttatatccgcgtagtacaatgtacctggttttaaaatcaaaataaagtatctaaccaaaaataaagagaagacacgttataaagccaccaacataaagggagaaatacaatttattcaacccctgttagtaaatttttgtttaaagttggcgaaaatttagtaaacctttgtgagtatcgatttacgcaggggcggatcctgttgtgcgagatcacccatgtcactgacagatgaattatttgatccctccttgaggacagttactttgcagccaagaagtattctgcacctacctttcatgtaatgttagtatatctctccattgagaggagagatcccagttgatcagcacacgagggtaaaatattaaatctgatgaaaattctgaatatccctaaagaaaaactatgcaggaaagctatcatcacgtcacgtaaaaactgcaccgaatttatcacaccaagttagggatttgatcctaccgaaagtacgtacaccgaccaaatttaataacataagtgtgacaacatatatacacaaaaatcatcaaaaggtgccttcacactgattttggcttctacgcctccaagacggaactgatgaggatatatcttactaaaccttgagttcatgaagcatattgatgttctacattacaccaaattatcttcgaccttccgataaatgtagtttgttgatgctttgtttctaattctgctttttccctttttcttttgggtaataactgattttgtcatttccgcaactcggcattaataagatttgatcgtccaaatccttcaactgacccggcatttttagaacatagttgtgcctcccaagcattcaattgcaggcatgatatgaggctgcaccaaggaaccttctgaatgtgtccaacatttgtattttggcagtgaaatgtctccaattccaatggactaatgtgctcaaacatttcgctgactctaggattttgcaagaactgcaatatgtacgcgtgcaaatttatagttagttactgtaggacggcattcatcaaatcgatctaatttgagcttgtaagctatttttttgactgaaagaaaagagagataatgaggcaagaacttacagtagtgtcacgttgtagggtgagcagggttcactttctcgccggtaaccgcgcggtaaccgcggttaccgggcttaccgtggggggtcggtaacgaaaaccggcggtagggtttgggcaaattttgctcaaattcaaaaatttgaaaaataatcgaaaaaaatcaaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctaccgtttttcccctctctcgcgtagctgcgctcaggaccgaaggggcgacggcgtgcgcccgcgccaaatccgccgccttcgcgccggcgaggccggttcccgcgcggtaagcggcggtaaccgcgcggtacgcgacggtaaccgcctgggtcgacgggcaagaggtaatccctccgttttgaaggttttcgcgcggttaggagcggtaaccatgcggttttgtacggttaccatcggcttcgtaatctatgagacgatatacgtatgtgcggtaatcgtgtgaaaaccgtggtaaccgtccaccctaccgtggttaccatggcttgaaccgtggtatggtattttttactgtgatatgcatggacatatcaatagaacatatttttaccaatatgcatgtgaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagtctcacgacaagacgaaaactttaggagggatgttgaggagcgtggtggcacttatgagcatggcggtgggagtggatccgctcagccggaggcacggaaaggtagaagtaacccaattaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgcgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtagtacgcgaaataggctcggagcatgttgttcaaattatcacttacaatggctctaactacaagaaggcgtgcagactactacggcaagaatacaagacaattgtgtggcaaccttgtgtggcacacacagttaacttgatgcttaaggaggttgggaaaatgccagaccacgaaatggtgattgagagtgctaggaaaatttgcagatggctatacaatcataacaagttgcatgctatgatggtcttagctataggtggtgaactggttaagtggaatgctacaaggttcggaacaaactacagttttccagagtttccttaggaagcgagatcttttcatgcaatggatggcttcctc

SEQ ID NO: 41911 - DNA, 1468 bp, Oryza sativa
gtttgaagcatacatggagatcgtgaacaggaggatgcacaacctaaccaatgagactctcatcaatgccggtaaatattgatcataacataatccacatggcatattatgtaactcttacttaacctgtgccatgttttgtagctgccgcattgaaccctaggacgcactacgcgtattctccaagtgctactgtcttccaagacctccgacaggcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttgcgttgcgtttggttggtcaatgttgctcctccagtggatgtgaaaggaattggagcacattcgcattcgtacatacgaaggtccgtaatagacttacccacaagaagctcaacaagctagtgtacgtgaattacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggttaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttgagtattctatagtgtcaccta

SEQ ID NO: 41912 - DNA, 880 bp, Oryza sativa
  unsure (1)..(880): unsure at all n locations
agtttgtaaaggtcactgcatacagcatcagagtcagagaaccagacaacctcaccattcacctttcaggaaatttcagtgcaattttcccagatgctgacgtgtacacattccactctctctctctgtgtgccagagtggtgggccccactacgcggcgattcgatgccaacctgtgccactgacagcctgccacgtcagcacccgctgccagggagagaccgacaaacgcagcgtgcggtgcgagattcccttccctcttttcttttccacacacacattcaagaggaatctcttctcttcctcctctatttttttcaagnggggaaaattgcaaaattgcacactgcattattaatttattaatcattttttagtgctagagaatcttcttagctactgtaccaatatgatgctactactgtttgcttatactttgctttatgtacaattttggttagtgcagtctcacctgcatcttgattttttttccctttttagaacatcattgctacatgcatgaccagtgaatttcaccaaattcatatgaaaaattgtgcgaaaacagtgggtttgctcggtgcgactagggggtgtgggtcaccggtgagtattgaacttttttttaagatcggcatgagttttgcgtacctgtgtatatatatggcatgtagaattcgtaatccaaagtctcggcttaaaattttgagagggaaaattcggtcaggggacaagtgcaactgctacaactttgtggttagtttggcgtttgtttggtaccttttctttaagactcttcatgccaattaagaaaaaggagataagctatggacttaagcatcccacacttgattagtaatgactgatgagtcagctggtg

SEQ ID NO: 41913 - DNA, 1136 bp, Oryza sativa
tgcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaataagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactaaggggttctgaattgcatgggtac

SEQ ID NO: 41914 - DNA, 6476 bp, Oryza sativa
gtgccggtggggaggcccaggcacggcccggcacaggcccacccaagtcgggccgtgccatgcttgagccaggccaaaatgccgtgccgtgggccgagccttcgggcctcgggccttatggccatctatgccccgaaagcatgggtacccggcaggtgtaatcataggcgcgtaaagagcactctccatacttgcttggcaaaaacacaatccatcagtaggtgccaatcctactgatacaaagctccacagtctggtaatgtccagctcctattatgtgttgtattgtacgtggagtacatttacggtgatctctactagtagtattctactatcagtattattgtagtagaagtgatgtcaaccattgatttatgagttatactaccatttgaaaaacttacaaactctaacaattctactacacgtagtagatgcgtggtagtaatagtataaatggatatgatccattgaattagaaaaaggaaacgttttaaattagttccagtgtaaaacacctcccataacgtatgttagtggtaggtgctgcattgaaacagaaatgtaacattgctatggtcaatggtacctacagctctatatatacatggaagagtagactgtcgatgaaggagctgcagcgatgctcaagctaagagatgatagatggacatttcttgttgctttggtcagaataggatgcatcaggagttgccatgccacaagaatcatgttcagtaagttcctacatagtcactattaattacttttacctagcttgtcgatagttggttcaccgttctacatgcttaaactaaaattgcgcaaataactgttatattgcatcctgcgtacaggatctgcgagcaagaggtagaggacaaatgcttgagcatagcggttcatcagaattatgaacagttctcattcagaaagggaatgttggagctagtattctctctgcggtgcagccatgcaaatcctcttgtttataaaagcagattgactgataaccgatgtcgatgctccatgtagagtggtttatggtccaaggggttgggacagtggcagccatgtgatgaattcacaaagaccactactgttccaccgtacaactcgaagaactcatggtgctgcggtgaagctccttgtgtctgcggaagtgacgaatgcacgaagtagatcattgtggtaaagttcacatgtgaataattgttggaattcagtttaatttggtctagcagataaagggatttgtgcaaaatcaaagtgttttttattattattctatcatgaacaattggcatctgtgattattggttttaatatttgaagattattggcgaagtggttttggagatgataggatttacatgtgatatacaggaactgctgaatatgtggtctggtcagaccgggcatgtgctgccggtcagactggcttgtattgcgcggtctgaccagccgactttgtgtcggtttcggtttcgagttgtttatttggatttcatatttatggcttctagatggatactatgcgtatgtaatactgttgtttgctactaatgagtcaagttggagatagcttggtctcggaatatggtttctttgtttgattcatgtgtaggtgacttgatgcctcgggagagtattgccggtgatggatcgggagtcagcttggtgataagacgatgtccatgatggtcagatatcatgcgggatacttaggctaaagttcaaacgcacatggttggtgaagattccatatggcatacgatggaggtattgtgtgcgtatgggatgcgaagtcaaatttggaaggagtccaaatttggtatgattggagtttgtaaagtttgtttcttgtatgagaaggtttcctaggtggattaggacttctagtatgattttggttcgtggctttaggctgcctacctcatgtataaatagagagggagcgtgaggcttctcggtatcacttttgagagcattgagctgtgagtttagttagggtttcgagtttagtcgagattttcgtgaggagtgttattgttgcactttgtaaacacagagagaagtaataaagttgtcatctactttaagagttcttcgatttgtgtttctcgggttcggcggtctaaccggcgagtcaccggcggcatcgcggcagtcagaccggtggagtgaaggcggttagaccgacggcggtttcaggcgacggcagctgatcaggtggtcagaccggagatacaacctctttcagaccgacggcttccaggcggtcagaccggcgcaacaccttcggtcaggccgtgatccgtcgaatttgagggtaactttttattccgcaaaaagtttggggttttggttagttctggtgtttcgatgatacaatttggttactataccttgacattcttggttacgcctgacttggtgtgatgagtgctgtttttgtgtggctcaaagagaactttcctgcctatttttgtctttagacatgttcgcagatttctcttaattacatctcaacatttgattggatggctgtgaaggttcctaatgcttccactaaatggagagatgcacgtctatgaaaagcagctggacaattcttcaggttctatatacgagtaactgagaggggtcaaacaatacactctcatagtcatatgtgatgttcgaatctctccttgatccatgaataaacagagaagggatctgaacttcagaataattgtaacaaactgaggtatgaacagttcatcaagggccccatccatctggggtttatcgtggcaaaattctaaataaaaagctgaataaactctcagagactctgagaatttgaggctatgcttgggataggaggcaccaggagttctcttgttacttgaagtgatcttgcatgcccgtcaacgagggcatgccaacggagcgtcagcgcagggccccacaaaaatttggggcccccaaatcagagtgaccagcacaaccagccagccttagcatatacaactgacgtcctatgtgtgttcatgtgcatgcatgcgaaaccagcttttgaatccttgatcaacaatgacaccttgagcagctggccgactacctcgtcaaccatattagagtaagactggacaactggtaattaagtcaaatactgaattgttgaattgcatgcatgtatccatgcatggtcaattgaatgtttcagtactcttcttttaaatcaaattaccatgaatataatttactaatttaaatgatcaactcaatcaaaagtaaatttaggatctcaaattatatttcgttccagggcccccaattcctggagacggccctgtcaagttggtactttgatcaccattccacccctgagggaattcaatgacctgaacatgccgccattcggttaaatcttggcccccattaaaacaaatgaaaaatataggaattccaaaggatttgtaccctatgaagccctttcgatatgagcaggtatggtgtaaacaattggaaacttatttgtgcaaatgttgatacaaataagtttatttgcacaaaccaggtatggtgtatcctatggctgctatgcttattgtactatgggtaaaaaagggaacctttaaactaatggcatatacacatatcatgcgtacacattgttctctttgtttagcacattttgtgattaccaaaagccgagaacgacttttcttgaagagatgatgtggatctgccaaccaattgcacacattgtcctttgcatgtggattagaacaaaaggtgatatcatttttctcaaattctaagcatgaaatatatgagaatttgatgttacaaaatatttgtcacttgattactttcagacatgagatatttgaaccattggcatgcataaacaacacgtgggtctagggagatgtagcttacataattgtaaagcttgtcaagtctactttccaaaggatccaatggcacatcattcggagttttctatcaccgacaattgcaaaatgaagacatgttgcgcaaatagattggttgacgcgcgagtagcggcgctgatgatgaacatgggccttgcacgacatgtttggatggggatctatttccaaggcaaatctttggttgggatggactccatccactagttccccatggattgaatccttcgaaaacaaggagtttgaagataagaaagaaaatatttgacttggattcggtttgggccatcctggatatgcttggactaaaacgtttttttctcttcgtccgaagtccattttggacgtgtgagcacttgttggaaagtaaacttcatggcccacatgatggagaggcccacggacacaaattcattctggttccaccacaagagccaaaacaaactgatggtgctaccgagaggtttccatattgtgatgtatctgctcttgttcttttcctaggttttgtgctgtcaggcgccaaactagggatagtgattgggagttctgccatagattgttcttgcttttccttgcagggaattgagggagctagcaagagatccaattttgcatggtcgagtgaatcaacctatcaaagtgtgttgttttgtgagttcatggtgaaaggtgcgttgcacaagttcccccgcatcacctttgaaacaaaggagtgattcctaccgatttatttgaatttcctatggaatgaactattgtggaggaattttggaggaagtaagtatgaggtcttacctcttgttttcttcttcccgtatcttgaattcctacatttttcttgtgtgacaatcaaactttcctatgttttcaaatccttcaggaatccaatgaatatgatgttctattctcatgtttttcctactccaatgttttgataatcctgcatttcaaaggggggcaatatagctactggttcctccatgtccacatgcacctctagataagggtgaaaacggtatggaaatttcccgaccgtaccgataccgtttccgcaaaactaatataataataatatttttaccgatggttatcgttttcaaaatttagttttttttaatttctatcagcatgtcattgaagttgacactaatagatgaattcataaatatggaaattttccgaccattttcgttcgttttcaaaaaaataataaaataatgataccgtttccgaccatttccgaccgttttcatccctgcctctagatcatggtctagcactgatcagcttgagttggctagaactgtttgagaaaaagaaataccaaacttttgaagacctaaccactgatgagctacgttttgaaaggtaagataaaggaatttaaagtagagtagttttcggtagaacaaaatttagaccacatttggaaggtgtaagaatatggtgcggagcaaatacttttaattcacacacacaaacaagaaactaagccctggcacccttgccctacttctagccctgcttgtctgtgcaagcacaaataatgcacgatgaacatgatttcagacattgcctagtgaaatgcattatgtacaaaggacttgctcactttgtcgatcagcgatgagatggaaatacacatccttgctcactgtcaggttacaaagagtatatgggagcagtgtgggcactagataacatgcgaatcgatcaatgggataccatggacaccgtggagaaatggtggactgccctagctcaaacaccctgaatagcaaagagccgactgtgctcgctgatccttctagtcagctaggaagtttgtgcaggaaaataactctctaatgtaaagcaaatgctccccatacctcccaaacctaccaaaacaaagacatcgcatacatcatagtgccgtacaccctatgtatcaactctcattcccatttccagcatttggcacttgcactcactcgtatcatcttttatagagaaaaggtagcatgataatctgttcaattcaggggaaaaatcactgtatgattgagggatttctttcacgtggaacattattcaaagctaattaaaaagttacataaacgactatgggcttgttcagtttgccaccacttttaacctgctaattttttgagttactaaagtttggtaccatagcaagttgaacaagctcttgtcattgttatcatactaacggctctctctggccatctttggtgagctctgatccaagaatttttggagctatatatttcaagctacataaatccacggatctagatatgcgattacgttgataacatttagataaatcattatgttcgcattttaattgaaatttaagattttaaaccactataatttaacatataaattttaaatcaaacgtgaatctaagatctggagctgtgccaaacaagacataaaaattggcatttctggaaatttattctcattaacacatgatcaaaatttggtaagctccaaaccaaatacatcgaacgttgg

SEQ ID NO: 41915 - DNA, 7286 bp, Oryza sativa
gtcaccatcatctcctgctcaaacaggatactcacacggccacatggaattatatgcactgaagcgtattacgatttcagagttcagacatggccttcttgccagggaagttctatgcattcaccaaagcagaagggctccatgttcttgatctcaaaataacaacaatggcgtcggcaatcttccatatgcaaacgctggaatccttctgatggctgagcattatcggtgcaaaggctgcaagctgagcaaaatttagaatccttttcatggctataccttttctttgcaagctatgcaaactagctggtttcctttctttcagtgatcagctcaatagttggtgtggacgaaatggctaggatttgatgtgtactttaattttgtttgattatgtattgtacaggttaacgtatgtcttagggtgaagggaaaatgagtgatctcatcccactgaaatgctgatgattttggacggctcaacaaccctcaaacgatctatatatgtctttacatgtgtctaatattgctttgcttatccttttgctctggaataagataggggcgttatggctgtttcttcctactactattctttccatcagtacaatgaagaaaatcacgagaaagtcatagctagttgtgtgcctgtactttgtcttccctaaattttcttctgaagtattgttcaactggaagagtcatatgcagtatatactgtccagcaggattgcaggaaagacttcaattaggaaccaaaagagaatgcataattaatggttatcatacatataattgttttggcaaccgttaccaccatgttctggagttggggagagcggcatatataaagtctttctgaattttctggtttcttcgaattttccctgccattttcttgttttgattgtttgaaacagtagcaatcccttccaatccactgtccatccaagcaatctaaacaagctaagggatggaaggcgattgggagggaggggattgggtgtggaaatggagatcaacgcggtccccgactccccacatggtttgatttcccccggaaggaatatcccaacgtaccgaaaaaggcctaatagaaaaactctgttcctgttgcttttgttgttgtaggcctaggaggcttcaggagctcttgtggtaccttcatcaagctttgattctggaaaaaggcatgatttacaaatttatgacctcgaatttgaaccaataagttcaatgggtcaattgagtacacatgtgtagtatgtgagatcatggggccatgtcgcatattttgaattccgagaagtgtagaaaggggcaaaactacagaatgggagagactgatagagattatgcaagttagcaggtggcaggtccgtccttcttgttatatgagcgccttagtttgtatcatgtttcgcaaaaaaaattatatggttataaaataccatcaaacgaatgtatgtgaacgtttaaacaagaccagattgtacattcaggagtaggcctaggaggcatcgggagctttccactatcgagcagaagttgacatagtgcgtgaagtcatggacgtggcattgagggacacagaacactagcaactctctcttgcagctcttcataaactgaaagcgcacgagctcgatgtgcgaaacagacagtttaacgaagagttgcagtgtttaacttgtatgaggcaactactgagaattttcttaatggaatgatgcatcagtgtgaatttcgatctggttttttcttaactgcacacataacactctgtactctgtttctgaaaggcagagtttatcaagccttgtgaccaaaggcaactgcttttgtttcagttactcaagtacaggacatgaacagagaatagaccaccgaattttgatttatcattctaacaattaaacaaaacgacctcacgtctgatgactctgatactcatcttgtgcatgttcagtttgtcaggtctatttttgttgttgccttttcgttttgttacatggaagtgtctaccatctatggcgacgatggcaatgccttgccttgtaaacatgcacattcggtagctcttcgagggtatatacgttcctgagttcagcgcggtggactatatttttgccaacaaaatgcgaagtaaaaaggagctgaggtagattaactaacaacatttaggcatggaaaactaacaacctgtaatcaaacagcaatacatccttgagtgatatgtttatctctcttttgtctataaaagagctggttatgaataagcacaattgcttggagcaattagagctagctagttctgttcatggaggctgtgagcttctgtggcttttaccgtacgtgttaagcttaattaggaggcaccggagcccttgtgttaggttgggcaacctatgattttaccaaacagcattgtcgctaaccccagaacgagttaagtattgtttgtgtggtattaattttaatatggcatgcattaaaaatccaaagaaataaatagttaataaaatatcaagaccgtcgagcccttgagctgataatgtagtgtacatcagtatatatatgccatcaattcatagacaaaaattgataaaaaatatagttaacacatcaatacgtacacatgtagaacagtagaagaagagtaatcatgtattatactccgtccattcctttttcttttgttagttcaggcctgtgcgctgtagttccagggaaactctgtctacaacaacaacaaatgaccgcaatgatggccgttccatgcctggagttgttgcaagaactcaacaaatgtaaatatattcctctgcattcaatccacccaaatgagagcggtttttacatattaatacatggggtatacaacaggaaatgacttcggtacccctaggcctatgaggaatctgaggtgctggccaatgggtcagccctgggtctattagtaatctcataggtgacaaggaggaggcgcctattaaggtagcagcgccggttcccgagggagcccgctattacctggataaaggcatcccccgggtaatatcgtgctccgtctggtcatcatcgacagtctcagaggtggttggggcgcaaagtgtgcatttattccaacccactagtcgcctgattcctaacttgagccgttgagggcatattgaggctcgattcgccccgggcagcatctcgagcttcggaggcctccggagctccgaagtccctggccgcctccggagttcttttgctaggctccggaaaccctctgagttccggagctcgagatgcttcctggggctccggagcccacggatgttacggcctcccggagcccttccggcgatctccagatcccttccaggctccggggctctcgccgtccacgggatccgattatctgggatccttggtagcctccggagcggccacctcggtcggggaccgacatggccccgatccacggtcatctccctgggaggatggtctccggagcgcttcaacccttcggaggatggctcctcaatccggagccactcccccaacaccttgcctggttaactcacggagtgaactatattttcattggtaacatgcgataaagaaaaggtgatcaactgaatatctgaacacaagcacatgccatgtggcactgaataactgcatgcatggaatcaaatggtacgtcgttcatccttttgtgatatgcatgatgatatgttttggtccataaaagggcatgcagggtggagaagcacacaaatgctgcaagcaatgagaggaacatacattagcccatgcagtctgctagctcctatggcttttgcagtggtaggcctaggaggcatcaggaactcttgtgctaattttgtcaatctttgattctaccaaaatgcatggtcgctgacattgaactgacgaataggctatgtcaattgagtacagatggtgagtattaatttgatctcatggaatcatgtgaccacaatactagaaaacctattttgccagacgggcgaaaaccgccttcataggcgaactgccaatccacctgtagaaaaaggtctgcgaaaatcaatttttttcacaggcggatatatggtgccaaaaaaacttatccacctggaaaaatggaagggcctcgtccacaaaaatcgttttcctcgtagtcccatttttagcttactaggtggcagattcaatttactagcttagggcgtgtctaatttggatagggtttcaatatattgcatgttttgagagatgagctcccatgtttgtttgttttttttactgaataacattgatttggatataaggacagttcatgtcatcaagaattcgtggatgactattaaatggaaattcacaagctatgaaaatagctgttgccagtaaaaaaacaaacaaacatgggagctcatccctttattttattctcttgaatatataatttcatctccatcttttaatgctcactcgaatgatcctgaatctagaaggcactgaaaaaccatcttacaactgattttttttacaaaaaaaataattaaacactcaatggtaggtgcacattgaattactgttatccctgaaatgtttcttcttttccctattgctcttgtatcttccctattggacaccctagaggatcatcactactatcctttctggtccatgaaagagttgagacaagctctgacaatgagactggtgagtgcacatctgaaatctgtttggacaagagttgagacaagctccactttcttttcggccaaattgggcctccaatgtagcccatgcaaatagtccagcccaacaccctgaccggtgtagtacccagaagcgcgaattttttttatttttaattttttttattaaaagttttacaaaaataatttttcattttgaaaattgacagaagtggtcgcctaccgccctctgggagggcgatttttaaaaatcaccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgaatttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaaatcaccaccataattaaacattgtaatgataagatagataagaagtgccatcgatacacggtacaaatttgtcgatcccgacgaatcaagcatgcggtaacctatcggcaccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccaacgttcgtactccatccaagcatgaatgaactgtatggtcggttcaggttgcgttatcggcccgccacttgaagtaactctgactgtgtcaatccattgtacgaattgacatttccttacatcctcctatgtacatttattttgggatagttaagttaatgatagtactgaggagtgatgaaaagaatagttgtaattaccacgaaatcatcgtcgacaatgtttggacacaagaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccaccttaggtagtccgatcttgtttcactacgtgggtaagcacgggttccgtcgttttgtgggttctccatgtctacccactcgataaagttgcacattggacgatatgtctgcgtaagatgttacaattgtgtacgaagaagttagtttttttatccatttgaacttcgaatagatgaagcatacctgatgaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcagttatatagcgttgttttcactgcaatatatgtgaactcaatgagatacattattcattagatgtgacaagacgatcacgagtgggcgtgattcactttatgtcaacaggcagcgccgaaagttgatagtaacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtag

SEQ ID NO: 41916 - DNA, 2406 bp, Oryza sativa
agcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgctttcgtgccgtgaaggatgaattcaacaatagcaaccaatggaagtatccaaactcctcgcattacccagttgtacacctctgccaaattggttgtcattatgccataccgagatccatcggtgtcgaacaataaagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaatttcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaatcagtaccagctttcagtgttctcactctctacaaatgcaaaagccataggtacaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccaatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcataatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtagccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaact

SEQ ID NO: 41917 - DNA, 9556 bp, Oryza sativa
tcccagagggcggtaggcgaccacttccgtcaattttcaaaatggaaaattatttttgtaaaacttttaataaaaaaaattaaaaataaaaaaaattccagaagcgcacactccctagcatatccctaacacccaattcaaatatcagaatccttttgatggtcgaacattttctgtgcaaggctgcaagctgtgcaaaattttgaaccattttgatggatattccttttgtttgcaaggtattaaaaacagggtgccttcaggtggtcaggtttatagttggtgtggaagaaatcttcagctgatcacaagtgctctttagttttctctctctctttttttttatcatgtcctggacaactttatataagtcttagtctgaaggaaaatacagtgaagattcttctgaaatattgatgtttttggatagcttaacagccctgaaaggatatgtctctatacttgtgtttgacattgccgaaatattggcttctccttttgctgtggaatgaaacagggctatgactctttcttcgtgttgttgttgtaatcagtagaaccaagaaaaaacactatcaaattatatcagttgtgtgcctgtactttgtcttgcctagaatttctgctgaagtattgttcacctggaagcttgatatgtagcaagagcaattttaccgtacttaagaaggtaccatgaggtatcactttttctactgtaaatttggtacctcttggtacctagttaccatgagataccaaattttacactaaatttttagtacctcatgatatctactcaatgaccgtaaaattgcttatgcagaagaacaactgaagtcctgatgcctcctaagctcaccatagcaatccgacaggctacccttcatgacccttacatctctctctctctctctctctctctctcacagtttgtagcatctgtgttcatctgtctatttttatattttaggatggaaggagtaagtgttttgccttagctttaatttcagctagttatcctttcagaggagttggggaattgtcccatagcttgacgtttcttttctttgttcgcactgaaaccttttggagctgtgtgcttgtcagcagatactggagatgcaaatcatttccattatccaaaaaatactaggacctgctagcaaccctgtcctacttctagctctactggtgtgtgcacaagcacaatgaacataatttcagacattccatagttaaatgcattgaattatcctcgccaaaaaaaataaagacagtacatccttacatgatacagtgatctgctatggcccataaaagagaaggcaaaggagcacaagtgttgcaagctactagtaagacactgacagttagtcatggggcctggtcgaatgtcatttgctatggtaggcatcagaggcatcaggagctctgttcatctttcaacaagctgggctcttacataatgaaccaggagctctgttcttttttaacaagctgagctctagatcgatcatcaaccaggagcccagttcttttttttaacaagacgagtttttacaggatggccagcttgttttgttttgttctcttttttttttcaaaagaagaaaacgggtggccaccttttgtatattataagcacgcactgcagttataatatgtaactaaaaaactaaataaataattattaaaaaatcatgaccgtcaaggccttgagctgatagtgtgccatcaattcatacaaaagtagatgaaaatatggaataaaaagatcagttcatgataatgaaaataaaactattgatttaacatgcaatggtgtataggtgagtattcattatccaaaatagtatgggtaagtattgaaattgaactccactttaattgttttttgtagatggaaggctagccttgacagcatacggagtttactaggattgccaattagtaacctctgaacttgctagttgacaaaagaaacacaaattcagaacaaaagaaataaaaacaaggatcctttgattcgaggtctttgagacagaactcatcgatggccattgccggtggatgaaggtggacaccttgggtggccatgcaatcttccttggtttagagtgcttcaagttttcaggttgcgtgtgtagtgtgccttcaggttatagttgaccaaaaggcctggggctcaatgacccggcccatggcacgaggttttggcccggcccaagcacagcttgcccgattggtgtcaggtctgtactggtccggctcgacctttgggccgtgcctgggcctctagctcggcacggcggaggcaaatagatgagggagccaaaatagacttactccagccatataaggcatgaccaaagacacgagggatgcatagggatacaaaatagactttttttaaggagcacagtgaactttcatgccttcaggctgacccaatacggcccgagtcttattgggccatgcctgagctattggtgcagcacgttggcgggcatggcctaacccagtgtgtaggtcgggccatgctggcccgattgatatcgggcctgtgcctagtcgtgcctgggctaggcgggccatttggccatctatacttcaggtggttaggtcaataattggtccggaagaaatggctagtatctgacaagtgtgctttacttttgttttattatggcatgcatttagtctgaaggtaaatgcagtgaacatcctgctgaaatactgatgtattttggacagcttaacagccctgaaaggatctgtctctataccacctgtgttttacatttcctaaatcttgcttctccttttgctatgcaataaaacagggatatggttctttcttctttttgttgtaatcagtatagccaacaaaaacatgatcagatcatacagttgtgtgccagtactgatgttcatctggaagctccgcatgcagtgaactgtccagaactgcaggatgaaagcatatctgcaactgctgatgattccatgacattactactccatcaaatgcatgcagtattgttcaattgggcacctactgggctagaaaagaaactgaatcatagtgttgtcaaattacatcgaaaaccatgatcgtcaaacccaaaaaaaaaaattgcaaacatcatttaggccatatacaacaatattgagcttcctaaccaaaattcttttaattttttttccaaaatgaaattgttatcgaaagacaactgcgtcatgtcgaaagatgtggttcactcagtgagttgatagaatagtaaaagcaatatattaattggtaattttttttgggatccccccattacatggccctagggggctatttatagtcttagtacaggctcataccctctagagttttagttagtataggagaatttacagggaaacccttatgaaagggacattagtgtgggtacacagtgtcttttgtatttatgggccaccaggcgatctccttgggccggcccactgatggcgaaaggccccaatgggccatagggcctcccaagcccatagtcgaaggcacctccaacccgggtgaggacctctcactttgccttatggccttcgcccttagtggtgacttggtcgaatggcgagcttgggggcgaacccatcggtcttcgtcgcttggcttcgcccaagcgcttcaccctattgcttcgccccgagcgcactcctttggactcagtcgacgcctagtggattcggtggtttcagcaggtccggtcgaagggcctcgtgacatgccaacaatagagatatatctagcgggtaaagggtagtactcctactatcgaagcattattatcggcgaagactgttgtcccatgtcctagggcagtcccactagttgcaaccgctcctcggcatgcttgtggtctctgcagaaggataggggcgacgccgagtgggtgacatggaaactcctggctactctgtagcaacacactgcatggctggaatggcttcagcatccatgtatggaagattacatctcacagacaattctttgccattcagctggcatgtcaacactgccattgccgttcaatccagggcctgccacagcgatgttctgttgaagtaacagaagaactcctgatgcctcctaagctcaccatagcaatctcctgtgccagctctcatcacccttacatctctctctctctctctctctctctctctctctctctctctcagtttctagcatctgagttcagttgtctattcttatatggagcagagaggggagaagtgtatcgtatatgaatgcacaaattgtttctatggatgtagttattcaggcttgcagctgatcgaatttaatgtgcatgtacaagtgcatttgctcgatcaaccatacccaactcttcagttaaacacccatgatgcaagtgaacgaagtaaatagattgctcatgatgaccatgatgcaagtttaagtatgtcttagtctgaatgaaaatgcattgaacatcctgctgaagtgttgatgttttgaacgtcctgaaaggatgatcagtttctgtacatgtatttgtcattgcctaaaccttgcttctccttttgctttggaataaaaatgggttatggctctttttccttcatgtaattagtagtacaaccatgaaaaatcatgatcaaatcatagctagttgtgtccatatacgttgtcttccccggagtttcttttgaagtatatttcttcagctggaagcaccctattccgtaatctgtccagcaggaaggctaattaaggaccaaaagagaatgcatatctgcaactccaagcagtattgttcaattcaaagcgagtcatattatcgtcaaattacatcgagaaaccatgaccatcaaacaaagattgtgaacggattggcaaaacatcatttagctcaacgcaacaataccgagctctctcaactaaaatctttttctttttccccaagataagttctgaaaccactatgttggaagttgataccaggatgccatttcctagatggtgtagcatgtgcgagaacgagatgaagcgtgagcctccacaaagacaagtagtcctgccaactgtaataacagttcttcagccatgtcagcactgccattggaggtcagttcagcacttggcactgaagaactgtacaactgtaacagaagaactcctgatgcctcctaagcataccatagaaacccacatgctcttgttcgtatgtccttagttggcctagtgagctaggtgtggtgacaactccatttggttggctaatcttggagatatgttcagcaattgttgccagtttgatctcttgctctgatggtatccaaaggcatgaacatctacatcctactttccctgtctcaaccataaactgaactaagttcatcaaatgattattcagttataagctttgatcgaatggagacctactctcaactctatgcagtggcaattgcttaactgcccatatagcactctgaactctgttcctgaaagccagagtttataacgccttgcatccaaagaaatacaactcattttctttcactaactcaactacacttcaaaaacagagaacagaccagtgaattatgcttgaccattccaaacaacgacagaccatttgcaggtaaataccttgatcatttggtatgatcagcatttctaccagattagatataatcccggctttccatggctcgatcctacggctacccaaagtcatggccatatctagctacctcctactccctgtctcaacttctacactgaactgagcttcagatgattaatcaaccattcatagcatcgactgaatggagatatatatatcctttgcatacatacacgttcaaggtagtttcccaatgaattactttgctactggactatagacgcacaatatataattacagaatcaaatgatacatcctttatataatagcaaggtctctcgggctctcttttggtctatatgtatacatgttagctgatagctagcatgcagtaacaaacgaacagttagataaggagaccacttctgtgaccctgctatcgtaggcctaggaggcattgggagctctcgtcttaggaacatatcactcataagagccccactgcgatgctctctactggtaatagaaaacaatctgaaccattaatcttatttcatcgaatggtctatatctatttgtactattaccccagttggtggtagtagaaacatgtatgggcattattatccaaagatgtgtcgaggggtataatcatcatttagcagtgattaaaccttttttttctccgttttcttgttctgatggaatatgagtgatgctagtggaatggatgaccagatcgatctagacgaaaaaaaatgtaaatgataaaattactcctaatcactgaattagtaaattattaacttacccttaataacaaacggttcagagccctggagcatcactccagaggtagaaggacaggcctcaaccagatatctgttagatttaattgggtaattgatacatttaaatcaattaaatcaaataaattccaaggctcattatgctaggaattcatgtgaattcattctcttatgggatatcaatgggatgaagagttttgagaattaatccatttgattagggaattggtaacttatatcaattagtcctaattgatggatggttgatggttgtgtagtggatgatggttcatggctagttgatgacaattagttgctctattcctcttcctattacattggtgatggttgtgtagtggaggatggttgatggctaattgatgagaattagttactctattcatcttcctattccatgactcttactcttcatcttccattcctcttataaaatgagaatggatttgatctcccgcgtaagaggaagacacacttttatccattttccaaagctgttgctgctacggtaatcccattccaacgagtgtgtgcacacgcgttgggagagtaggcctccgaaaccacgcgttgctgtgacgtttgcacagacgggcgggcgatcaggtttttgggagctcaaggcgcgactactcactgttcgtcaacatctacttcaccttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgttattatgtgattgttgatgcttattctacgttaagcatgctcatgttgattacattcaccactatcactggatcaaatcctattgtaaatatcatgtttattatcttgttattttggattaaaatatgccgaattatgaccaaatttccaacaatatcaacatgtgcaagtcccttcctttgtcattttgaatgattgttcataattcaggtggatttgaggaagaactagagtgactcattggctatggtaggccttggaggcatctggagttgttgggttcctttgaaacaagtagaaatatgtacggtacggacagacggagttatcatcgtcattggtactttcatggatatggaaatcttgttttacctggttggagttcatcttagtttccatatgaccaaatgataaagctagctacttgtagctgacagaagagccgcatctggtagaattccctgttttcatccctctctaagaaaaaaaatcaattcctactatgtctatggagaataaccaagattggaagttattatgaatcacattcagttatatccttataataaatttgactagagttgtctatgagtcatgttaagaaaatgagagtaattgtagaatattgggtctccatccgatgatccagatctgcccatctatttgcttcaactctaaactgaactgatcagctgactagaaacatttctagctagggtagaagtgaaagtagatatatgtacaaatccaagcaatgcatggtaggttcgtagcaaaccgggcttacttcaattgggttctgaataattgcttgaaaccaaccaagcagtacatcttatgcgatattgcaatctcctacggctaattggcccataaaagagcaggcgaagaatcagacaaagagatgcaatctgatcaagttggatcgatggaccttatggtgcagattagctagtgccttcgcaatcgttaggattggaaagcatcatgaactctcatattgaaacgctagctagctagctatcggcctagctagttgaaaggagcctacgttttttagtctgactcctatgtggctaagttactgttcctcggttggtcaatcagaaccatagtcacaggaaacaggatcggtggcagtattcctcaaactgggaatacggaggcatcttcgtccccaccttataacaacgtctcgtaagtagcgtgtcacattcctcgacccgataactttgtgactatgatctaatcatctgaactgattgctgacaacctgggtgtgctaataggtattcttctctcatttcattatgtagcaatttacaattaatcaggaaatacaagtaaatgtttatccagcatatctgcaattgatctgtaccacttgtccagctacttcttgcagtgttgttcaattaaaagtgagtcatactattttcaaattacatcgagaaaccatgatcatgaaaccaaaattttgaacggactggcaaaaaaacatcattgagctcaacacaacaatactgtctctcttagccgaaatccttgaattcagaaaccactatgctggtaaaaacccttcaaagctgacatcacgatgccattcccgatttcggagtagcatgtgtgagaacaggaggaagcatgagcctcagcaaacaccactactcctaccgactgtaacaactctttaccactcaacagccatgtcaacactgccattgcaacctactgcagcacttgccaccatagaaccgtccttgtgtaacagaacaactcttgattcctcctaagcctaccatagcaacccactggcctcatgcctcttcggttggcttcagcaattgctgccacattttgatctctggctctgatggtacccaaaggcttggacatgtctatgtcctactttcccggtttcaatcataaactgaactgttgatcagcaattattcagtcatagctttgatcgaacggagacttgcataaaactctatgcaatgccaattgctcaataaattgaaacatagatgctaaataattaggaggaatcaattactactccctccgttttataatgtaaatcattctaacattatctaaattcatgttgatgttaatggatctagacatatatatccatctagattcattaccatccatatgaatatgaaaaatgctagaaagacttacattgtgaaacggaggatgtacatcctagcaaaatatcactagaatatatatagcaatggcct

SEQ ID NO: 41918 - DNA, 37498 bp, Oryza sativa
tagcccaatgcccataataatgtcatgaactgaaaatacatgagcttgatgtgtaatacagatagattatatttaaagaattgcagtgtttaacttgtactccctccgtcctaaaatataacaacttttagcactcagaatttatctcaaaatacaacaacttttctaccaacattccattcccaacccaatcacaaccctccatcattcattttttccacatacctttacttctcaaccaattacaatctctccctatttaattttacctactttcttaataaccgtatccaactcaaaaattacttatatactgggacggaggtagtatcaagtaactgctaagaattttctcaatggattaatgcatcatcatcctgaatttccggattttcttaactgcatagacaacatatatttatgtattacgttcctgaaagccaaagtttataaaacaacaaccgattttgtttcacttactcaagtacacttcatgaacagaaaacaggacaacgaattttgcttgatcattccaaggaattaaagaaacgacctcatgcctgataactctgatgcacaatcagttttctgcatgttcctagtaagtttgtcaagtcattggtctttgggcaaaattagagctttggcattggcccaacgaggtgccatattttcatgtatacaccttcttgaagggatgctcagtattgctgctagatttgatcccagctttctatggcccaatcctattgtcgatctctcttactctcttggtctctatatttatatatatatatatatatatatatatatatatatatatatatatatatatatatatatatatatatatatatacactagtacatagctgatagctagtactagaaagtaatatgtaatagacgaacagttagatcatggagatgcttctgcgactgttgtatatggtaggcttggcaggaatctggagctctcataggaatatgtcatctcttaaggcatccacaatgtgctcccaaaccaagtaataggcaatattttaatcttcataccaggtagtaagcattgtggaaccagtaaatagctactaccaagcaagagcactacaacctagtagtaaggagtaaaaaaacatttattcttttggcatgtattgatcctcatcactctcccttcatgctattggcttgggcccaccttattactagttatacattgtggaacttttaacaacaaatacctacttttactaggtcccaccttatttactactctgtcgaggagtgatcctctctagcgggagatcgtgagaccctcctttcgtgagtttggccggggaaagaagctcgcctctagaaatcgcgtatccatccccaagactcctagctagcttgcacacaaccaaattatacatgttcgggccgctatgaagcgtaataccctactcctgtgtgtaggatttagactgagagttacaagggttcctaaactcggaagaacattcttacttccctcctccacaagctcagattttctgagagtcgtccactttctcggtgggcaaggtcctccttttatacctcaagggaataacacatgcaccgcctctacctactcttctttcgggtggggacccaccctatcttgactggaactcgacccgtgctttcgcctggaagctaaaccacagcttgtccttgagcggggcccagcaccgtccctcgcctgacacgggggacagccctgtcattccctcattaataggtgaagacttgtggtggccgccgtccgaatgaccccccgatgggacgggtcatacctacctccactccgccggaagcagatgcgacgtgggagcacggttgtccatccagtcagacgtgaccggtgtcaggccggtcacagaccggtcattcttgaccatcgcgcgtcagtttagcacgccgcacatctgccccactgcattaaatgcgacagggggcagttggggcgctgcgcgcattaaaggaagttcagcctgggccccctcctcgcttgctccccccgccaaatggcggctgggcgagggcctcagggcgaagcagtgcaagggcccgaggggcatgacgtggcaccccgaggccccgaccccccggccgctcctgcggttcgcggaatgcaaggacaggaccaggctgtagggacacgtggtaggatgggaaggtagattcccctcacttcgcatacccccgggcccatatctccgacagtagccctcggcaccacatcggacattggcctcctgaggtcggtctgacgtggtgcctcacgacttcccaagctggggttgtgggcctggcagggaatctaagcggatgccgccgcatggccaggttggcgtatcaacaacaacagcggtttgaccaccacagaccgcgctgatgatgaggatgcttaaggcgtgaaaatcagggggttagttggaccacacctcgactccctcgcctgccacgcatgcggcggtactagtgacggtttgcccagattacgcccgtgaccatcgcacgccctacgccgagtgtgccgctgacaggcgcactaaatgcggggcgcggattcagtgggcaacatgatgagtggtcgtaggaaatgacgaggcgactgcaggcgcgagaatcgtgggggcaaccgagagggcgtgaaacaaggaggcgagcgagggcgaggcagggataaaaggatacggaggcggggactttgcctccttcctttcgccaactgcacactcgctccctaagccctaacattctcgccactccacgctactccgctcatcaagcccctcgtcgtttctccgccggtcatgatggctcaagatgccagcgacgcagtgcttccggcatcgcgtattatgacggatagacaccttagtctcccccgcaagatcatgccggaagacgccgccgtgagggcaggggagtcgcggccgcggccgcggtacccggagagatccgtgcacctcatgtcctttgctatggcagggttgatcccgccattctccggattcttccatgaggttttggatttctacgaaatccatgccttgcaactcgcacccaacgtcgtgatgacgctggccatcttcgctcatttgtgcgagatgttcatcggggtgcggccaacgatgcggctgttctagtctttcttcgtcccgcagctgctacaaggtgtggtggtggggggatgttacttctagccccggccaggcacagcggggcaatacatcgagagtcatctccgcaagaaatgggaggactggaagaaggactggttctacaccgcgctgccggaccaccggcgacttcggctccccggcggccctcccgaacgatccgccgcatggctggcggtttcagagctgggcgagaagtacgacgcagtgcgggatcaccttaggggcctgcgaagcctgggcctcacaggggctatggtctttagcgattacttccgccaccgcatcgcgcctctccaagatcgatcccatggcgcgtgggagtactctggacccaacgatcccatgcgcacgcatgtgggcgagcgctgggatggggcgaggaggacacgaagacggtgattcgacgggtgctgggtctggacaccgccgagcaaacactgattccagacgggatccttcccctctgcagcgaccgcgaccgggagagtatcatggctgtgatgtcggccgtcggcgccggcaggggtcggtcccgccggggcggcgccggtgacggcgctgtcggcgtgggtagcggtggcgcgaccgtaggcgggagtcggaccagcggctccggcgggggtggcagctccagggcacccggcccgagccgtggacccgggatcgactcggccagcgacccaaaagggaagcggaagatgtccaaatctcgaccgccctctcccccgcgcgaagggggcgccgagcgcgtggcggaccgaccgccggcgggccacaagcaccctgccgcgcccgaggctggatggaagaagaagcggctccggaagataggtcaaacggagccgtgtcgggggagcttcattgagcccccgaagtggactttcaaccgccctccccgcaggtatgactgccggcacccgcttcggtgctttttactcatcttggtctcttgttccttcctctttttttctttgttaacgcgatcagggttcttctgtagcgagattacttcccatgggatctcggggttcgaccctttgtaggggacaaagtccgaatgctatcgctcgcggcggcagcgtttctcccgggggcgacttcgaggctcggatccatgcggagcgccacccgggagcgggggccgagggaggtcgcggcccggaagccaaggctggaggcggccctaagcccgaggccgaggccgaaactaggggcgggcccgagcccgagcccgaggccgaatctacccgagggcccgaagcggggggcgagaggaacagccactcccccttgcacttggggcgccctcggggctggccgcgcagaaggtgggctgagagcagcccccaatctcgcgggggatccagcagcactccgtcgtcccgggggtggaccgcaactttttcttctccgactccggcaagtatggagccactcctgcaggtgctcgccgccgccgattccaccgtccgggaggggctcaatgcccaagttcaagccctggcggaagagcgagcagccctggaggcagagtgggcacagctcgctgcggaccgcgcgcgggttgacgaggggcgccgcgccgtggacgacatggtgaaggtgggacgcaaaatgtgccaagcccaactggctgaaatccaggcgcgcgaggagacgctggacatcgtcatgcgggagacggaggaagagcggcaggcagcactgattgcctcaagcgtcctggatgaagcgttgggcgacatccgcctatagtacgaggcccatgccgaggacctggcgaagagggttaaggacgcccgcgtagtccttgatgcagctgccgcccaagagcagcgggtattggaggccgatgcctcgctgcgggctcggacggcagcgctcgaggctgaacgcatggccttagatgagcatgcccgctccgcgcaggagtttgaggccacgattcgtcggtgaattgaggtccttgaccggagccagcgcgagcaggacgagcgcagccaggaacaggcacagcgagcccatgagctagagaggcgggctcaggcgctggaggagcgagcgtgcctgctagatcagcgggagtccaccttggccgcccacgagagaacggcggcggagacggaggcctcccttggccttcgtgaggaggccacagccgagcgtgaccggaccaccctcgccgcgaaagcttcggaggcccgtcgcgcggaggagctacggctccgggaagaggcgtgccgagcgcgaagccgaggtgaaccgccgtgaggtggccttgcgccggctgggcgagcaactcgcgaaacgcgaggaggccgttgccgggcgcgaggctcggcatctggagagtgctcgtgccgagtgcgcggcgatggcggcaagggcttctgagctggaggcccaggagaaggacctggtggcgggtgggcagcctggtgacgcagagttggtgagccagcttaccgcggctcagagcactcttgccgacctagagcgcctggtgcaagacaaggctggggagatcgcggcctccgccttaccaacgagatcggacccgggcagctctccgatgccgtcgatcgactggagcacgcggggcgccgagtcggcatctccgtgcgctgggatagcaagctcccgcccacacaaccagcactcgcgctctggctggacgggctggcggcggatctagagaggctggaggaggaggtcggcgagaccgtgaaatcgtcgtcggcttccttggcgcgggccgcggtggaactggtcctcgcaagccaccaagcccgcgaccctgacttcgtcccatggcgcgcactcgaggatttccccccggggaccgaggcaaaggctcgggagcaagtccgggaggcggccgacgcgatcgtctctaacttcgaggggtcggcccctcggttcaccttcgggcttgcctcggacgaggagagcaggaacggagacggtggtgatgacatcgacggcgaggactgggacgacgtggttagcagcgccggcctcgggggcccgggcactccgtgattatccccacttttaatttccttttgttgtgtgcctgcagcggacacttcttgtctttaggccatcgtgccgtcttgtctgtaaataaagcttccccttcgcactttctacccctttactttctccattgaatgcctgcggcacggaaagaagaaaaaacaagagcaaaagtatataattaacctccctgtgatcgaaatgccgtttttaccccatccgcccccgcccccaccccccccccccctcgggctcgttcttgtgaaaagataaatgcgcgctcggttcgtggtacctaagtactgaggggcaagaccgtcgccccgagggagccgcccagcgggactggccagaccgaggctacgacgaccgggggtcgaggacggccgtgtgtaggcccttccgagcccctggggttcggcgcaacctaggacgcggccctcatttaggctccctttcggcgcttttcaggtcgcccaatgccacttagggtttggagtaagcgcgaactgtcctttgaaccaggacaagccagaggaaagagtgagaaaaagggggcgtaacggcctccactttaggtggaaaaaatttattgcctggaaagggaaaaagatacaaagtaattcacagcagtagcccccgtccaaccccgcacaagccgaggggttgtgcgggggttggcccaagctcctggaaagcaaaaaatcgcgacgctatggatagaagcgatggaggtgttcgatattccaggggttaggcaactccgtgccgtcctctgtggttagtcgaacagagcctagccggagaacgccgatcactttgtatggcccttcccacattggcgagagcttgcttagccccagacgcgactgcacgcggcataggacgacgtcgccaactttcagtgaccggtcccggacgtggcgctgatggtagcgccgcaggctttgttggtagcgcgccgcacgtagggccgcgcgccttctccgctcttcaaaatagtcgaggtcgtcgcggcgaagatcatcctgcttggcctcatcgtacagcgcgacgcgaggcgatcccaaggaaagctccgaaggtaggaccgccttggcgccatacaccaggaaaaagggcgtttcccccgtggcacgacttggagtagtccgatttgcccacaacacggcgggcaactcctcgagccacgaatccccgtgtttcttcaggacgttgtacgtcttggtcttgaggcctttgaggatttcggcgttggctcgctcgacttggccgttgctcttggggtgggcgggcgaggcaaagcacaatttgatgcccatgtcgtcgcaatagtcgccgaacagctcactggtgaactgggtgccgttatctgtaatgatacggttgggcactccgaatcaggacgtgatgcccctgatgaacttgagggcggaatgcttgtcgatcttgacgaccgggtaagcttcgggccacttggtgaacttgtcgatagcgacgtataggtgctgatacccgcctcgagccgctttgaatggtccaaggatgtctagcccccagaccgtgaaaggccaagggagtgggatgacctgcaaggcttgggccggctggtgggcttgcttggcatgaaactggcacgccttgcaccgccggacccattcttgggcatcttgcaacgcagtcggccagtaaaaaccttgtcggaaggctttaccgactaaagtgcgtgaggccgaatggaccccgcactcaccctgatgggtgtcagctatgagctcgatgccttactcccgagaaacacacttcaagagtatcccgttggcggcacgccggtagagggtcccttctacaagcacgtaccgcttggagatgcgcgcgagcttctcaacttctgcgcgatcctcaggaagagtatttttgtcgagatacgcccggatgtcagtcatccaaacaacctgacgaggggggtcgtggtcgaccccctcgggccccgaggcccgcaggtcgccaagggtcggggcggagggcgtggtgtcggggtccctcgtggggttcggtcgcgccgacggctgtgcgagtctttccacgaaggtcccagggggagtggggctcgtgccgacgcaacacgcgacaactcatcagcgactgtgttgtcgcgtcggggcacgtgccggagctcgagtccgtcgaagtggcgttccatgcgccgcacttcgcggacatatgcgtccatttgtggatcggtgcactggtactctttggatacttgattcacgaccagctgggaatcgcctaggaccaggagacggcggatgcccattccggccgccgccctcaaccccgcgaggagtccttcgtattccgccatgttgttcgtggctcggaagtcgagccgaacgacgtatttgaggacgtccccgcttggcgaagtcaacgtgactccggcacctgcaccttgaaggttgagggagccgtcgaaatgcataacccagtgcccaccacgaatgtcggtgtttgggtcctctccatctccggggagggagggaacgttggacggaacagggtcatccactggggtccactccgcgatgaagtcagctaggacctagcttttgatcgcgtgccgtggttcgaagtgcaggtcgaactcagcaagctcgatggcccactttacgacccgaccggtaccctcttggttgtgcaagatttggctgagatggtaggatgtcactatggaaacccgatgtgcttagaagtagtggtgcaatttccttgaggccattaagattgcataaagcatcttctgggcctgtggatatcgggtcttcgcctctcggagtgcctcactgacaaagtagatgggccgctgcacctttcggtggagccggtccgtgctgccaggggcagatgatctggggcgcccttgcctaggggccccgggggggtctcgagtcatgtcaggaccataggcctcgggaacactcgccaaagcctcccctcctcccacgggggcctcggggtcctcctgggggttgggggcttcgggcaccgggtcttcgggggacgaagggccatcgtgagtcaagggggcctccggtccgctctcttcgcgctcgactactaggacggcactcaccgcatgggggatcgcaactaagtagagcagcaacggtttctccggccccggggcaaccaagatggggggaggagatgaggtaagctttcagctgattgagagcttgctcagcttcctccgtccacacaaatggcctggagcgcttgaggagcttgaataggggcagcgccctctctcccagcctcgatataaaccgacttagggcggccatgcatccactgacgcactgcacatccctaagcttgctgggggggcgcatcctctctatcgcgtgtattttcttgggattagcttctatgcctcgggaggagactagaaaaccaaggagtttgcccgccggcacaccgaacacacttgtcggcgttcagtttcacgcgtgtggatctaagactgtcgaaagtctcggccaaatcctgcaacaacgtgtcctagtggcgcgtctttaccaccaggtcatcgacatacgcctctatattgcgccctatctgattactcaaagtaatacgagtcatacgctgaaaactagggcctgcattctttaacccaaaaggcatagttgtataacaaaaggtgcccacaggagtaataaaggcagtttttcctcatcttccctagccatgcagatctggtgatacccagagtaggcatctagaaaacacaaaaggtcgcaccccacagtggagtcgactatctgatctatgcgtggtaaagggcagggatctttagggcatgccttgttgagatccgtatagtcgatgcacatccggagcttgccgttggccttcgggacgaccaccgggttcgccaaccactctggatggataacctcgcggatgaagtcagcctccaggagccgcgccacttcctctcggatgaaggcctgctgctccggggcttgacgctgcactttttgccggacggatcgcgcatccggccgcacggtgaggcggtgctcgatcacctccctagggaccccgggcatgtccgacggcttccatgcaaagacgtcggagtttgcccgcaggaagaagacgagcgcgctttcctatttggcgtccagggtcccgccaattttggcggtcttggacggatcgtcgccaagggggatctccttgacgggcacctcgtcagccgaggtgaggcgcttcttggaggcgcgggatgcggaggcctccggggcctgtggctccgtggccactgccaggttgtcggcgcgctgctccgcgcaggtgagggcgactttgacattgccaaagacggtgatgggaccactagggcccagcatctttatctggaggtaggcgtagtgggtggcggccatgaacttcaccaacgcaggtctgcccaggaccgcgttgtagggcagattaaggtccgccacatcgaagtcgatccgctcggtacggaagttggtggagtcgccgaaggttaccgagagctcaacgtggccgaggggccatgtgtgtcccggagtcacgccgatgaccggcagcgcggctggagcttcatccccggggccttgaacgcatcgaaggcggctggggagatgatgctcaggctggcccccccgtcaaccaggacgcgcttcatcctaatgttgtgaatggtcagggagaccacgagggccaactttccacctcgagcgagcactgttggatggtcgctcttggtcaaaggtgagcttcacctccgaccagcgtgccttccgagccgcttcgtgggtcgggacggcggccagaagctctcgcctcatagccttgaagcctcggcgggaggtgtgaacgcaagccccctcctccccccggtcgattgtggcgacggttccctgaggtatctggaactccagatcctcgctgttatcgccatcatcggcgggagccttcttcttggcctcccctcgcaggtcttcggttggggtcgcgggggctttgccctctcgtcgaccctgccgcttctcctcatcggctttctggaaccgctcggccaaattcttgaccgagcggcagtcggcgagattgtgccgataagtgttgtgcaccgagcaccacttgtctgccgatcggccctcgccggatggagcagtggagctcggcttgtcgccggtggcctttcccttgcgcggggcccgtgtgggcccatcagccgcaaggacatggccctcgtcatcggagcgggccggtttccttttgcccctcctatctcgccgcttagagaggggaacagactcgggggtagccgcagccgccgcgccggtgccgggggagttccaggcccacacctcctccttccgagccaccttgtccgccagctcgaagagctcggcggtgatcttggtctccttggaggcgatcttctccagcatgcggttatgccgcacgccattccgaaacgcataaacgaccgcatgggccggaatgcatggaatagtgttgcggacctggcagaagcgctgtatgtacgagcggagggactcatcgtccttccgccgcacagcgtgcaggtccgcctcttctcttgggcggggatatgtgccctgaaagtttgtgacgaactgctggtacaggtcctcccaagagtggatggagtcggggggctgggtcatcagccagccgcacgcctgacccttgagggccatggggaaataattcgccatgacccagtcatcgccccctgctgccacgatgatcgtggtttagatctggaggaactcggagggattcatgctgccatcatacttctccgtgaggttggggcgaaacttcgggggcaaccggacattccgaagactcgccacgaaggccctacaaccagtccctccaggggtgagcgtggggggagggctgtctcgtgaggaggaacgcggcactccagatgaggaggcgccttcccccatgcgggtagctcggcgctcgtcccggcgtcgctcgatattgattcgagcatcctgctccccgtagagactatcgggacacctccggcttcccgaggcccccgacgatgttggagccgtggaccgcctcgaggccgtggctgatcgacgggccctcctcctcgctgacgaggagagggtaatgggggtacgcgacgtaccggtgacggcgggtcggccgcccgcggccaactgccgctgggcagtggtgaccaatttggccacgtcgtccaaccagcgctggacaggggtctccggctccgagttcacggggggatgccgcagaagggcacccgccgcctgaagcgtgcctcggggcgagccgccgtcaccgtaagtgaggcggcgccatgccccgatgcgtcgtggcctccctccacccgggggcggggagagggccaaaccacccgaacggttggggtcctccctccgcgaggggtcgtggcggggaggagttggagagttgcggcggtggtgacgagggccgtggctctcgctagcatcctcactcccagacgaagtgggggtgaacaccaccgcctcctcctccaggacctcgaccatgatcatcgagggtcaagggaaacttgggacggaaggaaacgacttctcgttaaagcgcacgacttccccctacctggcgcaccagctgtcgaggagtgatcctctctagcagaagatcgtgagacccccctcccttcatgagttcggccgggggaagaagctcgcctctagaaatcgcgtatccatccccaaggctcctagctagctcgcacacaaccaaattatacaggttcgggccgctatgaagcgtaataccctactcctgtgtgtgggatttagactgagagttacaacagttcctaaactcgggagaacattcttacttccctcctccacaagctcagattttctgagagtcatccactttctcggtgggcaaggtcctccttttatacctcaaggggataccacatgcaccgcctctacctactcttctttcgggtggggacccaccctatcttgactggaactccacccgtgccttcgcctggaagctaaaccacagcttgtccttgagcggggcccagcgtcgtccctcgcctgacatggggaacagccctgtcattccctcattaataggtgaagacttgtggtggccgccgtccgaatgaccccccgatgggacgggtcatacctacctccactccgccggaagcagatgcgacgtgggagcacggttgtccgtccagtcagacgtgaccggcgtcaggccggtcacagaccggtcattcttgaccattgtgcgtcagtttagcacgccgcacgtttgccccactgcattaaatgcgatagggggcagttggggcgctgcacgcattaaaggaagttcagcctgggccccctcctcgcttgctccccccgccaaacggcggctgggcgagggcctcgaggcgaagaagtgcaagggcccgaggggcatgatgtggcaccccgaggccccgactccccggccgctcctgcggttcgcggaatgcggggacaggaccaggctatagggatacgtggcaggatgggaaggtagattcccctcacttcgtatacccccgggcccatatctccgacatactccctccattctaaattgatctacatatttcataggtacaacaagaccaagaaaagctaataactctctcatactatatttactctagcaacaaactcaattcatgcatcatccccactacttcctagccaatagcaaatcaagatattgcatgtgtggtataaatacttgtgtgcatggatgcatgaatcaatatccatttactccaatgcataaataacgaatagacttaataaatgaacacaaatatatagattatttaggaataaccttaaaaaaatatatgtagatcgatttggaatggagggcgtagttggtaaatatacattggtgatgcccttaggaatttggaaagagatgccccatggtagatgccattatatgcaagttcctacctttgtctttctttctagttatgtacttcggattgactcggatagtatacccatttgttatacccctaatgatatatctaccttgtgcaaaacttggagagaggcaacacaaatatgctaccttcattcaggcaatcttaaaatatacgacatttatttcttctctaatcgttgtgacgacttcttgaatgtgtaggttttggaacttgggataggcatgccatttagttatacttgtggataaaattggcacaaatgaaaataccaaagaataataaagttcaacattaataatgtgtgtattcatatccagatatttttccaacatcttagagccctgagatgagtgagttcttgacctgacttttgtacacaagctagttgatggcaatgttccattcgtttcacaaatggagggtgcatgaagtcatcaagaccatgagtgcaagcaaggaacatactagtgtagacatcatatacaagagttattattacccaaaattaattacttgcagagatgaacaattactttaagcaagactgcaaataaagtcaacaactacaactactagctatagagaggaagtgcagtattaattgtcaccaaattgcctaatggattctttatatggaggggtatatcttgtgggcactctgtccacttgtgtgaacagactgttctatgcatccttgatgcagagaccaaaggtatcacacaggtctcgttcgattctccaatatggatgaagattaagtgcacacgcaaaagacataagtcattaccacataattaatcgaattttaattattaaaaacttgaaaaagagatttattctattttttagcaacttctatgtagaaagtttttatactaaaaacacattgtttagcagtttgaaaagtgtgttaacggaaaacgaggaaacatttgtatcttgttggagttttagaaaaaaaaacgaggaaacactcttgcatcatctataagaaaatcgctaaactagtcatgcaatatctttgagttaggagtgctgagaagggaaaaaaggactcatttaaaatggttgttcaaattcacgtggatttcatggaatgagagttacttgttggctaggataggcctaggaggcatctggagttgttgggttactgtgaacctagcatacactataatagatagaaacattgtggtattaattggttgcaattcgtcttagtttttcaaaatgataatgttatatgcatgtgagatatgtgcttaccggtggggggcgaaatttcaatccctggttcaaagtggaatggtaaatttgagtaggcctgtctgtggagcaatgtaactgttttgttaagaataaaatgaattggattttagactgttggatcaccatccaacgatccagacctgcccactgtttactagtataactttaaactgaagtgagcagatgactaaacatttacgaactatggtcttcaaatatctgcaggtgctgaataattgcacgaaattaccaaatcagtatatcttacgcaatatcgtgatctcctatggcaggcagttaatttggcccataaaaagagcaggtgaagattcagaaatagagatgcaaactgcagctactgcaatgaaccgttcgtggtgcccgattgatctagcttagcgtctctgcaagaatggtatatgttcaggaggcatcaggaaatttcatgcttaaaaaacattggtacgtaattacccaatgttttaggagcaaacccctcatttgagtctgactcttatgtggatcagttactgtccctcggatggtcaatcagaactcatttctggtacaagcagagcagggagagtagaggtaactgagcttttcgtttcattacgcagcaacttacagttaagaaagaaatacaagtgtttatcctacactcctgagagaagtatctatgcggtaaattggaagaaaaaaaaacttcctagtaaaagttctgtacaacggctgatttatacaagtagggttaattattggaagttcacatatttgattttatctccaatcattcagtcatgtactctgaaactgtgtaataagtatgttatgttaactcaatattacctccgtcccaaaataagtgcagtcgtggatatccgtatccaacgtttaaacgtttgtccgtcttatttgaaaaatttaaaaaattagtcacacataaattactattcatgttttatcatccaataacaacaaaaatattaatcataaaaaaatttcaaataagccgaacggttaaatgctggacataaatagtgcaaaactgcacttattttgggacggatagagtactaattctcttgtcctagcattttttttaaacaatgggtactcaaaattacttcccaagatgtacgattactttaacaccaataagaatatcaaccattggatctacataaaatggatgatccaattaatcttggagtaaagtaaaagaaatccattaactttaactttaactaagtagctgactaaacatttacgggctaagattgaatgctgacatgtacgcacatccaagcaatggtagtctcacaaccgagcttcaaatattaggtgctgaataattccacgaaaccaaaggagtacatcttatttatagttgtatacctattggcagagaccaaagatggaaatcatttttattattttaaaaaaaaacagtacatcttacgcaaaatcgtgatcccctgcggtagtttgtctcataaaaagagcaagtgaagattgaggaatagagatatgcaagctgatcaagctaagctagtgaaatgaaccgatcatggtgtccgatcgatctaatgtcttaatttacaattgtaggtttgtgaagcatcaggaattctcatgtttaaaggtttgtcgttgcccaagctttcaggcgcgattgctcgagttggagtccgactcctcgtcctagccatgtagttcaaatactgtccctcggatagtcaatcagaagctaagtcatctatggttatcttcattcagatttctctcaaatcattcagggctgcactttgaaattgtgtaattataagtttgtcatgttaactcgatactaattctcttctccaagtatatatgtatagaaccttatttcccttattttctaaagcaccataagtttttcaactactaacttgaaagtttggtgtacaaaaattgaccaaggaaaacggaacactgtacatgcgactgtttgcacacatgcacatttcatgtgcatgtggtacatccttgttaatttcgacaggttttgatccagagatttctgcaattttcagaggttcagagccctaattaggtcctagatctgataaggtgtcacttgattaagagagatatgatgacaattctgctgcctaattttgtatgttatctgaatatattcctaatcatgatgatctatcgcatttgagattaatatagaatatcatgcaaacggcgacctttctcacatcttcagccattattggagatcaagagagtgctatatgtgcatggccatcagcatcatgagtgcaagaaacaatttactggtcttcctgatttgcccaaatgagcatgacagcaacataatttttttttttttttggtgaggagagacagcaacataattaaccattgtaaattggacaccaaaagttcattccttttgaagagtactagggtttggggaagggggttagggttgtttttgttttgcaaaaacacccctaaccttctagttttcagagcgcagtccaattttttgatttttcgcttcttcctatagaatattgttttcttcagaggtcctctaagtaagaaagcacaacgttaaaactaaggcctagggacctattacaaattattaggtaaatgaagggcgtttttgcaaaatcgccagcgacgacgcggacgcccgagaactcgcaaaaaccacccgccatccagcgcctcgctgacgcgtcggcacacgccggtggccacgccagcgtaaaattctctggagggggcaaattcccggaggtttgaagtatttcaattatcttcttcgcaaaaaattccatgtatactcactatcttaagcgcaacagtaacatcgatttttccatactcactatcttgagataagtggaccaagcaaaacatcgaattcgtccacagacccacttatcagtgaccatcgcgaaaattcattcttactcctttgtgactagcatattggactgcctgtaattaaagaggtgtctgaaaggaaggcttctcttacaaactagcttgtgcacacaaaacagtggtacatatgctagcaagatagccctgaattgcatccggatattttcgctggatgccaaccgcaattgctgacctaaaagctagcgaaagttgttgtggtttgatgtcgctgccaagaaactattggttgctagtggccacccttttggtgatgagcctcctcttctttttcactcattcaaagaatagtatataaattcaccacgtgagcttctagatgttgcttcacagattaggcctcttctcaagaccacatgattgcaggagcttcttatctgattggctgcatgacatcctcaccgttttttttcccctttcatagtagtaatcttgtgtgctgttccctccgcttcttaatatatacataacattattaacttttaaacatttgtcttgttaaaagattatataaatttcaggtaaaaagttatagaaatatgcaacaatataaatctttcttaaagtatcaaaacagatcacaacaaaataaatgttaattacataatttttaataagataaatggtcataaatttatggtaagagttaataatgtcatatattaaaaactagagagagtaggatatatcgcttcttaccatgcaaaaataaagagagagatatactaaaatatgtgtgtcttcagcagaagtgagatcagaatcagatacaatgaaccataattgtccctatgtttgggtttttttagtactatagacaacagctgtcagagagattgctggagatgcatcatgcatgtgagtaatgagcatgtacggttcaactgcaactagatccagcacgagtttttttctatcttttatttaggggtcaaagcttatcatctttcaaggttcagacttgcaggaaggagaggactctgaagaacacacttagtggagggcacattttcagttatctttgaaattcttgctcatggtaatgcaaaagcatgtgcttgtcactccggtttcaacacagttcacttgtgacgtcagaaagaccattctggtcatagccttcaggctactgcatcataaccaacaatggttggcacactgcacagaaaattgtccattcacaaacttgtttggactttgaagaacatatttaagccatgaaaacctgaaaaggttgagtttctcaactggtgaacaaattttcagcttctactactatagattttactggtgaacaatttatttcagcttccacttctcatagtaacttctagtttattttctagattttacaactatagattctcataatacaggttagaatctaggccgtttaggagagatgaaaattctatgagaagctgcaacttctaatagctccctcgactagagtggtaacatatatgacattttaacgttatgcattttaaggtaaagaactcagagagacaccacctatccatgaatcaaacatggagggcaaaagagttccttgatctttcgaagtatgaagactgtttcagtactaagctcctagtgactgattagcttgatttaatcccctgaattggacatgaggataacttatatatgtcctctaaaatcagttgaaatgttgaggacgatgtcagtggttagagtgaagcatcaagtgatcgacttaaaagacaaaataaccttcaagttaggggaaattgacatggatcctgaaggtgacaccctcttgctgcaaccaccacacaaagttgcccctcacacaaagccattcatcctccattgtcgaaacaagatttcggcaataataaaaagggtagctatcaagctaggaaagtggatgggtttggagacaaggaattttatacaggttcaggccttcttattcaagaagtaataccctactcctgtccggggatgattccgccgagtgtgttattgattgtataaactggaaaaaagaaccggcccccaagaggcacacggaccctccttatataggggaaggaatccgctttacaaaatatagtccatatcctaacggaatatgggattatagataaaatacaatcgtaaccgactaggatcccgggtatttccttgacatacaagttaaaaactaacccgagtccccataaagatattctatctatatttggtaccatatatccgactaaagtataactgtcatacagatatggggtatccataatctccacagtagcccccgagaccttcgcagttgacgaaataaccttctcgaaacaaaaaacaatagtccgagtgcttcaattcaacttgctctagcttgccgagtactaaaaatcaaaaactgtgaagggcgaaaataaaacatggtgcatcgagtagatgcacctaattaggtgtagcccccgactatgtgattagttgaaaaactaaacatatagtcaagaaccaagtggttttatagcgaagcacgcatggtacttagtaagatacccagccacctgcttctcaacttgaacacaccaaggacaaaaaatacaagaagggccgagtgataaacactcaaaggtccagaaatagacatgtttgataggaatccgggtaaaaatctcataaaatgacccaccaaacatgatagaaaatcatggtaattaatgagtctaatagcttaggctgtgacccttaccataaccaaaataagcatataacatgctaaaagaatgactattaataaaccagtcatctcaaatcaacccaaacagcttttgcaacctaataaagcttacaaaaaaggatataacacctttctgtcgggcacctttttatgtgcatcataataatttcaaagaattattaaatcgcgttaaaaaggattttaacagcattgggccacaccattgtgaacacaaattgccaaagcaaaaagtgcctaagtccttagggatcacaacaggccacgctgattatagtattgggctgaagtactgtacaggcccaggcccattagtactcccgataccctaataataccaaagtgaaaaacgtctctttgtcttccccgccgagactctcgccattttccccatttcctgctacagtgtaaaactgcgccgggcaaactagggttcatcaatccgctccaatccactctcaaaaactttacaaaatttctccccgcatccatcgctccgattccccatccctttctagccatatctcgaactaaatcagaccatccagttcacattcatggcggaagaaagagaaagcttcgagagtcagtgggcgccctccaatgtgacggaagacaatctgaaggaaatggtggcgcacggtgttcttccagcaaaagagatcattgggtggcgaccggcatttggtgaggcattcccgacccccgatacacacgaaatcgtagtatttgctcatttcttctatggcggattttctcttccaacctcaagatttttccggggcattctgaacttctacgggattagcttgcatcatctgaatccaaacttcatagtgcatattgccaattttattcatgcatgcgaagcttttctgggcattaggcctcatttcgccttgttccgccgcatcttcttcctcaagccccagccaaataagagcaaaccatgcgtcgttgggggtgctggtttccaactcaggggaacactaagccaaaaatacttctccatgcccttcaagacctcaaataaaggctggcacgcaaactggttttatgttcaaaaccccgagcctgttcttcccgagtactcctgtcttcctccagtttatcgggatacttggaactcactgccaacgggagatgaagctgcacaagcagtagaactgatggagaggatgataaagctgaaagagcagggcctttaaggagaacaaatcacccggcactttatcaagtgtcggttagctccaatcaaagaaagatctcgcacagcctttgaatttgacggcaagcatgacccaaaccgtgaagatccagattctcttgacttcaaggtcatgaaggaaaggatgtataagatcttctcaaacgccatcgttgtcagctactcacacttgctgccagtcgtaccgttcaatgcattcaatcctcctccaccggtacgtattcatacacttcaacctttctcaaaatatgatcttgttttcttgttgaatcagttaacaatgaaggatattacacccaggagtttgctttgatgaagttggatcccccaatcgctcaacgccgatctccccgccatcaaactgggcaagggagcggaggaccaagaattcggtctgaaactcaaccaagtgcttctgatccagtcggccagtcagattcttgaaagagaaagctggttctaagtgatgacgaagccgatgataccaccaggaggcctggagaccgagagacaaccaagaaactaccaaaacaggctactccaaggaagagaaacatccagtcgccctgtgccaaagatcaggaagtcttctaggtgcaactcatataacgatctctcttgcattgatgcacacccattgcggcaataatactgataatcaaatttgcaggaaaccatctaatatagatccgtctgggaaagactctgacccgactaacacggacacaagttcttccaaagaaaccgggccaactgctggggatcatccgaggacaatcagccggcaaccgataatgtagaatccggtgatcaaccccggactggaaccagtcggccgaagccgaagccggatttaatcaggagcccccgactggaaaccagtcggacgcagggccaagccaagagataaccagaagtcgaaacccaagcagacagccctcgcggacaaaacgccagcaataaccagagatctggatctcctttaaaggcatccgaatccactcatcctcgtccagaaatcaatacgggtaaacactttgtctgaaaccatgttgacctgaataactctgatcaattgtctaacctttgtcagtgaatacattaggaccaatgattggtgatgaagaagaaatcccccgtatacgagcaaccgaagattcgtgccctcccattctggtcaagtggtgggatgacaacttgcaacctcaaggaattgtaataaaccggcaaaaagaagacgaagaggtctgcctactgaaaaaggcactcaaccaagcgactcgcattgtaaatgtaagttccttgacgcctgacctcagccatcttgtttgccatctggctcgagcgctgattcatcttaggaacgaggcgaaaaccgcgaccctagagagaatagtcctcatcttggaaccctcgaagccaccaggagtcaactgcacgaggccagagaacttgccaagaagaatgaacacgatctgagggatcgtattgctgagctctaggagtccaatttcgaactgagtggctcatcaaaaggttcgcgcaaactctgcccaactgatttgcgctgttatctctgtaatcttgattaaccgaagttaatgtagtgcaagctgccaagatatctcaactagagaagcagatccaaactctggaaaatgacaaggctgagctggcaagacagagggattcggctttaaaggaggttgaaggtaccaataatcaatacttcgaaagccattatcttctatatgctgattcattaatgtgaatctgttgatgcagaccgcaagatcaaatctcaagcacagtttgatgtcttagttgacaagatcaacaagcttgaaggagccagggataaagtcgctaatgccgctactccactcatccaggccatgttcttcaataacgccggttcgagtacacttgatgctaccgaaatcttcgacaagctaagagtcgctccagatacttatttcaagaacatcaaagaagctggaagtatgggagcaagtctggcgttggtgataaccaaatccctttatccaagggttgatatggatgccattgatggctttgcagacaggacgagcgaagaagctgcgcttgacctcatcagtaatgcgcagaaagccgctgacaagattgctgctgatgtagttgagagattccaagatgtcgaccttcagccgactgggtttgataagtccaacgatgaaaaaactgatactgattgatataacaatgattttgatgatcaatgacggtggaggctcaatttgtacaatactgatgaatttatgctatgcttggtgttccatacttagcttctgatttcttaaaagcctttgtgaagccttattgagcctaaaacccgcaaaagctattaaaaaccttcagtcctcattagctaagttgaaagaccaaacagggcaatgataaatcaagtaagcaaattgaattgataaaaatcacactccattattattatagtagccccctgactgaaaacttcaaggaaaaacttgaagttagcagtcaaagaggaaagatccaaacgaaatgcctaagcgtaaaatcgacgaaggtgttcaatattccaagaattgttgatgagagtatcgtcttcgcgcttgagtcgataagaacctggccgagtgacttcagcaattatgaacggtccttcccataagggagataatttatgccgatcctgtgttgtttgaattttcctcagaaccaggtcgccgactaaaaaggctcgcgatcgaacattccgattatgataacggcgcaacccttgcaaatatcgagtcgactgaattaaagctgcttctcgggcttcttctagtcgattgatgttgtctactcggccctcttcatagccctcctcgttgaagttccgaaatcgtagtgattcaaattccacttcactcggcaacattgcttctgcgccataaaccaaaaagaacggcgactggccggtagcccgactaggagtagtgcgtaaataccaaagtacggacggcagctgatctacccacttgccagcatagggacgtagtcggtcaaaaactcgtgctttgatcccttaaagtatcatgccgttagcgcgctcgacttgtccgttactcatagggtgtgccacggaggcgtaacaaattttaatgccgaagtcttcacaaaagtctttaaatgctccgccagtgaattgagtgccattatcagtgatgatccgattaggtaccccaaaccgatgcacaatgttgatgaaaaaatctctagctttatctgctgtgattgtgatgaccggtttagcctcaatccacttggagaatttgtcgatagccacaaagagatgcgtgtaaccgccgactgcccttttaaacgggccgaccatgtcaagcccccagaccgcaaacggccaggacaacgggatggtttgcaactcttgggctggcaaatgagtttgcctggcaaaaaattgacaaccttcgcatgtccgcacaatcttgtccgcatcggacacagctgtaggccagaaaaaaccttgccggtaagctttgccgacaatagtccgtgcagcagcatgattaccacaaataccagaatgtatatccttcaacaactgtctcccttcttccaaagacacacagcgctgcagtattcctgatggacttttcttgtacagctcagtctcatgaataatgtaaagtctgttgcgcctggaaatccgctcggcttcatttttgtcttgagggagttcttgtttgctcagaaattttgtaaatggttctctccagtcagcttcgatcatgcttacgccttgaatatccatggctttgactgtctcttttctgggtacggtcggttcgtaaagatgttcgacgaacacatctgaaggagctgcttcccgttttgaaccaaaattggccagtctgtcggctgcctcattgttatgtcggagaacatgggtgagctcgagtccatcgaatttattttccaacttgcgtacctcttgtcgataagcggtcatattatcatctagacatgaccactctttcatgacttgattaacaaccaactgagagtctccaaggacgattaatcggcgaatgcctaaagagattgcaatccttaatccatggagtagtgcctcgtattccgccacgtcatgggacgcagaaaaaggtatccacaatacgtagcccaatctttctccagtcggggagattaaaacaaccccagctccagtgcctgtaagcctcttcgacccatcaaaatgcatagtccaatattccatcttttcctctggcatgtcttcttggcactcggtccactcggcaaggaaatcagctaaagcttgtgacttgatcgaagttcgtggcttgaacgatatgtccgaagacatcaattctaaagcccatttcgcgatccatccgtttgcttcgcggttataaagtatatccctgagtggaaacgatgtgactaccgtgaccgggtgactttgaaagtagtgagataatttcctgacggtaattaagacaccatatagtaacttttgaacctgaggatatcttgtcttggagtgggctaaaacctcgctaacgaaataaattggacgttggactttttgaatatggccttcctcttcacgctcgacaaccaggaccgtactcacaacctgggaggtcgccgacacatataacagtagcggctcttgcggatgtggcgaggccaaaactggtggagtggtgagaagtttcttgaagtcttcaaaggctttctgtgcttcgggtccccactggaaattgttagtcttcttcagcaacttgaagaagggcatcccctgctcaccgagtcgtgagacgaaccggctgagcgccgccatgcaaccagtcagcttttggacgtcttttcgggagcttggcggtttcatgttgaggatggcgttgattttctccgggttggcctgtatgcctctttgagaaaccataaatccgagcaatctccctgacggtactccgaagatgcacttttccgggtttagtttcatcttgaaagcatgaatgcttgtaaaagtttcttctaaatccgcaatcaggtcatccttctgcttggtcttgacgactacatcatcaacataagcttcaacattgcgaccgatctgagttgaaaagcatctttgaatcatgcgttgataggtcgctcctgcattcttcaatccaaagggcatggtgatgtagcagtaggccccaaagggtgtaataaacgaggtcttcaagcagtcggattcttttagtcggatctgatgatatcccgagtaacagtccaagaagctgagtaactcgcagccggccgttgaatcaaccacctggtcaatgcgaggtaacccaaaagggtctttgggacaagatttgttgaggtcggtataatcgacacacatgcgccattgccctgtctttttccgaaccaagactgggttagctagccagtcaggatgaaggacttccttaatgaagcctgctgctaacagcttggttaattcctccttgatcgcatccttcctatcctgtgcaaaacggcggagtcgttgcttgatgggtttggcgtcttccttaacatgtaaagagtgctcaatcacctctctggggataccatgcatatcggatggtttccacgcaaaaatatctttattattctgaagaaaggtgatgagcgcgctttcctatttacaatctaactcagcgcctattacagcagtcttatcaagatcagagggatctaagggaatcttttttgtcttggcatcactttcttcggtcttcgtcagcttggttgcaggcacttctccctcgcttgccgtggtcgcagtcagccggatctcttcgcgggcaagagtagtctcgtgggtttgggccatctcgcaactttctttgtcacatgtgagggcctgcttgatgtcgctccgtagtgatatgactcctcgaggaccaggcatcttcatcgtcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcattgccaccgtcgataaaagtccgtcggagcttgacattgcgaaccactgggtctagtaccagggggtaccggaccactcggtcgggatgatctgagcggtcgaacttaattgctatctctgaccaccgaagatattggggcgtattaggctgaaccgcattgatctcccgttctgttagcttctgttttctcttagactcataagctaggggtccgccgaagatgtgattaagttctttgcgatgatcttgaaaaccaggcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcggacattgggagttcattatcttgtcgaaggtgttgacgcgggaacgttgtcgggaagatggagaggtggtcgccacaagttcttcgggcttacgcttgcgatccttgtggttgttacttccactccctcctgcggtcggcgtatccttctttggcttccaagtggtgcccgactgcttggacgccgtgatagcatcttcggctttggcatactcattggctttttcaaacatctgtgtgaccgtcttgggaggtttgcgtccgaacttgccgactaggtcctcgtggcgaatgcctttagtaaaggcagcgatgatgacgtcgtcggtgatgtcggagatcttgttgcgttgctcagagaagcgtcgaatgtaatctcgaagagattctccagacttctgaacgatgttgtagagatcaaagtgtgtaccgggccgttcaaaagtgccttggaagttggcgatgaagtgatcgcgtagctctgcccatgatccgatcgtgccgcggggtagcccgtgaagccatgaccgggcagaatccgctaaggccacaagtagatagttcgccatggctttgctgtctcctcctgctgcgcggattgcgagaccatagacggtgagccaagactcagggttggtggtgccgtcatatttctcgattccagtcggcttaaagccggctggccaatccactcgacacaggtcgcttgtgaaggcagcaactccgtccacgtcgtcgtcgtagcgatctggtgaatgatggcctcttgctgcacagcgctgattgatggtatcgcgaagatcgatggggcgccttcgatgtggggagtgtggtcgttcaactcggcgctccctatatcgctcgggaggcgagcgaacggaccgttcatcatgtcccctgctcctgcgactagattcgacgccggcaatgctgaggcttggctggtgatagtcttgagatcgaagatgagggactcggctaccagtcagggtgcgggtgcttgcggagttggctggaaccgaggcagcgatcatggtcttcgtctggttcaagatgttgactacatgatcagcttggttgagtgcgtcttccttgaggagggtgtcgaggagagtgatcgctgcaaccgcgttctgctggggggtgcgaaaaaccgctgtcccatcgacgtcttgttgcccaatgagctctctcgctcgccgcccagattccaaggcatgttgtcgtcgatcttcagcctcctttgcaatccgttcgtgatcttgttgctcacgctgtagtcgttctcgctcttgtcgctgtcgctcttcctccagtcggcgacgttcagcttcttgccgtgcgcgatctttgtccgctcctcaggcttggcgctgttcctccgtttcgttgtcagccatgaatacgccgaagaagaggggcgtgtagttatcctcatagctgtcgtcgaagttgtcgaggtcaccgtggtcgtagtggtagccgaagtcgtcgtagtcgaggatctcggttggtcgagaactgacgccgggggagctgaggtagccatccaactcttccgtcgagactgtcccaagaggttggagtataacgccaacctccctggatctagatcggatcggggctaaagccggagctcgcctagatcttcgagtgggagatgtcttgactgtgaagacagcggccaaatcatcaggaagtttcatcaggattgagggataggacccgtcgtcttgatctggtcgtggaaaaatagattggatctcgtccgagtggtttgaagccgactcgggagagatgatcttggcgtaggctttggccgagttcggaataccgaacggcatggggacctggtctctccccgactggtttgaatccgagtcaaggagagagatcttgccgaagtttttggtgatgaagttgaggctgccgaaccggaacgcctgcccgggagggaaggcgaagtcgttggtgacagaaacggaacccatcgcacttagtcggcaaaaacttgacgctgcccctacctggcgcgccaactgtcgaaacaagatttcggcaataataaaagggggtagctatcaagttaggaaagtggatgggtttggagacaaggaattttatacaggttcaggccttcttattcaagaagtaataccctactcctgtccagggatgattccgccgagtgtgttattgattgtataaactagaaaaaagaaccgccccccaagaggcacacggaccctccttatataggggaaggaatccgctttacaaaatacagtccatatcctaacggaatatgggattatagataaaatacaatcgtaaccgactaggatcccgggtatttccttgacatacaagttaaaaactaacccgagtccccataaaaatattctatctatatttggtaccatatatccgactaaagtataactgtcatatagatatgaggtatccataatctccacatccattttttatattcatcacctcaccaattacattcaaccctgcaatattccccactatactccaccttatataaagctgtaactttcaagtaaggtaatttctcccaataaatctattgatggtactgtgatttcgatgtcgcttgataaatggagccaacaattgtggcacacttttcctgtcatcttgcatcagaaaatattccaccgtcgagggtttgaaatttcgttttacatatttacgagatctcggaaatttcaaacaactttttagtaactttaaacaaactttgactaaattcaaaaaaacataatttcagacgaattagttgcgtgccggaggagtccaagattttagaaatttcaaacactcgtccttcgtattaagatcatgcatgcaaccaaataggccctaaccgacgacgaagacgatgggtactatgaacacgacctgaagagctctttttatctcctgtgtcacacgaggccttattaattaaaaagacaatcattcggctaagaaaagcgatgggttcacttaagatagagaatcagaattgcaattgccatctgcagctgctgctgcgtcatattccctggtaaatgcagcagaaggaatcgtttttttgttcactgccgtgtagcctctgctgcctcgtgccaggacacaaattggcactgtaaagccacatctgcatacacacacggcaaaaggcagcaaactgtgatcacatccatccatcttgtaatggttttgattgctgcaaagcaacaattcctcctttttgacctccccccccccccccctcgtttgaattcgatttccgcttcgattgcgatcatgattcgccttatttcagacttcagtcgaaaacaagctaccatgtagatgaaaaaccaaaaatgatctaacaaaataacactaggtggaaagtttggtactataccacaaattaagtctcgaaagtatggtgatacgccttgtggcaagtcatatggtttcacctgtagttgattataagccgtaaagattactagtgacttacaaataatttatggataaaacttttacatatgtgttcttagtgacttaaaagctaatgttgaaaattaaagtatgataaaaaaacataaaaattaactctaaaattaagttttaaaatttaaatttttgttgcgattgataagctgaaaagaaaatgatgaaaggtctgaaattagattcatgtattcatctgtcacacatgtggttttacaaataaattcacatctagctcggatgtatgtgaaatggccacaattttcagcaatcaaaaaaaaatttgtcccttcttcaatttattcttgtgtggtagtagatggagtttatagtcaaggtccatggcctgctggtccatggtccaaaactttgaccaggttcattgaagggaatcaaaacttaaggaattataattaagctgataattttaatgggaaaaaaccatttgggagaaagggacggttggattggatgttgcagctggatggcatattctaattgcaaggtgacaacaactcacatatttagcatgtgctcattagcatctatatatctatccaataattctactgctttcagtgctttggcatctccatggcattggtcagtttttttcgtagtaaaaaacactgttgtgattgtcctgaagatactggatggctacatctatttgcaatgggagaatttactatttggaatacgttggatgaattctaatttagttgttcctaacataatagtgatatgagtgtaaatttgttactgtatgccacgatgaaacacaaatattataaatttttcataggcgatggtgaaattttatggccagaatcaattcagaaaagactttcacttgctatatattatactatgtcacatcatatattatataaccactttgaggaaaattgtgggtttcgtgaattaaaaaaaagtatttcagcagagtccatattcttagacactctttcttcatataaaattaaagcttgttctattcacaccttggaggataaaatataaaaccctacaataatgttcacttttagaaatatactggccggtggaacatcacacgtgcttgcagagtgagaggagttcagacagtgtggccgagtttagtccaacttttccatcacattaaaattttcccacacacaaacttttaactttttcattacattgtttcaatttcaaccaaactttcaattttagcgtgaactaaacacacccatattgaaggcttgtaaatgctttgtaggttatgctacagttatggccggatatcaggccatttagccgacttcttctcagtttcgtcaccatcatcacttgtcatgttcggcttcattggcatgttcggcttcaggcagagcaaccatgctgacctactgtgatgactgatgatcaaggctatactgaatttggaatggtatatgatgaatcctggaaggtcctcaaaccgcgttcctttcttttgagatccacccatgtataggagtgaccgtgctttaccttatcagtgtcggttcgtaatagccatatcagggccggttttggatctggttgttgtcgttggcaacagtacatgatgaatccgagagggtccttgaatttctctttctttcaagatccctccattcgatctacatatatgttgtcttttaatttcaatggttattgttcatcataaattgatgttaccaaaggagacgtttaacctcaaaagttctaattaataataactaacaaggacaagcctgtatacatccagttggatgtagagcatagattttttaatccattttataaaaaacaagtaacaagaatcgggagatctcaaaaatgttgcgataatctctcgcaaattcaacaaccttttaattccttcgtaccaccattgatctagaccaagaacagagagattatgattagattgggaaacaaaaggacatggactcctcctttgggcatgtcacaaaacaataatacaagagggcagtgtcctttggtggattggattgcttggtcatagcccatagagaagtttgttgatgctcatttaattgctcaagtactgctcatgaaagtccccatgatgctattgtcatgccctgctatttatgatgtatagatatcctgatcttctcttctttctagcagtatagcaaacagagtcaacagaggtggacgcagggaaaaagaaaatcaaaggcaaggaggcgtaggcaatgactttcttcaacaatatggcttgatggatagccatatgtgctagggatcatcttgtttttcctcttcttttttgtttgtaaggtaatgtatattgcgcacatacagacgtacatgtgcatgcatatatagatacaattttttgcattcggatcatacggacgaggatgcacatcatcttccaagcaaggtgcgtgacaaactatcttcagtaacatgcatcttaatttcaactcaacggatgtggtttcggctccccttctaggatgtactttctccgtcccaaaataaatcaacctcatacgggatgtggcacatactagtacgatgaatctggatacaacacaaagatatccggattcatcatactagaatgtgttacatcatatacgagattggtttattttgagacgaagggagtagactatagtgccaatcatgatcatcattaccccacccaaccacacacacataaaataccaccatagacaaagtcaccgtaacggcaccaccaattcaacacttagttatgttaacatgctcgtacgtgaaattctgcaagcgatgtgtggtggaatgccatcgaaggcgacgtcctcattgcctagctaggttccttgtattattattgggaatccatttttttctccaccattgtggtgcctttgacgcatctcctccttcaccctaagcatatatatctagtactcacgtactacttccaccactgcacccgtgctaacctataagtctgcattcatctgacctactacaaattctctagaaggaatccaactcctatctaaaattaaccgtgtcgttgtaaggtttttgggtccggtttcctttataaactgaatcaattcttttattttatagtgcattgcaagagctctattcctgttccctcggagaaaagaataccattttttttagaataccatttgtccaccttcaattgttgggtgcaagatactcttccggttatcctcctagcatcaccctgagcgaaacctcacatgccaatggtgaataaatgacttcgctaatcgctaacaaatacatactgatgccctgttatacgttatgcataaatagatttagggcttcatctttttgcttatgcttatatttattagccaaaatttgaattttcaatcttaaatttagagttgattttgaggttttttttcattgtagtttatttttcagcctttgttttttgattgttaagaacacgtatgtaaaagttttattcacgaattatttttcatttgtaaatatgtcgtttggtagagctattaaactgtaatggcgtgttctaagagattaatagagttggtatggattatttgggccgcacttctaaaatacgttttttaaaagttatttgttcgctttttataatatttagttcatcgttatgaactgatatttttttctctatatccataatctatcaaaatcatcatcaccatgcccataagttacatgttgaaccattctaatgcatactgctaatacccctaacacccattgctttgctccttgactcaaagccaagatcaaagatgctctcagatcatagtctttaggtcagctatcagctcctctacttaaaccttgaacagtgtttgtcccactaatacagtagtagtaattcaatgtgcagtgtactaatactagtggtagactgactgagcagtgggccccacacggtaactggcagtgtcagtgacccgtagccgcggcggttgacccctccaaccctctctcatctcctcctatatttattcttcttttccactcttctccaactcctcctcctcaattccatggcgatggccaccacccaccacttacccggctgagccaagccacccccaagaacacgagggagagggatacaaacaatttcaaagagattcagttgatctcatcatccaagattcaagaagacgagacaggcaaagaagaggaagaattctgttcaattgcaattgatttcatcatccaagatccaagaagacgaggcagagaatagaaagaattctgttcgattgcaattgatttcatcatcccaagatccaagaagaagaagaggcagggaaagaattgtgttggattgattttgaagaagtggaggcatggagaggctgttcgaggagctggcgggggaggcggtgaaggagctgctgcgggcggtgagggggacgttcttctgcaggtcgacggcggagcggctgcgccggaacgtggagccgctgctgccgctggtgcagccgcaggcggcgcaggggggaggagggtgggggcacgggcggagcgccggcgagctggcggagctggcggcgcagctgagggaggcgctggagctggcgcggcgcgccgcgtcggcgccgcggtggaacgtgtaccgcaccgcccagctggcccgccggatggaggccgccgacaccgccatcgcgcgctggctctcccgccacgcccccgcccacgttgctcgactgcgtccgcc

SEQ ID NO: 41919 - DNA, 9866 bp, Oryza sativa
gccaccgcccttccaccccccgccatctccctccccttcgctctccccccaccacctccgccgcccaaggccatggcgatgatggccatggatacgccaccgaccaagggcatggcggtggggatggaggtggagctcccgttcccggacgacgaggaggacgagagcatggtcggcggcggcgtgagggtgggcaaagagaaggtgaaggagatggtgatgagcggcggcggcggcgggtgggaggccgtcggaatctgcggcatgggcggcagcggcaagaccacgctcgccatggaaatcttcaaggatcacaaaatccgaggtaaccaacaaatcatcatcaaattttgcgtgttttttgcaaaaattattcgattcgattcgattcctcgtgtgaaaaaaaggaaaagagaagggtttcacatctttttccttcaattattgtggcggcttagggtgtaaaacctgcaaaattattgtgtgctttttgtgcgcaattaggtaaagttgaggttgatgcttccgtcttgttcttcactactgctacctgcttggtcaaaattggcgctttgaccaagcttaagtgtgatgtgtacgatcctaatgggattagattgctggtggagcacacaattacgccacacggcctaacttttttggagatgctgtgaaaaattatttttggtccaaattgagtagtaactcgttttctgttcatggccttttgccttgaaatcatggcatggtatgttcttgcttagattcagattgaaattatgagatttgcctagtgttcattggcatggtttaatacaaaccccggtatgatcatctgtaagtgcaaagggagttataattagtatgttggtgaactcattcggctcaacgtagcaacttgtgttcatggtgccaattttaatcaacataacattagaactttcttcgaatttattcgcctttttcctaattgatctgagcaaccccttggattttgcgttaattgtttgccatcaagatctgttcacaaaagacagttgtatttgatcctttgctggtttctctggaaaggtttgcatgctttattgtttttcatggtgctaacatatttcgttcttgtttctgtaggctacttcagcgatagagtcttctttgagacgatctcgcagtccgcaaatctggacactatcaagatgaagctatgggagcagatcagtggaaaccttgtgctcggtgcgtacaaccagatcccagaatggcaactcaagttggggccaagggacaaaggacctgttcttgttatccttgatgatgtctggtctctctcacagctagaggagctcatcttcaagttccctgggtgcaagacacttgtagtatcaaggttcaagttcccctcgttggtcacccggacttacgaaatggagttgctcgatgaggaggcggctctttctgtcttctgtcgtgctgcctttgatcaggagtccgttcctcggaccgctgacaagaaactggttcggcaggttgctgcagagtgcagaggacttcctctagcactgaaggttatcggtgcgtcgttgcgggatcagcctcctaagatatggttgagtgcgaagaaccggttgtcgcgaggagagactatatctgactctcatgagaccaaactcctggagaggatggccgcaagcatcgagtgcttgtcagggaaggttagagaatgtttccttgatctgggttgctttccggaggataagaagatcccactggatgtgttgatcaatatatggatggagattcatgatcttgatgagccggatgccttcgccatcttggttgagctatcaaacaagaatcttctcaccctagttaatgatgcacagtatgtacagcttgccctgtatttcctttcaaagcctttaataatttggatgcgacaaaaggacggatttgacatttggttactctatgcaggaacaaagccggcgatttgtacagcagctaccatgacttctcggttacacaacatgatgtattgagggatctagcgcttcacatgagtggtcgtgatgctctgaacaaccggagacggctggtgatgccaagaagagaagaatcactaccgaaggattggcagaggaataaggacactccgttcgaagctcagatagtttccatcatacaggtgattcattggctattaactacactttcatctttttttttcttgctatgagaaaaaaaaataccatctaatttgtttaactgatgcttaatccttcaaggtaatacataaagttccatttgttattagtattacctgatcttgtgaaatatttcccttatttaaagttctatggtagtgttacttgcaattatttgtgtttcccctttggacaaaataatctgaccaattggtttcaatcttcaggtgagatgaaagaatctgactggttccagatgagcttccccaaggccgaagtgcttatcctcaacttcgcgtcaagtgtatactatctcccaccattcattgcaaccatgcagaacttgaaagccctggtgctgatcaactatggcaccatcagtgcaacccttgataacctatccgccttcaccacgctcagtgacctgaggagcctttggcttgagaagatcacacttccaccgctaccaaaaaccacaatcccactgaagaacctgcgcaagatatcccttgtcctctgtgagctgaccaacagtctgagaggatcaaaggtggatctctcgatgacattcccgcgcctatccaacctcaccattgaccactgcatagacctgaaggagctaccatctagcatatgtgaaatcagttccctggagagcatctccatctcaaactgccatgacctcacagagcttccatatgagctgggcaagctgcattgcctgagcatcctaagggtatacgcctgcccggctctgtggcggctcccgccttcggtatgcagcctgaagaggctgaaatacctcgacatttcgcagtgtgtcaacctgacggacctccctgaggagctcggtcacctgacaagcctggagaagatcgacatgcgagaatgctcgcgactgaggagcctcccgaggtcgtcctcatcgctcaagtccctcgggcacgtcgtgtgcgacgaggagacggcgttgctgtggagggaagctgagcaggtcatcccagacctccgggttcaggtagcagaagagtgttataacctggactggcttgtagactgatgttcctggatgcttttggctccaagctcacctttgtacagatgatgtgtatatttttccctgtctaatacaggatggaggaacaatccactctgcaattttgacatgttcagtgttcatgcaactgactctccagcagcagccaaagcttgctgagaaaatagaaccatagaattaatagagattttttcttcttcttggcacaaagcatatttacatacacatagcaaatacattaaccaatacatctcttctgtctctctgtttaatacaatacagaactaggttccatacaatgcttctcatttctcagtgttcccaagaaacagtcttgcatgatatcatccggtgctaaatttttggcacaacatacataattacatactacacaatctgctgcaactcagctgcagtatggttcatcagaaattcagactcaagaactaataggcagcagagcctgcttcctagtagcctgaacacagatctcttctggagctctacctgctctgaaacaagctgattttcagtgcagtttcattgcaaatgttgagatgattacatggcatatacgatctctccgctgctctcaatgtcaaggtcaaggtccgagtccatatcctccatgtcgtcgtcgaggtcaaggctgtcagtcaagaactggttgattccactggtgcctgctgctggaattgttgcttctgccagtatctgcatgatctcgttcatattctgcatcggctggtcaggctcctcgtactgattgctaaccatgccatcatccatgaggtcagccgggatgttcttcatgaaccatgggtggttctttatctcaggcatggtgatcctctgcaagagcaaatgattgcatatgttgtctcacatcagagctgaataattgaagattgtgtggcaggaatagaattggtactcacactagctgggttgccaacaaaaatcctcgtaatgagatcgcggcactccggagatatgtggacatagtctggaattgagtactgaacacccaatattttctgcaaattgagatcagtatttagacattatttatctaaaaaaagtatttaggcattactatttagctggctgattataactgtaaattgtggtgctgcaaagctgaatggttggcaaggatacctgaattgtctttctgaagttcttgggatcttcaggatcctcgaaagggtatgcgccaaccaacatcacgtagagcgtcacaccgcatgaccaaacatcggcaatctccatccaaagacaaattattagggattgagctaactaatgcattaaaagggttacttcacaagaccatacactacccatgccattgaaacatggatcaacacctttacaacacaatggcagcttctattgtcgagcaaaaggcatagaagttgggcagctgctggtatcagtgtatctttgcatgcaggatggcaacttttaaagcacaaaggggatagataatacctttccatcgtattctttcttgagcaaaacttctggagcaatataagctggagttccaactgttgattttggttgtgaatgaagaaccgatgactgcaaaatcagaaagcaacagtacaatattatccaggcagcaatcacatcgagaaaaatctagcgaaagttctctcttcttttcactactacagaaagtaatttaagccacattgtgcaccctaaatgtcttgtggatactatctaccttcagatcatcaaatcagtatcacatagtattgccaaatgatcaaagtaatcccaactaaaagcatagcaaaaataaatagaaaaacattagtaccttcgagtaaccaaagtcacatatcttcaagcgaggagcagtacttccatctagcagagtgttctccagctttaagtcacgatggcatacttgctgaacaatgcaaaaacacattaacaaaatcgcttcagctcaatgcagcaaaccgcttatagttatagacaagcgaaaatcacacggtaactttgaaatcaaaatgatactgtaccatggaatggcagtagctaactccagatatcagctgctggaagaagaaacgagcctgaaagtacaccaaaagttcagagttagccaatacaacagtacaatacagatactacacaattattggtgaaagaaatagacatgatcatagtgtatcaggacagtgatatcgacctcgtcctcgctgaagcggccggcgctgcagatgcgctcgaagagctcgccgccggaggcgtactccatgacgatcgcgagatgcgtcggcgtcagaataacctgaaaagattcgtcagagtcggaattgcaaacgaaacaagaaggaacaaacaaaggtgtccttttacatcattcagcatcagcaatcagcatgatctccaaagaagagaggaggaagaggagaatcgtgtcatggtcacctccttgaatcggatgatgttggggtggcgcagcgacctgtggttgatgatctccctctgcacgttctcgtcaatctgcagtcgaattccacggtcgatcaaaccagctttgattttacccttttttttcttctcaattttgctaagctaagctcgcagcaaagaaaagagaggaaggaaagagaaccttctcgccgcggtcgatgtacttgacggcgacgaggtcgccggaggcgcggttgcgcatgaggcgggcgacgccgaagttccccgacccgatctccttcaccagctcgtacctgtcaccgtcgtgcattatcggcatctccatccccagcggccccgccgccgccctctccatcgcttccgccggcgaccaaacgaacacaaacgcaaacctcgatccgactcaacacgccacctcctcccctcttcttcctcctcctcctcctccgatctcgtgatctctctctctctctctctctctctctctctctcttcccctctcgcttgctcgtgttcttgattttttttttctcgctgttgtttttttttctccttttgctcccgcgctttttcttattgccgcgggaaagtgggggaagacgaagcaaaggacgttatccacatacgaatcctaaacccacccaactacctacccactctatcacttacacgtgggtcccgcatgacaccgggcccacatgtcattgtgattgctcgtcgacgttcaggtgagaaaaaacatcccgggatgctgggacggatgcttattctacccgcatcctcgggtgggtggctgacaggtgggcccgactgatggtggggctcacaggtcggtggcgggtggggatgacggagggaggcggggaaaaagcggccggaaatatctcgcggtggggccgaaaagcgccaaggggtggttaattaccatcgtgccctcgcgcgtctggagcagtcggatggagatcggacggtgtacatgggttgactttttttatagggttgttgatatttccttggacggctgcgatcggattggcggctacgcggccacaaggacggtgagggtatttcagtcatatcatcatcgtctgccgctgctctttaattgggctggtgactgtagattttaagcccaatttgggatgagcatattatgggcctatttgagaagcccagatattttaacaggttttgtactaatgggccaaaagcccatcatttgtactggatcagtgtgcttttgagcccctttctttcgggcccatgtagttgaacaatggaccagtgatggccccgtaccacttggaattttgggcttgttcattttgtgaaaaaaaaacacttagtaatactcgattttggcattatcaagtttcggtagggtaaaattgaggtgagtagtgtttagtttgatgcattaccaaatactgagaaaagttttttgaatagaaagttaattatcaactattgataaggctattttggtattactaaattttggaatgattgataatggtaaagaagtgaacaaaccctttgttctctcaccctcgtttgattgttcgcttataagtcatagataaattttaaattttaaaacttattgagatattctgtcaattttcttttttcatcatggtcttttagaccattcagagcaaaaatataaaaggttctgctctaaaattattttcatggtaggtgacatgtgtgtgcgcgtgtgtttataggtatgagtgtgcatattataaacgtctacggttgtgctgtgttttttttaatttctcaatttcataatactagtacatatagctataggttatacaaaattcattgattcgtcgttattcatagcgggtgattacctgctcgactatgcttaaattgaaagattataaatttgactagttttctttctagtgaacaaaataaggggtgattttatatcatgaatattggtaaaccgaatttgaattcgggtctaaggatggatggtgcagcacttagtgctatccaatggagatctcagtatctcattctcacccagatcggatatcatctccatccatatttttgctgatcgatgcatcctcctgctcctgtcattttcctctcaaagcagatcagcagaacgagaaaacttgcagagattcttccttccacgagacacaaattgcagttcgcaacaaacagctaattaatcttttgctccacagagagattgagagaatcgatagttcatttcatttgtgagcagagtttttcagcgagctaagcgtatcatattcttcagaaaaagggcttctgtattagtactcttgtgttcatttaggcagaacagccgatcttttccatggcacgcaaaacatttttctttctttgactcttttggttttactcaattcatgaaaaaaaaaattaaactattaatttatttttatccataatggatttatgtgggctaatacatgaaattcttatgatgtttggagggatttattattctactaaggggtctatgtgtggaatacaacttatttactcctgagcaaaacgagtaatgtgggagcaaaacgagaagaaccattagctcgtgattaattgagtaggactattaattatgataaactccaaatttagatttatattattttcagaataaatttctatataacaagtttttcaatgaaacataacatttactccggtggtttggaaagcgtgcttacgaaaaacgatgtagtcgttcaatgaagaagagaggattcaaacacaatccagaatgtgtttatgttgttaggtaaggcaagagattcttctccataattcaggtacaacaactgcaaagaaccaacttatctgtggtccaactgcaaagtcagcctgtccaccaggagagaacttgaggagaggggcattctgaattctctgatcctgaaaaagccagcagatagcatacaagagaaaacagtgcacataaagtcgagatccatggaaaggaggaaagaaatatactcatactacgaacgatgataaaaaaagaagacgaataaagtcatgtgtgtgtgtatatatatggtccatttccattgctgaactgtgtgcgccaccatcagcagaatattctctgcaaccacacgaacaagattgcaaataaagtcaccatatcagaaaagaaaagaatttctcctcctctttttttttcttttctcttatgtcctcgtcgtcacggttgattttatgtgataataactttttaggttagtctagaagatcggatgaaaattttctgttcataataagtctgtccatgttagtggcagaaacacagggaagagttcataggctgatgctaggatttcagtcaagtttcagttaaaaaatattcaatgtctaggcttcagatagcaccaagatcagaatgaatttctctccttttatcagtccacagaattgaatacagtaggtttttgaaacagagcaccggctgggaatcaaacatggaggaattcctaacaatttttcactcgaatttcagttaaaaaaaattcattcatccagtttgtaaaggtcactgcatacagcatcagagtcagagaaccagacaacctcaccattcacctttcaggaaatttcagtgcaattttcccagatgctgacgtgtacacattccactctctctctctgtgtgccagagtggtgggccccactacgcggcgattcgatgccaacctgtgccactgacagcctgccacgtcagcacccgctgccagggagagaccgacaaacgcagcgtgcggtgcgagattcccttccctcttttcttttccacacacacattcaagaggaatctcttctcttcctcctctaattttttcccagggagaaaatttgcaaattgcacactgcattattaatttattaatcattttttagtgctagagaatcttcttagctactgtaccaatatgatgctactactgtttgcttatactttgctttatgtacaattttggttagtgcagtctcacctgcatcttgattttttttccctttttagaacatcattgctacatgcatgaccagtgaatttcaccaaattcatatgaaaaattgtgcgaaaacaggggtttgctcggtgcgactagggg

SEQ ID NO: 41920 - DNA, 10030 bp, Oryza sativa
  unsure (1)..(10030): unsure at all n locations
aggaagggattaggatttgatctcacatcacccttaattaacaattcatcaagggttaagacatgataacataagatactaatatgttgcataatgcaatgtaaacacacatacacacacagagagagaaagctagaggagaaagaagacaagttgtgcaagtctttggagtaatctctgggggatctcacagagattcttctgcccttgaaattatgttggtcttcattggttatttttctactactcttctctctttctgttgatgtttttcatgtgaaggtttgcagccaagtcaaagtgtggctcttggaaccctggcaggggcaactggccaaccaatcctggtccatatttttcataccagcttacttacaattgctacttggactttgaatgcttcactttggaccctagtcattgtcattaattgaatagtgcttgtactcctacttaattagatctaataaagctgtcaattttttgatgctgtaagtttatatttcagagctaccattgtactaccattgctaatattattagtgcaggcagaagcatttttatggcccacaaaataacaatagttaagtgtttgcgtgttaatttatatatggagtacctttacggtgatctctactagtactattctactactaattttatcattagtaaaagtgatcttcacggttgatttacaagttctactaccaatagaaaaaatattctactaccgatatatgatccattagcttggaaaatatgagcggtctatgttaattccactaccgttaagaaccattacagaacacatctaacttataataatagtcttatcaccaaggactgtaaaaagtcactagtacaagggaaattctctttacaaatgcaagtgcacaagagccttttggatgattttttttttacctactcaaccttatgactaccagtaagatgggcaggctttagggggacagccaaagtcatcacatccggtttgaggcgcacttggaacttaccagatcagcacaccaaaaaacagcagcacaaactaaaagttgaagccatctagattggtagtggcatgtgtatgaaacccacaattgacccggagatacgataaggatctcgataggcgcaaggcatcgtcctgcggtgataacctagtacaattgatcatgcattctccctttcctccagtgtgtgtatatatatatcgctgacaaattgagaatatataattaatttccttcgttcttaaggagccctaaacttctagaggattataagtagtggccatcatcgttgttgtcgtcatcgtcgtctatctctccacgatatatacaacatccttatagaatgggtgctttggtccccaagtgaatggaggaatctctctcatgcaattttatctccttatcaccagtactagctagctagctacaccatcaccaacaaacagcatcaattcaggcagaatgaggaggaggaggcagcaagtgatgttttcactatgcaagtgcgcaatccacgctatctatctactagagctagctccctttctatgtaaaggcatggctcatgtaaaaggtggcagcgtgcagtgttggtgatggcccatgcatcaacaatggcctccaccaccaccattaccacttatccactcaattcatcaagagggaccatgtcaccatatatggagatggaacgagaaggggatgaggagactcgtatcgtctgccgttcaatataagttgatcgtatgtggttggaaatcaacaagtataattccggcgttgatggaaaattgcttgggggccttctcttcttttgtcaaactaggatatcaacgtaatttcgactgtgtaacacaatagtgtgaaaattattattttttgtttatgttcgtatatgcatggttcaattttcaattcaattggatgttcatgttttaatttacacctctctatcaccttgtacatttggaatttcacataaaatagttctaagtctagtaagtatatactagaaagttttccttcattcaaaataggcttataagctaaaatatgcatacaagacatttagacccccaagattttatccttgttgcatcagtggttatttctcacggcttttataccacataaaagttgcgatgtaacccatgaattccgaagtggaagaattcatggtccaaaccgtccacccttgccaaaccaaaggtatagcacctaaccttaatttgaaggtaaacaacaaatttcaatttccaccttttcatggttcatttagatgcatgtagcaacttttgttaaggttgaggtaaaattactctgatgctcctatatataagttcattactagttcgaaaaagatcacacccaaaaatgcaacaatataacataaatgtagggaatcatgatagtagtgcatggttcgattggaaaagtaccactccaaaaatgcctatatttgcggataaattttaaacgctaaaaatgtttatatttgtgcatggggaagtatatgacttccaacattattatttgcggatcaatattttattacaaattatctacaatttccataggaacttccattccaaaattatctacaaaattaattaacttccattccaagttcagaaatgtatataattatattgtttggaatccattgcaacccccataattacattaattaggatatggattctctacagtggtctcattcatgccaaggggggatgcatatatgcttggatcaaagctggatgctgctttcctccagatgcatgcggtgatcgatatcatatggtacgaaaaagagagagatggggagagtttagtacaggggcagcaaagaatccaatggagaagagatcgagaagagagaatcccatcgatcaatcgatccaaatattcgtacgatttgcattgcatgcgatggcaattattcacggtgtcgatcccgtccttgcgtccaaaggcacatgtaggccccctagctcccagccagaatctccacagatccacacacccaatcatgccgtgtgaaaaacgcttatgagtttttttataacaaaaatcactttgctttttttttcctataggtgacctttgaatttggtctgcccggcctctagtgagaccaaaagtcctacaaagaagagagagagagagagatctttttcaaaatcttggtcaaattcaatcggaatacgaagaaattttatgtcaaaagtaatagtatagatgaccttcccaccaaacacatgggagcgcatgcaagtcatggaatgtgatgtttgttaaggttgagtttgaaacagcttctcaatttggctactttcttattttttttcatgaatatatattttatgagttatatttgatagttcagtggcaaagagtatgtgtggttttaactccgtgttcttgtgttcaatccctaacatactcatattatttttcttaaaatttttttgatggatgtctctccctccaaatttcattttcttttataagtatgttttctgaactgctaaacgatacattttctgccaaaactttttagacaaaaagttcttttaaaaattaaataaatttattttttagtttgtaacaattaattaatactcacttaattatgtgctaatggctcttctcattttgtgtgcagccatcccgtggcatcaaatgcaatcaagtgtattggtagttggtggctgtatcacaaagatatataagaaaggaaaaaaatgcatatgtgtttgatttatgaaaaaaataaaggtgagatgaattttttggggggaaattcattttggctctgaatttggatatagtggttagggactagtggtggatactgttcaatgttctatccctcttttcattgacagcgagtgcttttgacaaaatggtgcacaaatgggaggatgccaaatcatggaatcccagctttatatatgcttgtggagtttcaactttcaacatctggaaggcacctccttggtacaaaagggggaggtcaaaaagaatagcttatttcagactaattgcatgatcagatgttctcattctgatctgtcaataaatgcggttaattgaagcttcaacaaactggagcttaagtatgtgctcttaattaattttaaatcatctcatcccatcttctagtgagattaaaaaaattgtttttccctgtagtattcaattgaaaatttgagtagttagcaaacgaagccttaatgttttggtattgaaagtaaaactattgcgcaattctaacttttacgaattcaattttagattatatttccatgaatgaagaacttcttacttcaagaaagaaaaaaaatactccctccttcccacaatataagggattttgattttttttcttgcaacgtttgaccactcgtcttattcaaattttttttacaaatataaaaaacgaaaagttgtgcttaaaatattgtggataataaagtaagtcacaaataaaataaacaataatttcaaaaaaaattgaataagangagtggtcaaacgttgcaagcaaaaactcaaaatcccttatattatgggacggagcttatattataggacggagggagtatatctttagtacaatcagtatactcccttcgctttttactagacatatttttaagagattactagacatattctgatttcagaaatatgtatatcctctatttaaagaaactaacttctgattacaatctaaacatagattttttaaaaaaaactaagtgagtagaaaatatttgggttcgttagatggtgtttggagtaaatcttttgtgcacacaaaacatagcgacatattaaaatatgattaattaagtattacctaattttttttaaaatagattaatatgatttttttaaaaatatatttttattgaaaattattttttataaaaataagcaagataagttaggaaagaaggggaagaacacagcctatagaatctttgaggcggttcacttcaccctaaccaaaagaatctttgcagcttgggaacggtgacgttgcctttgtctccttgatgagaatctctctctctctctctactttggcgtgtcatctcagcaatggcggcagcaaaatcccatggagatctcatctcacctctgtctttctctctctctcatggcccactctctctcatggcccactcatacatggaatccttagccccttgccaaattgctgttgccaataataaattccaaacctctctcccaaatgagggaatctcaattgtcactatgcccaaaccacctgccacgtggaggacagccattggctgggaggatgaacaatctttggagtagtggttctactgcacagagacttgcatcatggctgtgatgatgaaaatgatcataactttaatttggtgaaagtaaaaaaaaacacatgtctttttccatggtgaaaaagataccagaaatcaatttcgtaatacctagtactctctccgtctcagaatataataatttagaatcagatgtgacttatcttagtgctatgactttagacagatcccctttccagattcatagtactagaatatgtcgcatccaattctagattgttatagtggatagggataagtggagtacaaagctatctattgtcctaaaatataaacactttttactgagataaaggatagttgtgatagtaagagatgagaaaatgtgtggagaagttatatgcatgaaagattgttgtgattggttgagatgaaggagaaatcagataaaatctcaacatagaactagctatattttcgcactgagcgagtaactaattaattactcttatatatgggctttgtgcactatactatgtgtaacttctgtgtcaaggcacaaatccttttcagatttgacaagggtcagatgcttgaattattgcattagctacagtacttgttggaaaaaatagaaaagtgaacctctcactttcacgggatcaatgccatcgagatagatatccctaattaatctattgcatgcactccttccatttcacatgtaagactttctagcatttcctatatttatatagatgttaatgaatctagacatatatatgcatctatattcattagcatctatatgaatatgagcaatgctaaaaagtcttacattgtaaaacagaggaagtactaatctaacatttaccaatagcagatagagagagaaaacagtaccatggcaattctctggtcccccaacctccctaaaaaaattagtactaaaatgactttcaagatgcatgaaagagtgaaaaaaaaatgaaatagtgatatatagactgatagctattactaacatatagaagaactcgatctgaattaggatgtcttttgttttcacatttatttgatgtcaatttgcatttatatgatgtcgttgacatgctcttcctaccgataagcaccgaaggcgtgctgcatgaggtagaaacaaaagtccaacacacttttttggtcatgagtgtcatggaaacctcatgaaatctatctcctaggtcacattaattttatagttggtacattgggtactttgactaaggatgctatttatgaatggtaataataatgtgattctcaatagacctacccctcctcaaaataaaaaaaaaagacaaaccgtgcgtccgggttcgtagctaggattttttttgacagaatagtaagtctcataaaaaaataagtaaaacggagacataatttgagtaaggaggtgtgttggctagctcattaatataatgcggggtagaaaggttagagaatgttactccttgtgttttagcatctatcggttggcaagtgatggtaacagcaataaatttattgccagaaaaccacaaagcaacatatcaatttctttgttaaagaaaaccaggtttgaccattagctaaagacagaatttccataaaactaaacttctatttcatgagggaaatctttcaaagaaaatgatgataagtagctttagcttcgagatggcaccgacgaatcgtcaagcatgtatgttcaaagcttgttggtgccgcatcgaaccggctcaaaaaaaacatgaagaagaagcaaaataattaagtttagaaattttgtggaaaggaatgtattgtgggatctaaacacatagaccatttttatcgaaaaaaaaacaatgccatcaattcttcttcgaagaaaaggaagaagaaggacgagaaaagagtaataaagaacacacgaatatatccgtgtgtatcccttgatgaaacctacccctcaccaactcttcccccctgatctcaagcatctagcatcaacaagaagagaatagcacaaaacctccttgctaacgacaacataggaaaggaggaagaatcaactttccagcaatggatcctcttgtcttgctgtccccctcccttggtttcttattaattcacatcgcatccaaacacacacagattctccatcttttcttttttttttctttgcaaggacaattattcttattcgaaaagcaaattaaagaaactcggttcggtttcagttggaacacaacagacgccgtcgcgataaggcagaaaaagaaaagaggaagtgccatttacaatagattctgcaaggtacgcagggacgtgcgaggacgatttctctacttataaaaaacccaatgaaattaggtttggttctagttggaacacaacagatgctgagacagaaaaaggaatgaaaagaaaaagagatagtaagagctgtagaatattggtgctccaccagcaagtgcaagtgcagggacctgaatgaaaaacctgaaaaggacccatatgaaattgaggggaaatgtgagggggtggtgtgtaaaagagagggtggtgtggaggaagaaagattcgtggggaggcggtatcctgactgtgtttggtgatggttgggtgttacgcgacgaaacgcctctgatcccccatccatattccacgggcggcatcttttctccgactctcacctcccctcccctctcaatttaccatcctacccctctcccctctccccttcatttcatcactagtaaaataatactactattcatgctatgtactattattttttttttctaaacaagctataatttttttaaaaacaggctattcatgctataatggggttgttcggttgagctagctatgctgtggtagccagcccaatacaactataccggttgtagtaaccaattgcagcagcagcgtgtgttcaaacttgcagtcgaatggctagggttgcgtagcatagtctagatcgctgcaacgacagagtatcgaacaaccctaatactactacttcgtaggatttttcattgttccaatctaaactgaattttcttgtgaagttctagcaaaattcttgtttggcatggctccacgtctggatcaactcttggaatctcgaaaaaaaagaacttatacattaaattaacatgcattaatcctcttattttaattttaaatatgaactaaatatttcgtattattgaaattaatcaaccatcacctacaactcatgaatttccggagctaaagatgtctcgttatcaaatattccatccgtcttttttgatattttaattttgaaccaaccaacatcaaatattaaaggatggtggcagtaaaaaaaaaacttggagatttttacgtctagaaaccatcgttacacataaatttaggcaggaaagttttttttcccaactcagagcattttagttgcaaaaggtttatgcaaaataaagcagaaaaaaaactactaccagtatcttttacatgcacagatcagaaggaaccagtggttgtacagataatagcagaagctagtggtatcttccacggccgattctatactgttccacgtcaaattaccattctaccctccattctgcctgaaccggaacccccaaccttcctccggtataaacgcggcgagagcgcgacgccgcaaaccatttccaccgccaccgtctcctcccgaattccggcgaggtgttgtggacgatggggtcgtcgtcggcgtcggcggcgcacacgaggaggcggcggcggcggcggccttcgtcctcggcggcgtcgacatgcggatgctggcggcgaggacggcgacgggcgcgctggcgagggcgggcggcggcaaggcggcggcggcggcggcggcggcggcgaggttcgaggattgcatccggagcctcgaggccgagaaggccaagatggaggtgttccgccgcgagctccccatcagcgtccacctcatcgccgacggtgagctctacctccaccctctacctgctcgatcactcgatctgcctatagatttcatggatgattattcgctgagatcttcttgggcgtccagtgatcgagtggctcaaggacgaggtggagaagcagcggctgctacggcggcggcaggtggaggctccggcggcggcgccgccaccggagatgttcgcgccgccggcgacggcgaagaggaagtcggcggcgtcggcggcggcggagggggtgaaggcggaggcggacgcgaacgacaagcggagctggatgagctcggcgcagctgtggagctgcgggagccacacaagcaccagcaccagcaatggcggcagcgtcaagaagcagcagcacaaggtatttttgtttggttaagttttgtagtttttttttttataaaacaaatcaagtttatactagtttgaagggaagatatgggaaaaacatgaatattttgtttggttaagttttgtcaagtttgtcctagtttgaagggagattgttttggaagggaagagaaggagtaatgctactcctactagattttttttgaagaaacttaatttgcaaatttatgcgatactactactactagtctagtgctactaaaaaaaatggagaaaattgtaatattgggactgcaaacacgtgggcttcgctgttttg

SEQ ID NO: 41921 - DNA, 10864 bp, Oryza sativa
tctgtgtgtatgaaatgtgggtccagtgtcattatagcaaagtttaatgtttgccgtgttataattgcaaatccccaaaaaaaaaaaataggaatctttacaattcaggtgttcaatgaaaaattctctctctttttttggtttctactagaaagaggagaaactttttccccatatcaccatgtagaatagaaatggaaaaatacagaataaaacaaaaaaaaaacaaagattcattttgttcgatttcttgtaatttgtcaattttttctatgttattccaccaagaaaatattaacacatgttgagcatgcatagctttgttgtcaatctcatgcatatttgtctgtattttcgctaacttttttctcaaaagagtatattttttcctaactagttctgtcaatttcaaatcatgatcaggtgtccaatgcgttcatgccactggccaccttgccggcgtttgcaaaatcactggagaaagccgacgccgccgtgccagacctgtccctctcctcccgggtggcgatggccgacgccccggcatgtccggcggcgccgagcgccaccagcagcgccgtcacggatgtcgctgtagcgcagcggcagcaggcggtgcacggaaggccagacggtgctggtctccggagctccaccgccggttcgtcgccgcgctccagcgcctcggtggcccacaaggtgaggatcatctcattctcatcaacctaaattgtgcaaattgccacattttattttagattcgatttttttttccaatgataattttagatgattgtattttctttctgaactgtttagatgattgagtgataatttgtggtcacattgttgattgctcctagtaaaattgtttgattaattttttgattggtgcgctgaaacttgcttaatgtttttttattgttgatgcagctgcaactcccaagcagattagggagctgatgaaggttgatggcctcactaatgatgaagtcaaaagccacctgcaggtttgttcagtctcaactccttacttttacaacctaaaaaatattgccatatgtcggtggcaacaatttggtacgcctcttttataaaaagttcacgaacctcaaagcaaattgtgcagaagtaccggctgcacacgcggcgggcatccgacggcggtgatggtggcggtgaccatcagacggttggcggccgtctatggccgctgccaccggagcaatacaccacctcgcagcacagcacatcgcagtctggctcgccgcagggccccctccagctcaccgtgtcgtcgagccacgccgtgtcagtgaccgccggcgatagctgcgacggcggtgaggaggaagaggaggacgggaagtcggggagctatagctgggagatgcagaatggggcaagggcatcatcatcatcttgagcaccattaattaattgtctccaggtgctgcacagcagcagtgaccgaagaacttaggcctatttctgtacagtggttgagagctttttttgggctttttttttggaggatgagattaagtacgggagttacccatgtgagtaatttgagttgttgttgtagagggtttgagaatatgagaggtgttaattacatcacattgtataatctttgggctaaattgtgatgtcgagattaattattcttatgtgaggagaatattgctagattattgtccacctttgatgcctcctgttgtgcaaatttatttatttttttgaatatgcaaggaacacatctttttattaaggggaataaagtttatttacaacgataattttatacattataagccataatggcttatcaaaaataaaaagtattttacgaagaaaacttttatatatgtgaacaaattatgggaaaacacgctaaaaactgtaaaatgattccaaaattgagttttaaaattcaaatttgactacaagttataagtgaaaggcatgttgatttgtttgtaaaatttcatcaggcacactactggctgtgataataaaaaaaatgtaactgaaaaattaacaactgaggtaaaaaaatgaaagtgagatcattcgattagttgcttgcatcttgcagtggatcttgattggagatgttctcttgtgccaatgaatctggatcaggatcaggatcatttaaccctttttttggtaagtgcattggtgagcatcaagagagtggttcactctaacctactcatattaatgcttaatcaatcaagtggttggtactgcgtgcaagatggtataattatgaacttcggatcttgacttttgccgtgcatttcgtactggtttcatcctttggcgggaattggtagaggaagctacctctagggttcattgttcatctcttcactgtacgaatttactagtttttttctttaaaaaaataaaaactgtacgagttgaatcaggaacagtttataaatttgtgtccggtttattgggtttgaattgaattgggctgaaaaaaatgcaggtccatttatttcctgggccgaaatgggccatcccttttctgattgagccgaataaattgggctaaaaaatccagcccaatccacagtggtagtgaggggaaaacctccacgatttctcgcgccgccgccgccgccgccgccgtttggctgagcacctcgccgccggcgctattccccaccggggaaacctcgccggcgtgtctgtggagatttctgctgcgagggaagcttcttcgtcgactccgccggtgcggttgcggttcaggagctcgccgagcggcggcggcggcgatgagggaggcggtgacggtgcaggtcggcggcttcgccaactacgtcggctcccacttctggaacttccaggtgagtcgccctctctctctctctctctcgtctccggcaagacccccagcttgttgctccacctggtgcaagaacctgacgcttcttggggtcttcttcttcttcttcttcttcttcttcttcttcttcttctccaggatgagttgctcgggctcgccgacgaccccgacgccgatccggtcttcaagaacgccgcgctggacatggacgtcctctaccgctccggcgagacgcaccaggtaaagccgccgctcatcgctggcatgacaaaatgcgtcgtttcttttctttctgtatttgtttctcttttttttttggcgttgttgttcatcttttactgactactagtatacactgcttgatttcactagggtgttgctacctactgccctcgtctggtgtctgttgattctcgaggtaatttgatgctgaatttggtccgaatattattgtagtgcgtaaaaccccatgtttagcattcaacttataagcataaacgaaaattttgaatcttagaacttaatttcagggttgattatggggttttttttttcatcatggtttattttccagcattttgttttaaatcagtaagaacacgtatttaaatttttttacccataaatgattttctaatcgctaccagtccatttcacttataataagtatataagcgaaacgatgaggaaataagaactaagaactgttattttgttattggtagtgtatatactgcatgttcacggtggtatcatttgcagggtctcttggctctttgagttcatccggtaatctcggtcagtctagtactgctgcagatcaactcaatgttgctacatggcaagtggcgctctaacttctttagaatatgttttcatgtttggttttgcttattgtgcccaccatgaataattgaccactgtgatttggcatgtacgacctgcgcagaaggcggctgttgtttcagtttagttttggattgcttgtgcgaatgggttacagatgtgctaggatcgtttaaataagcttgcatatctataactgggggtaattctgacaaatggtgaaatcatgtctgcatcgtcaaagcaagcagatagcaaatacagcagctttactatagcactgttatattgatacagttctaggaaatttctgcagcctgagcaaacaatgagctgttcttaggctgataataagagagtaataaactggtaataatgattcatatgctcatccagctgctgtggaagtgatgcattgcatctgcctattattctcgtagagttgcattcatcttttgccttactgttgcttgttttgcactgctatgtgcaaatcattcaatgtattagtaactatatatatatatgttgaataatgtgtcgggctcataggttaccatgatgaattttccttgtttatgtaggtctggaaatgtaacaagatcagtctcaaaacctcatgggcggaacttgtttctgcaaagcttagttgaagaagggcagaatccaagcactagcaatggtggcagcaactcccagaaaagtgttgaatataaggacctgattgaatgcctagagaatggcatcaacttttggacagattattcaaaagttcactatcatcctcagagtttgtatgagttatatggatcatggacagactttgacaagttcgataactatggcagcgcacaagaggttgtttcagactggtcgcaaatagaggaaatgaatgagaggctaaggttctttgttgaagaatgtgaccatattcaggtcctacccttttttccccagtaaattatcagcaaactctacttacagttttgcaacaagctaacgttcacttatgcaatcatttttgccatcatgcatattatttagaccattattttaagcttaattgattcataatttaccacagggcatccagtttattgtggatgattcaggaggtttttccagtgtagctgcacagtttttggagaacattgctgatgattacacaaatacacttgtattgctttactgtgtgagggatccaatgacccttggaccatccaggaggaatcaaagggagtccattatgagagctcttcatgatgctgtttcattttcaaaactttcgtccttttgcaacctgatggtacccataggaccgccttcattaagtagaagtatactatcctttgcctgaactccacatttttagtttatcttttgttattgttattctgtgattttataggacttctttctggttgcctagttttgcctttgattgcttcaagtatactgatattgtgccttaagatactgcacttgattgcgtttctattaaatatcaactccttttgttcaagctgtatattcacatttgatttccatacaatattactttcatgaattcccttaaaaaaatactttcatgaatatacagaaagcttattctgaatgagattttctcacaaatttcctttcactctgtttcatcaggttgcatgtcaccgtacctttatatacaagatgagaaaccattccatgctagtgctgtttgtgctgcagcaatacattcaatcactgttccatttagattgcaacgaacgggaccgagttcagacttagcacattcatctggtaatcttgacattggcgaacttgtgcacattttatctgatcaaggtcggcagaacatggttactgctctggatgtagcgatgcctgccccttctttgacaggtatacaacataacatatgccctactgttataccaacattggatggaaatttaatcttgcttgctaattgcacactttaatttgcagatagagatgctatggggaacatagagatgaagctgcactctttgacccctgaaatcagcgatgaggacgaagatccttattcagttgaatcgctagtggttcatggagctcttgatagaggtctgcacatcttatcttttgccttaggatctgattaactcctattatttgtcatgccaacagaacttatttttctattgttgttaatacttacaatattgaacatttaacaacattataggcatggtggctaaattttggttatacatgtagaagtacaaagaattaacaattgaaatttgtttgcacaggcgggcaaaggacttccatatcacaagtgaaggactcggtatgttcagtctacgaagccagagagacaaagccaaaattttcccatctctcagcatctctttgccccctccctgtcccccttccgttcccgtcaatcttcagaggcaacattggccggcacggggagatccttagtgaccatacagaagaatcccagccaaagggctcacttgacatcgaatcgataccaatggcggcacggttacgatcaagcagcgccgtcctgcctttcatagagaggcgatcggggagcctccagaagcacggtgtcgcgagaggcgccatcgggtctctggtcctccatgactggggcttcgggagggaggaggtggaggacatgggggagcacctagcgaagttgctccgcccgtttcaccctgaaatggatcttacttcggattccgactagatcatcttcgaaaaatcttacttcgagaatcaagcatgatccatctgttgcaatttatgtggattgtagtaatactaaatctttttttttcagagggttttcagatactgaaaattcatgctcatgtggctggctgttgtgagatcaagaatgagagatctgaatctatggccctgtttagatccggagggctattaaatagccctctggaatcttactatttaagagtattaaacgtagattactgacaaaacccattccataacccctaggttattttgcgagacgaatctaacgaggtatattaatccatgatttgctacagtgatgctacagtaatcagccgctaattatagattaatatacatcattaaattcgtctcgtaaaatagcctaggggttatggaatcggttttgtcgataatctacgtttaataatcttaaatagcaagattctgaagggctatttaatagaccagaggttctaaacaaggcgtatggcatggtagaccttttttgtgttctactcatgtgcatttgagcacgggtgtaggctgtgtatgccacatgctgctgccgtgacattctgcggtgtttcaggccatgtacagatcaaccgggccctggcttctgtcaagtcaagcagttccattttcgttgtgatgtgaggtcacactccgtcggtctgtgacagtttcacatgaaactggagtactcaatttctgttaaaaataactaaaattcccgcatttcaaatataaaagccgataggctgtatatatcgggttttagccacattaggaacatggaaaattttcgccattcctatggagttattctataaatttcagcctcttttggaatgttggatttttgaggaatttcgcataaattgagttgtttcctgtaaaaatcctacggagggtttttggaacaaaagaattttataggacttttgatcgattgtactcctaaggaaaatcctttaaaaaacaaagatgatttcgggaagattttcaacatgatatcgaatcttttggaaaaattgattaacgtctacctatcttttcttattcatgtatttttcttgctccattcaaacaatcatttctgtagtttttacatgtttttctatccataagatttgagtatcagtgtcttaaaatttctgccattttctaaacagtgacaaaaaggcctcctatcattttcctggaccgaaacatttctttcatctcttaacccaatacctttcatgcctctccatcaagcatctgtacaaatcttgttgactaaccaagtccattagcacggtcaccaagaacaacactaaaattaaactgtcattcaagtatacaatacggttaataaataattcagagctgtcaatcaacgaaagtttggcatttttcgcatcaatgattggtggcgagcatcacatggccggcccgaccggtcatgtgtccgaaaacgcgtgaacatgtttataatttaaaagtgtatttgtaaattgtaatcgcaaaaacaaagacacgatgattttttataattattagtaaaaaaaaaaggagagactgactgacacacacacgaccaaagacatggattgattgattttttttagtgcaaagcgatccggatcttgaggtgatgcgctctttcttaattgtcgttccatgcgtgttcaggctcccatattttttttaaaaaaagataataaaaataattccaaaagtttgatttttcggcgtgtttttttggatgtatgcattttcttttttgcgatgaagtttcctatccttttcctttgtgaaaaaagttatgtgttttttttccaaaaggaaaaggaatagaatctctaggttctttttgcctttttcataattggtggatggtatcaagggaaaaagtaaccttttttttatgtgcctgttctaacaggttttatttttgaaagcgactttgtgttgaccgatgaaaattagacacacaacaccaagatttttcttaaactttagccctcttaactataaaattcatgaccaggagtccaggaccacttgaccgctaactcttttttttggtgcaaatctgataacctgtcttagcttaatctagaccggtctcggaaatccaaatatgtctgttgatcgcttccatttttactcaaccagccgctgcccgttggtgtattacgatattctaaagagccgtaatatttttcacaaacgttgaatgttaaaaattcgaaaattatgtacatcctccgcttaaagatgactatgaatagttgaacccacagaaggaggaaagaaagaaaaatctcgagtttgtgaggaaaatgtccaggcagtacttatcaatgaagaaactaaaatctcgagtttcgtccttaacgacgtcgttgacttttcacataacattatactaaaagaacatataatttttttattataaattatcttatcaataaagaaactaacttatattttttaacagggattatctgtaatactgctggtgcagtagcatacaagaccacataaatttaggcagtacatatcaaacagaatcattatctaaaaaaaacatatcaaacaaaatggaaacacacttgccagatttgagcaaattattcttcaccaactactgacatgaagacatcatattttgcatagcttacaaaacaatgttcaggattccaaatttttagcatggcttggttgaactgaccgtttcagcagaacagcaccaataataaggtaaacgcataccgaacatactgatgttccaacttttctagcttaatccagtgacttgcctggctgtaaatgtaatgggctactaagcttatggagacattgttttaacatctgcatcttctccaagacatgagcaaaatttgacaaacagattacaccatagttatctcattcagattttagaacaaactacgtaaatttagcctgtacatatcaaattcacagtatgtttggatgggcctgaatccacggtctacttgcgggaataagttcacccgaggtccctcaacttaacagcgagattttttgaggtcccttaatcacaaaaccagaaatttccacccctaaactatacaaaactgttctcaaggtccctaggcagtatatatgggtgatttcgctgatgtggaatcctagtcagcaaaaaaaaaataaaaaaaatatacgtgaggcccacatgtcagctgcacattccttcccttctcttttcttctccttctcctcttttctttcttctcctcttcttcttcaatgacggatcaaggtcagcggccggtgggcggagcagcggcgggcgagcgcgccggggtggcgaggagaacgacggagaaggcgagtgaggcgggcggcgaccttgctcccgttcgcgtgcgtggagttcctccgaccttgctcccgtccggcggtgcgtccagggcgcgcccggcgctgtggagttcctcctgtccatccactggtggagaaagggtttgtagtcccagttggtaaccctctgtagtcccggtttttcaaccaggattacgaatccgggactaaatatgtctatctttagtcccggttcgtaacaccaaccgggactaaagtttttttttcttttttttcttttctcatgttcaatctctccaaatcattataaaaataacaaataacaaatcacaccacaaatcacaaataactttctcatgttcaatctctccaaatcattataaaaataacaaataacaaatcacaccacaaatcacaaataacatatagcacgaatcacagatacacgaatcatagatagttcacatatcacatatctcctaatatcattcacaaatcacagatcgcatcacaaatcacagatcgaacaaatcacacagatcgcacaaatcacagtcatccacatcacattaagaagggaaaaagaaaaaaaaagcaaaaaattccatgccgggcggcccgaggcgctgcctgccgccgtcggggcggtcctccgcaactgccgcggggtggcccttcacgactccgctgccagccgccgcggggcggccctccgcgcctccgccgccggccgccagccgccagcgcctccaccacctgcctccgcgccggccggcgcttgccaccgccggccctccgcgccggccgccgcccgctgccgccaggaagacaggggagagaggaaggggaggaggagaaggagtggaggggaagaaaagctaaggataagactgaggaggagggtcagacaatggacacgcgaagagataaacatcgcgcacggcttggggtgatttttagtcccggttgttataaacaaccgggactaaagatggatctttagtcccggttgtttataccaaccgggactaaaaa

SEQ ID NO: 41922 - DNA, 6743 bp, Oryza sativa
tgggacctcgccgccgaggttgctagggtttttcttatccatcctgcagagcgatctggagttgggggcagttggtgtgtgtgtgtgtgtgtgtgatgtgatctcatctccaccaactactagtgtttgtagctgcacactgtgtgcgtaggaggaggatcttgagcttagcaagtagtagcaaattagtagcaattttgtggatatggatgcggctgttgcagcgagaaattgcggagtctgatagtgatggctgttgctgagctataggaggggatccttgttgcttcatcgctttcgacatgtattgcggtggtgttgattttagtatactcgctatggtttgggaattaggaaacccggttcgcaagatcggagcatctgcatgtaggcgcttttcttgtgaacattgtgtagcaagcccgtcgatcagagcctactatcctttccttaattgactccagagtgcagctatgtagtagcttcgcactcacgaatggattttcgagaagttatagttggaaggttttcggtgctcacgctgctgcattcctagagcgtgctaagcttatttttcgcacttaattctaagaggttactgaatttcgtactgtggatggttttaacaggagaaactgcgggttgcggtgctggtatcgaaagctgcactacagtttatacagggtaatcatgtaatgattggatgctgtttcataatgtagaacgtgccttgttttggtattttcttatatttctgaccatttttagtacctaataaacatgccatcaaaaatacaaatactcaggtctttcacttcgaagtgagtatgttgttcctgaagaagtcaaggctgcagggtttcagatttgcgctgatgaactgggctctattgttgagggtcatgatagtaaaaagttgatcacccacggtggagttactggaatagcagacaagcttgcgacatcaccagcggatgggttaagtacagctgaggaaagcattaagcgcaggcaagatgtatatggactaaacaaattcacagaaagcgaggtccggagtttttgggtgtttgtatgggaagcacttcaagatacaactcttataattcttgctgtctgtgcctttgtatcgttggttgttggcattgccatggaaggatggccaaaaggtgctcatgatggtctgggaattgttgcaagtatcctcttggtcgtgtttgttaccgcaacaagtgactatcggcaatccttacagttcaaggacttggacaaggagaaaaagaaaatacaagtgcaagtcacaaggaatggttttagacaaaggctatcaatatatgatcttcttcctggagatgttgtccatttagcaattggtgatcaggttcctgctgatgggctattcatttctgggttttctctactgattaatgagtccagtctcactggcgagagtgaacctgttgttgtaaatgaagataatccttttcttttgtcggggaccaaagttcaagatggttcctgcaagatgctgattacaacagttggcatgcgaacccaatggggaaaactaatggctactctcagtgaaggtggcgatgatgaaaccccactacaggtcaagcttaatggtgttgcaactattataggcaagattggtctatttttcgcagtcataactttcattgtcctttctcaagggttaatcagcaagaagtaccatgaggggctgcttttaagctggtcaggagacgatgcactggaaatgttagagcattttgctattgcagttaccattgttgttgttgctgttcctgaggggttacccttagcagttactttgagtctggcattcgcaatgaagaaaatgatgaatgacaaggcattggttcgtcacttagccgcatgtgaaacaatgggctcagctacgaccatctgcagtgacaagacaggaacactgacgaccaatcatatgactgttgtcaaggcctgcatttgtggaaacataaaggaagttaacaatcctaagaatgcatctgatttgtgttctgagcttccagaaactgttgtcaaaacccttctggagtctatttttaacaatactggtggtgaggttgtgattgaccaagatgggaaatatcagattctaggtaccccaacagagacagctttgttggaatttgcattgtcacttggtggaaattttaaggcaaagcgtgatgaaactaagattgtgaaaatggaaccctttaattcaacaaaaaagaggatgtgtgttgttcttaagcttcctggaggaggatgccgtgcacattgtaaaggtgcttcagaaatagtgttggctgcctgcgataagtttatggacgagacaggtgctgttgtcccccttgataaaacaactgctgacaagcttaatgggattattgaaagctttgctaatgaagctcttaggacattgtgccttggttatcgggaaatggaagaaggcttttctgttgaagaacaaataccactgcaagggtatacatgcattgggattgtaggtattaaagatcctgttcgcccaggcgtgagggagtctgttgcaacctgccgatctgctggaattatggtgagaatggtcactggtgacaacataaatacagcaaaagcgatcgctcgtgaatgtggcatacttactgaagatggcctggctattgagggaccggagttcagagagaaaagtcttgatgaactactcaagttgattccgaaaattcaggtttgctatgcatatattaccttattgacttaagtttttaccatctatatacaaacataattcttggtgattctgtgtattgaaggtaatggcccgatcatcaccacttgacaagcatacacttgtaaagcatttgcgcacaacattcaatgaagttgttgctgtaactggtgatggcacaaatgatgcgcctgcgcttcatgaagcagatattggacttgcaatgggcattgctgggactgaggttagattatttaaccatttgaagagatgaaaacttcgagttctattctctctggtcacaactgtgtgtcatttttggatgttgacatggcgtagcaaatgcaactttgaccactaatttccattgcgataatgataaaactcagtagaattaatattatgtaagcatttttttattcatattttttttgtaaatccaacataaacattcggagatgttagaaacatatggttagaaaacatcatttgtttttgactggatggactaaatggtattaatcaactagcagatatttcatgatttataattttttattcaagtcatgcatttagtcaatttatccagcaccatacacccatacaaaacctaaatattggtaatctgaaatatccttatttatgtcatccagtaactaatgcttgcttattcaggtggcgaaagagagtgccgatgtcataattctggacgacaacttctccacaattgttactgttgccaaatggggacgctctgtttacgtcaacattcaaaagtttgtgcagtttcagctgactgttaacgttgtggctttacttgtcaacttctcttcagcttgctttacaggtatacttcatatcattgatgattctgttaactccagaatttggatatcctctcctgaccttttatattatgcaatcgcaggaaatgcacctctgacagctgttcaacttctttgggtgaacatgatcatggacacccttggcgcccttgcattagctacgagccacctaacgatgacttaatgaagagagagccagtgggcagaacagggaaatttatcacaaatgttatgtggaggaacattctggggcagtctttctaccaattcattgttatgtggtatctccagacgcaagggaaaagcatgtttggccttgatggccctgatgctgaagttgtgctaaatacaattattttcaactcgtttgtcttctgccaggtatgtgtaccataccaaatatgtttctttttttcttcggctaggagtacgggtgttgtcaaagttgccctatgcatgcagaggcctcatcactaattcaattagttcatagtccatcacctgcacacttaattaatcaacatttttttaaaagaagtgtcctgcttttctccagttagcatccacattgttttagatgccgatatgttagggccaatgcttataaaaagggcaattcactatgacggaattcagtcagtagattaacagatgtctagccagatgtgtggctaacaaattgatggccacaccttaggcagggtatggcaaaaaaaccgagtcatgacatgtgggaccataagtgtggcaaacaaaataaacaataggctcataaagtgtgacaaagtttggcaaagtgaggtagtgaaccaaacacccctagtcccagaataacatcaatcctctcttctctgtactagcagttcaagatccatttctcttgcaatacatctgtcataatttgttgaaataaggagggtagtccaacagaagatgataattgtttcactgccaacctgataaactaacctggtatatgctatttcaggtgttcaatgagataagctccagggagatggagaagatcaacgtgctgaggggcatactgaagaactacgtcttcttgggtgttctcaccagcacggtagtcttccagttcatcatggtgcaattcctcggcgagtttgcgaacacgataccactcaccaggctgcagtggattgccagtgttctccttggcctcattgggatgcccatctctgccattatcaagcttcttcccgtcggctcgtcgtgatgaagatgagatgatatctgcagtgacagtatccatactgaccaaattccatattgtttggaggagctgaactctccatgcagtcttttggaaatgcatgtggggcaagcagtgggaataggcaatagctgcactttgacaagtttttttgtagaatatgaatgtgtcatatttcgcatcatattgtaagaagcattttgttttggcacttttgctggttcagttgtgtagcaggatttcaaggttggtgtttgtattggaattcggtgacgagaaaattatgtggattaatgaacagaagcataaaaatatctccttttatcccctttccccttgcacttgattttgttatgttcattgagtagtggttagtgatacaccgcattgcactttgctatagcgtccatttttcctccttttttttcacctatgaaattattatatcctgaattccaataggatactctttctccagccatttaagattttaagaattttttattgatgaaatgaaacacaattcttgtacgttttgagaaaaaaatgtcttggtttatctattaaaaaaacaccatggtacatcttactaagaacaataagtctttactaaaaaaaacactaaaagaaaataagtctttatattataaacaatttactcttattctgatcggtttgacccgtttatttttttaccacttattataagctgggaaaagaatatacacaaggaacctaattaacaagctactccctccgtcccataatacgtcccataatataagagattttgagtttttgcttgcaacgtttgaccacttgtcttattcaaaaacttttaaaattattatttattttatttgtgacttactttattatctacagtactttaagcacaactttttattttttatatttgtaaaaaaaaattgaataagacgagtggtcaaacattgcaagcaaaaactcaaaatcccttatattgtgggacggagggagtagaaaagagagggggggggggattttcctttttttatcagtccatatattatcttctgggtggattgggccgtgaattttccctaccccggcccatcgaattatgcaagtagaggaataagttcaccggaggtccctcaacttaaccgcgagattttttgagatcccttaaccacaaaaccagaaatcacaacccataaactatacaaaaccgttcactcaaggtccctaggcagtatatatgggtggtttcgctgacgcggcatcctagtcagcaaaaacaattaaaaaaagtacgtggggctcacatatcagccgcactcttcttcagtgagggaggccggcgcgagcatagagcggcagcggtcggtgggtggcgggtggagcggcaggtggtttcgccggcgccatctcttgctggctcccaagatgtgccgcgacctggagccccgcgcgagtggcggcggtgctcgagcaggccaccgcgggtgacctgctgaccatcgcgctcgacggcgccggtgagcgcgtccagaacgtcgacaacgtgcgccgcatcatctccgggcggcgtgaacggccggagccggaagccggaagccgagactacatgacttctatagcaaagcaaacaaactttggccacatcgtacgcgcacgcagcacgcgatccacttaatttggcagccactagctagccgcatgcacgaagctagtaactgctatgcgacacatgcatgtattgactagctctaactaatcagctaactaagctatgcattgcatgcacaccactaacagttttgtactggttaggcggtctgaggcgctgagcgcgctctactacgaccagctcaagctccagcagcggcaatggcggaggagacgagggcagcgggtgggaatg

SEQ ID NO: 41923 - DNA, 7577 bp, Oryza sativa
atgcgtttaccttattatgggtgctgttctgctgaaacggtcagttcaaccaagccatgctaaaaatttggaatcctgaacattgttttgtaagctatgcaaaatatgatgtcttcatgtcagtagttggtgaagaataatttgctcaaatctggcaagtgtgtttccattttgtttgatatgttttttttagataatgattctgtttgatatgtactgcctaaatttatgtggtcttgtagtataagatctgaatgaggcaactatggtgtgatctgtttggcaaatttagaaataagatgctagaacaatgtctccataagccctacctcccaattaacctattcacttgagtttctactctatctttgagatgtactaatatctaataattccacccaatatcattaggtgaaccagaaaaaaagtgagccaattgggtttatcaattcaaagccgtcaagtcattgcaccaagaagattgatctttaaaccaaaacaaaaaaaaaaaaggttcaaacagggggttcatcagagagcagccgccgccttcgtgctcatgctcgaggagaggaggaagaacaggttgacgacgacctgaacgccgtctcggaggacgtgcggggtgggagcagcaacaatggcggcggccgatcaggtcggaacagagctcgatctttccacggcgaccattgagcgactccggtgtccaaattatgaggctgcgacgaaatataagtgggcattccaggccagatcagcagaaacacctagcttcctaggcttgtcaaaggttggggaaaattgagatgaacttatcatatcttactataaagttatcccccactaactccttaaacttaacgtgcaaagatgccgcataatcattcattaattaacaagataccacatcatcatccactaacaatcatcacatctaaacatcatgcaaacatgctatatctttatagttttataatttaagagcttttcaaatacaaacatgttaaattatcatccaacataatttcatcccactaatctatactttctataaagttataacccactaactctaaagcttaacatacaaccatgccacatcatcacccactaacaatatcatgcaagcatgcaagagcatctacaatctatttaattctacaaattatcatgcaagcatattcaatcaccacctctcacatcatttccacaatagttttacaaatctctctatcatttttataatatttaatatatacttatcaacatgttctacattaaagtgcgaatttcatttgtttcatgataaatattgataagccctaagattttattttttttctttttactcctagctgaattgtaacgaaaaataatattgaaaattacttagtaattcacgcagcaaagcgcggggaatcccctagtttaaaagagaactatatgcacttgctgctcacacaggcaaaaagagctatgtttccaatataacagtttattacagttggtaggtactccagtaaccaagtactgatgctgcactgctttggcatccttggcaagacttttgatttatctctggctgtcaaattaggtcagaaccaccctgtcctagtcagaagagaatcagccaggggccataggcatcatcaagtatatgatcatgaccatgccgcttgtcactgatagtctgggttcaacagaagtaagcaatcctagtctagattggaatatttgaataagaaatacgtttggaattttagatcagtacaaaccccttgtgtgtcaggatccgggggcatgcgaatatcataaaaaaaaaagaaaacaccagaacaaactttctcaaaaagggagctaacaacttgttcataagagcttgaaatgtggcatggcgttagtcaatccaaagggcatgactatatactcaaaatgacccatgtgagtgctaaaagctgtcttctaaatatcatctgggtgcatgcgaatctggtggtaccctgacctgatatcaatcttagaaaaatatttatcaccatgcaattcatctaagagatcctcaatggcagggatatgatatttgtttttaatagtctgagaattcagttgtctgtaatcgatgcaaaggcgccaagacccatcctttttcttggcaaggatggctggggaagagaaaggactgacactgggtcatatagtttgagaatccagcaactgttttattagatcctccagggcattctttttatgatggggcagtcgatagggcctcacatttactggctttgcattgggaactagtggtataggatgatcacaatccctgctaggaggcaagtgtagtggttcagcaaaaacatcatggtaattatcaacaattggcaagagacttggtggggtaggagtagcttgtaagcagaacactgcaattgctgaacaatcagaatagctcctgctgccccctgagacaacagtttgtccagttgatgagcttggaccataaaattgcctttaggtactgtggctttaaatgatagtgtaagtggtatagaaccattgagggacagagtcaatgttatggtatgaagatccaggccgtgtttagttacaaaatttttcttcaaacttccaacttttccatcacataaaaactttcctacacatacaaactttcaactttttcgtcacatcgttccaatttcaatcaaatttccaattttggtgtgaactaaacacagccccaatgtaattgggctatgttcataaatgggttaattggatccagaaaaaatttgaaaatataccatttattttttttctcttagaaatattcgggttgtaatttaatttgcacaaatataccgttgatattacgatcacgcacaatgaaaacgcgagatcgctcggtgtcacgcggcaagttcgcaagagtgagcggtcttgcaggctcaaccagcgagagcgagcggtctcatagactcaagtagcgataccgatccttgccgctaatcactgattaattagtgattaattatcttaattagcaattaatcaattattaattgatcactaattattattaattaatcgttaatcattcaattttcaaaacgctctcgcacactcaccatgcgagactgctcggtctcgcatcctcttcatgcgagaccgcccgtgtcgtcagcccacgtcagtttcacgcaatggtttagcgataccggtggtatatttgtgccaagaagtttatatcaagactatttatgagaaaaaaatatgaacagtatattttcaaatttaagtcattggatccatgtcattataattttatcattttttgaaaaataccattactattcatctatttggaatcgtgccattgtaattatatagttagtcagtatatgccactacttacccgttcaaaacatattgtaaattttttggaccaaattaccctttttcatccttcatttctgaaagttcaagtgccattgatttggtttgatgattaataacaaatccaattatgtgagactaatgtttttataagcatttctttgcctagtctcatgtggatatgaaagtggagtgttggtggacctaaatcacaaggatgaaatgcatggagatcaagctatatgtatcactctttctcttcatgtacatattgatatgatcgtatataatatttccacgtgattggcatatgcatgtgtgactaatgttttgtttgagtattatctcttatttagtctatttacattgagaacgtggagatgatgaaggtatttttttagtatctatatttgagaaatgccttctattcttgtataggataagctctcaatgtttaatatcttgttatgcatatacttgcttcacacaaatattttgtatgcatacatttagggggagcaaatcctatactttagttatgcatgtaatcgatccaagttattcaccttcatttaattgggatctttacatttgaacatatatttgagtatatgacacttgtggtgttgattaatactcatcatttattcatatccttttatacatgcgatcggttggtcaacatgtggaggttgacaaccggatcattgggactaataattttattgagttgaatgaaagaaataggtcccaaggattacaaaggtgttgatgctcaagtgatatcattacacctaataataccaagaatgacaaagtgaagatattgaagatgtgtgatacgaagtggctattatagcaagatggtgaagggcaagcgatgctcggtcgcgatggaccatgcggcggtgaagggcaagcaagggggcttggcgccgaagaaccaaatccggtggtgaagggcaagtgacggctttgtcatgatggaccgtgagagaccatttgaagctacaagtaaccgcatcaatcatttgaagaatatatggtgaaacggtatcggcattggcgtccctcaagacaatgaaagaaagatgaaaaaaaggcattcctaatggtataattatcttcttatttacatttgagtttaggaatgccgtactattaagagggatgctacgtcgagatgtttgtgtatgtctcggtgctcaaagtgacctatcatagtgctaccttgagagaaacccaacctttaacctattctttgagtggttttagaccttgtttttggttgagtttggtagtcctctgagtgagctttccatagagtccaagttcataaaaaacggactcccgagcgaaaagttatagtcgttttactctgtgcttttcggaaagtccgaaaaattaccggaaactccgaaaatttctccgaaaattttcggacattccgaaaatggctgtgaatctgagatttgcttcagtaagttttcaaacttgtccgaaaatgcttttcggaaactccgaaaattacagtcttggcctccaacggttagtttttgaggggctcgggtatataaactcctccacccctcctttgaggggctgctgctcttggggagtattagacacatccaaagcccaatagccatccctatttccctacctttgtggtgcctctttgtgaggaggatttgagaagggaagagagtttgattgagagagtgaggagttgagagctagtgagcttcactccatcctttgtggtgactctttgtgagagggatttgagaaggggaaagagttggattgagtgattgagaagttcagagctagtgagcttcactccatactttgagcactcgagttcatagcaagcaaatcttcgattgtgtttgttactcttggggactaaggtctcctagacggctaggcgtcgccggtgagcacctaaggttgtggtgtgccacggaaagtttgtgaaagcttcgatttcacctctgcacggaaagaaatcaagagtgaaaccaaggagtgcatttgtgcaacctcgtgaggaaagggttgaaataggcccggcccttgtggctcctcaacggagacgtaggatccgtggaaccgaacttcgggaaacaaatcacgcgtctcctctcttggtttgcccatttgtgcattctctcatattgtgtttgagcttgtttttacccgatcgacttgcatgcttaattgatttagttggtgaccttatatcttgtttagataccttatttgtcaccttttgattcatatacattttctttatttgagctacaagttcatagctagtgttttatttcattatccgccgaacttttcggttgagaccggaacttccaatctcatatcggaagttactatttgaaccgaaagttctcatcattctaatatgctatgaagttgtgataatttttaggaacgcctattcaccccccctctaggcgacattaaggtcctttcaatttccatctttctactgttcatcttctccaccgaagctggatctgatggtcggtgccataaagctaaagctcgaagcaggtggcgccagtggtggcagtgggaggatgaagcaggaacagaccaggggtggggtgcagcagaaaggatgcgacaaaccatcttgtcttgtgcaatgcaaccgcccaaatcctgaaatgatatccatggctggtgccactagctagctagccagaaagtttccctccagattcttttgattgctgatccgtcgtctctgtctatcctatcatcctctcaagctccaatatcgatcaaccgtagaaaccccacgagttcaagggggatcttgcgcacaaaagacatttatcaagccctaattggacttttgtgtggaagatccgggccctgccaaaggtgcagttctttgcttggcttctgtcaaaggaaagactcccaacgaaaggtaatcttctcaaaaagatactccctccgtattttaatgtatgacaccgttgactcttcgaacaacgtttgaccattcgtcttattcaaattttttgtttaaatataaaaatatttatgttatacttaaagaatatttgataataaatcaagccacaataaaataaatgataattacataaattttttgaataagacgaatggtcaaacgttgattaaaaagttaactgcgtcatatattaaaatatggagggagtattgtgcaatcggcatcttgtgatctctgtcacctgactgaagaaacggctatgcttcctttgccccttcgctgttgatttctggctgaagattggaattgtcccaaacatcagtgataccagggaacttcactctctacaaccaagcggtagtctgccagataaacacttcagcaccttcttcctgctctgcctatggggactatggaatcatcgccatgatgttgttttcagaggggaatccccttcacttaatcgtttagcttctaagtgcatagaggatgccactctctgggctgaaagactgaattgtaccgacaggatagtagtggagtcctggaaacaaattctctcttctcctctccgttcaaatgtatcatgactttatgtattcgatcttcctttaaatgaaaattcaggtggggaagctctcccccccggtgaccagtctaaaaaaaccgtagaaacctcatgactagttgctgcgcctgcactgcatcacctcctcccgctgggagaacatcaccccatctgcatctctgtgcgccatcccacagattgctcgacgtgttgctcttcacccccatcccggttcctgttgcctcttccactgccaccacatactcagatctagctccaatggtggggaaatttaactatttgccacttttaggttaggcacttatccaaatgcccctcttaggtttgcacttaataatttgccactggagagaggtgatttcttaactatttgccacttttgcctacgtggcatgccatcgtggtgtgcacgcgtggaaaacaatatggaccccacccgtcagcccctttcctctcttcttctctacctccggcccgagcaggtgccgcgccgacgcgccatggcgaggaatacgacgacgatgggcgggagcggtgcgatgaggccgctgcacgcgaggacgtgggtgagcgcgaggacat

SEQ ID NO: 41924 - DNA, 1334 bp, Oryza sativa
  unsure (1)..(1334): unsure at all n locations
attccccccaatggtgaagaggatgacatgagagagtgggaaggggatgaatgaagaagataggggtaatttggtcaagaaaaaacagaaaatgtattgaaggggtaagtagtggcatatattatcaaataactattgaattacaatggcatggcttcaaatagataaatagtaatggtatttttcaagattggtaaatatgtaatggcatggatccaattaacccttgataaatccaatcacaacaaaaaataatggcataacccttgatatccaaaatgcgaaaagatgtgacagaaacagttccttgaatttcatatggttgaaggacacactgagctacagactccagtggacaatgtgcctccattagccattgttactgaaattggaggatggttggagatttccaaatttgccttgtgcaccgatgaaccattcactgagccgagtatgtgcaagacaagacacggctagataagtcaaatagaagaaattgcttttacacaagcaactcttaccttcactttgggagacatgaatatcgtagtactgccactatcaaccagtgcagtagcaaggagagagccaattttaacttgcaaggtgaaggtagttataccagcatttagaccattcaaagcatgcagcgacacttcaggagaaggttgaggttcagtaggactgtcaggagtagtgtaaataacatcacctgaatattcaactggtaggtcatcctcctccatggtaaccaagtaaagttgttagtttactttacacactcttccatgaccagggacccacggctcctggcatttgaagcatttgccccctcctctggtttggacaacaggaagagatttgcgtctgtttgcattggttccttcttgacaggttgcataggggaatccttaagagccactttagggtaagaatgagcagtgccagctggctgtatagaagagaaggtggggctgtcataattgtgagcatgttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41925 - DNA, 1441 bp, Oryza sativa
  unsure (1)..(1441): unsure at all n locations
nnnnnnnnnnnnnnnnnnnnnnnnnnnnnnnnnnnnnnnnnnnncccgatgatctgctggttcggaatagctttacctgactcgtactcctggatcacctggggcttctcattgatcatctgtttgcaaaacacaccatattttagttgaaggttagtgtatgtgcgagtggctgtggtaaaagttaatgtaacgctaggaaattctaaaattgtatggttggacagggcacctgtgcaagctgtgcctgggtcatcttcttgtccagccttgcttgcatgaggtttttcttcaggtcacttgagacacgctcatctagcatatgttgagaataacaagggattagagaacagtagaaataatgaaaaggacaagcaagtccaagtaatagattgaatttatgctttctcggggctaaactttggagataacacaaggacctgatccatccaatgaaattccatgtaaaaaaatcatcttttagcaaagaacagacagtcaaaattcctgtcttcaggcaattatatccgatggatgtttagaatgccccatcatttggttgtacgattgcttttgcacccatggtaaattttcatttaagatgtaaaaatgttcatatcaaatatatcttgtttaggcgcacacagtggcatataaagtcaacatagctcaataaaattatgatattgcatcaaagaagattatcttccatttagctgtttgattgctgtagatcagcaccatcaaagctacaaaaacaattatagagcgagcccattgaataagcaaacttacgatctaaatatgggcccaagctaggaagtaggatctaaagttacaccccagatttgtaaggctgagaccttatagtcatgcaagatataactggaacatcatctcatcaccctcatcgttcaaagtggtggtactgacctatcccatccaatccaattacatgtcacacccaatacaagcatatatatatctccaagttacgtgacaatcttttttggagcccaccagcatcagaggtatatatcagagggtcagagcaagtgcttagaagtatatagtgaagattcaaatagaattcaggtgcattttgttacaaactacagatgcaaatattctaacatgaacaaatgttagcaagaccaaataacatgtagaaaaaaaaactagtgatgtaccaactaggggatcttgatatgcacaacatggagtatatatatatatgaagttcccggttccgatttgaccattcatgcatggtgcacatacagacacatatatactgcttgtgaagcttgcagcatccatgaagatgatcataaaaggatgtatcaagaagacataggtccttacagtacatattcagcaagaatttgaataacaaatgtcaaggaccatcttagtagtatgatactcattgttcacagaa

SEQ ID NO: 41926 - DNA, 3421 bp, Oryza sativa
tgcacccctatttaagcgaagaccagaataaaagaaggatctttgaacaacatatagatcgaacaaaaccctcaaaatcagcatcaactccgcccaaaaaaaaacgaaatcttttttcccaaaaagagtccatcagtaataagcccaaaaacctataacctaaaaagaaatcaacagaaaacaaaaacgaactccccaaaccgaatcgatcgattccctctgcaccggagcggcagggatcgatcaaatccagaagaaaaatcgcacccaaaaaaaaaagaaccccttcgattcaaagaaaaggagagggaaaagcgaatcgaatcaaatcaaaagaaaagggtaggagggggtgggggaggcagtagtacgcacacttcttcatggtctcgatctcggcgccggagcggcgggcggcgttgacggccttctcatccttcttggcggcggcggtgggcgccttcttccgcaccaccaccggctcccagtcctgcctgatcggaccaatcccggccatctcgacgagacgacaagaggaagaacaagatgaacaaagaaagggttaggggatgaacgaacaaggaagaagagaaggttctggagtcgcaattgatgggcacaccccccaccccacccccgggccgggatattatatccactgaacgcgtagagtccgtgaccctgacaggtggggcccacctagctttgggaatccacggtgggaccggcacgacaagtctgaatccggttttgtttctctctcttgttttttcttctttcgttagcaattctttttttttcttttcttttctgaaatattgttcgcataaacacgaatacacatacaacaagtacactttatttgagccagtatcttcgaactgttggaactgagggactgtgcagattgtagctaaaataaaccttaacaatattgtcaaaatatataaaaaatggcatcaaccattatcaagttttggtagaatttcttatatatttaccaaagtttagcaacaaactaaacgtggtatggctaaaaatggtatcaatctgaccagcccctaagcatcatgttttgagattaataaaaccattacagacatcttgttgtcgatataaacattatttacctattaaagaatagttagagatgaatacaagtggccaagattgaaaatgaaagtcataagttttttcttcgcaaacagtttggttttatcatgtgctcatgatcaagtcacgggtcatggtaaagtcataagatattgttgatgcccaagggatagaacttgacatgtgcaattctaattgcgcaggataatggtttccttagcatgagcagtgataataatgttattagtattcaactgctatactcaagtcattaacatttttgttcataaaagtggaaagatgcttccgtaaccatcaaaaaagagaaaaaaaaaagaatcgaaaaagaaattgattccgtaaggaatttctacactggcgtcggtagcaaaggaaagaaaagccaaaaattcaagagaagtataatagaatctgctttaggccacttttcgtaggtaccattaatttgggccagctctacaaatctgtttgggccaagctgagccaaagcacaaaggccgaagagagaaggaataaatctacttcacctccctcagctcttgctcctaattgaatcgtctcccacaaccgtaaataccggctataacatctccccaatcttcgaaaaccagatcaaatcgagttcctcgactgtttgggtagcggtttcgtcctatgtggctctcatatgggagtcatcggagctagtgaagttcgtcggcgtctagtgacatgtgggtcctatgagtgacacgtaagacaaacccgctattcaaacagcctaagactcgatttgctctggttttcaaagattaagggggcgttatacccgctattgcggttgagggaatgagttgaaggatgcaaaatagacttatttgaagagagaattggtcaggctcaaatgccattattgggttcaaggcccatagcaaagtagacagtaccacaagtgaacagccgccccagtcgcaattacagtaactaaatgatgcctcacactttactgtaggatatatgttagatattggagaaatgatgaaatggtttagattgaaatattataaaaatgatgatttagcatgtatgtgtttagttttagaatgaaataaattgtagatataattactatactagaaagtaaccgcggaagtatatataggccagcacaattgaacgcggtttatttaattatcaagtcttatcatcagctaaataaagcattaatcatgttctgattggcaagctcatattgcaagcccgaaattcctcagttctcctcgaattacacgattcaaagtacgaagaacgtgtcgaatgaattctttttctttagaccaacaatgcaatttttactctaggtacaagatatacctgtatactccatctcgaatatatgcaattcttactctaggcagcctatacgttaccctgctcaatcatgactcaaaaaaagttccgagaacatgcaattaatgcaacaattaatcatgtttgtcattagtaaatcaaatacaatatcaaccacaatgctttgagtaagtaatagctctttgttttcagaaaatccaagtttttctcacacttgaaacatcaagctattaaataaaggtgtagttaattacctggcgctattcatctcatcccgaaatctgatgaacttgtagatatgattgctgcactggagacggcaataatttttccaaaaacatttgcaaaaagaaatcaatagagcgagacaatgatgtgaacaaataatatcaagaagcaagaaagggcagaacttaaggagtgcagtaaataattcatgtacagaaatcaatgaccatatggtaattgaatgaccttggatgggaacattttcactttctgcattggacattgaaagatcattgtcttgtggtagccctggatgaattctactttgttaaagcataaacacaaatccctgtagcaaaatcagagcaacttttaaaagcttatctcagtttgagcaacacataagatgcgcggctagtcacccccctcccccaccgcgcgactggacacgtggcgtgcggagagggggtggggggtgaacagtgtgatttcctttcttttctttccccacttctttttggttttttatacaaattttgtatacaagtatataaactttgtatacgtgtatatattgttttcgattttttatacgcacatatacaaactttatatacgtgtgtatacatataaactatatatattgtatataaatacatatgtatatattttatatacatatgcataaactttgtatacatatagaggg

SEQ ID NO: 41927 - DNA, 2100 bp, Oryza sativa
agatcgaggtagcgctggattcaattttattatcgaaaaaaaactagcttcattctgagtacgcaccatatatatatatttcaaatacacctactcacacgcgcgcacatccatataagtatgtcataacacacgtctaaataagattaaagacctgatatcatgtactcccttatattaaaaaaaaactttattatgtcgagattcaaacctagaattagattttttttcggacggaagaagtagcacacaagcatgcacgcgctttaatggttgaacatactaccatatctcaaaatgtacaaatttattctactcactccatttctacatatgattatttctgagttgtttaaaaaaatataaacatttatatattgttttattttttttcctcttcagctatcttattggttaatttttaaatcgcttgcatttcactccaaccatttgatatgttggaatgcttagatttccatgtgatggatttagtattaaaaaatgtttatattttgtacaaaatttgaatactttaaatgtttagatttccatgtattggaattagtataaaaaatccttatattgtgtaaaaattggagtacctggatttaaactctgaaagaaaatacgagcagcctgtcgagcagatatcatacgtttaatcgatctgatgtctgaaaggaaaatacgagcaacgtcgtaactcgtacgtgtatagccgggcagatgctggtggacatgttccatatataaaagaaaagactccagctatcttaaaaagtactccctcgtaaaggaaatcgtttaggataatgtttaagtcaaaccttgaaaatataaattatgaataactcttaagttgttgagtttgaaaatgtaaaaattatgtgaatagatttgtcttgaaaaatactttcataaaagtatacatatatcacttttcaataaatttttttatagaaacaagaagtcaaagttgtgttttgtagaccatgtcgctgtccaaaacggcttcctttatgagtatggagggagtatgctaactactctcgttttggtttcatatcgttttggtttcatatttcaagacggtttgattttctttgtttcatcaagtacataaaaaaaaatctaataactgaataatttaattctgacagtaggtttgttttgcgttggaaatgttacaatgtttttctataaacttgattaatttttttagaaaacaacctaaaacggggaagagagtatgtcgttagttttctctatacttctgtaaaatcaaagtgtttttcattgttattctatgatgaacaattggcattgaagattattggttttgatatttgaagattattggcaaagtgattttggagatgattgattttcaggtgatgaacagggttactgtttttatcgggaccgggatgaacagggttactgttggaccggtcagaccggcggaacaacggcggtcagaccggcgacagcaacaggaggcggcgacaggttttggtgattagaccggtgatctataccggtcagaccgatagcttctagacagtcagaccggcgcttcaccttcggtcggaccatgatccgtcgaatttgagagtaacttttaatttcgcaaaaagtttaggttttgggtataccaaccattcacacctccctctggttaacttagttattgtgtttcgatccaacgagttcctctcctccacacatgtgagttacataaatccttttatgacaaacccatgtcaacaaccttcattgtaagaaatggctgttgagggagacatgagatatattctaaaaaaaatgaaagaaaaataaaaaaaagaaagaaaggaagggagacatcagacatgagatgcccaggtggattagggtcggccggcggccgtgatcgaccaacaacggcatgcatgcatgcaaggggtgacgtcatgacgagatacggagggtggggatccacggcgggccgcccccgttcacactatcgccatttactaatccgcatagggttggcggtgggcccaccctccccgccttagcgttcacacctgttcctttcccgcgcttccgattcggggc

SEQ ID NO: 41928 - DNA, 1898 bp, Oryza sativa
tgcacaattaatgcaagggagtacaaggggataataatataggggttacgttttgcagtaaacagcatttaaaagtcacttagttgcccaaagccattttgtaaagacgattctagagctacacagtattattaaacaaggctgtgaaccctcacgaacctgccttaacccaaggcctacgatgatttggaccgaactggcaacccgacctgggtcccagctcgtcccaagccaacccaggccaaccattccatgttttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagccataaacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttaagactagactgagccacaaactaagccttacccattagacatgtggaagtacggtagtgctttgcaacagaggcccgagcttcatccttatagtggccggggtgctacttcccataactggcatgcacccaaaccccaccgaaaacaggttttaggggttttgaaagaggaagagaggtgtatgtccaattccaccataagccaaccattccatagtgtccaaatgatatgaaaattcccaaagtctaaagttataaaaccacctaatgttgcctaattaatcagcgaagcatctacctaaattcatactagtggaaccaggaatagagtgtccactagttggggttttgtttattctagggtgaacaaggtaataataacaatagcaataataatgtcataacaaaggtaaataggcatggctaaataaaacagtgataacgcgggaatttaaataaagcgataatgcattaatttaaattaaaataattttgtaaactgggatttcaatatgctcaaggatgatgtgacttgccttgctcgctttcccaaccaccggcttcaacttccacgaagagcggatcttccgaagctgcagcgtctacacgaccaacggaaaagaaaaggcttttactctaataaactccaaacaacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaattttcaattaaaaattcctatttattgcgtcagccgagggagcgggcgcgcggaccgggtccacgggaagtggggcccacgcgtcagccgctcggtccacggtggaccgggcgctcgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgctcgcgccccgatggtcaccgccggcgaccaccggtgcggcggagcggcgcccgagagagcggagagaagggggaaagcgaacggcggtcttcggctcaccccgggacaacgacgacgacgagaacggcggccggagcggaagaaggcggcggcgcggtt

SEQ ID NO: 41929 - DNA, 3200 bp, Oryza sativa
ggcgccggcggcggcgctagggcacgggcgctcacgggcgcggcgcgaggagaaagatgacaggtgggccccacccgtcagcgaggggggcgggcgggcccgcctgtcagcggcgcgcgcgcgcgcggggacccgatgggccggggggagagagagagagagagagggaatgggccgagccggcccaagagggaaggggggggggaaaagaacttcttttaggatttttctttttataaacctttttaactttgtttatttcttctcaattattatttgtgctctgaaaattccactaaaatttgagggctcctttttagaccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacagagggttggaccttcacttcccagcacacaaaatgaagcagcgtttagcgcgtgattaattaagttttagctattttttttcaaaaatggattaatatgattttaaaacaactttcgtatagaaacttttgcaaaaaacgcaccgtttaacagtttgaaaagcgtgcgcgcgaaaaacggagaggaggagttgggaagatgtcctaccgaacgcagcctaaaaagaggactaacttgatggtacaaataaagcatctttactaacaataatattttacttttttaaaaaaagccactaaacattcaattaaaaaagacaaaatattttacttttaatttacgtttaattcgttagatatgttttttccaaacaaactaaatagatacttttgaaatatgagagatgtttatatggatcatagataattgtttgtacgaatgaattaaatattatatattttaaaagctaacaaatagtttggaaaaattatctaagcaatgccgatgaagtaaaattatggagaaatagtacttatgaaacatggcaatgtcattgagttgatattcgatctatataagtttttcgaacgcaatctaaaatacatgcccgcgcaatgcgcgggctaccttcctagttttatataatttgctgatagacatcgaaaaaaatgtgtcacggatgatagataatttttttttggtaatttgctaaaggacactttcggctcaattgaaaagataaatttttaagaaagactagaatgcgtctaggaacacatgcttcaaacatgacgttagtgtaaaaaaaattagaaattatacaactcaaaatttaccatcaccccaaatacatcactagcatactacatcatatttcatcttcactccagccttagctcaaaagtttttgatcatagagacattcttgtcgtttttaagattttctatctccaattaagtcgaaagtgtcctcagcaaattactagtttttaaaagtgtttttttagcagtgacacttttttacgatgtctaccatcaaattacatgaattttgaatatcttgtagcaaattttgccaattaattttgtgtcacaaagattatatgccttatcttttaagaaaagtagtactattttaaaaaaatctcagggtatgttcagattgattccaaaatgaaccttacaaaaatttgacaatatcaaaattttggcaaattgacaacattgctaaaattttggtcggattggcttaataatattgtcaaaattctatacacattaccaatatttggtgacaaactaaacgtatcgacataattgtcaattttaacaaataatgatatgattgaaattttcatcaatctaaacaagccctcgtaaccagaccttttatgaatgttgttagataacaatggcacacttcctccgttttatatattgtaagtcgttttaactatttttttcaaactttattagatataatcaaattatagacaaattagcaacatctaaaacacaaaattagtttcattatagaatatattttcataatatatttgttttgtacagaaaatatgattatattttatttataaacctagtaaaaaaaaaggttgaatatgaaaacgggaggatttaattggattgtaatgttgttttgagttttcaggcgtcagcgcaggagtgttggtggtgctagtggccttgttgttggcgtacgtgggcatggagaagaggaggatgctgagggcgaagcagaggttcttcgagcagaacggcggcctcctcctgcagcagcagctgggttccctggccgcctccggcgtggcgttcaagatcttctccgaggaggaggtcagcaaggcgacggacggcttcgccgaggcgcgggtcctcggccgcggaggccacggcgtcgtctaccggggctccctcgccgacggctccacggtggccgtgaagcggtcgagggtggtggaggagaagcagctcagggagttctccagggagatgctcatcctctcgcagatcaaccacaggaacgtcggcaagctgctcggctgctgcctcgaggtccaggtcccatgctcgtgtacgagtacgtccccaacggcagcctccaccggtacatccacggcggcggcgccggagccggcgagggcctgtcgccggcggaccgtctccgcgtcgcggccgagtcggcggacgcgctggcgtacatgcactcgtcggcctcgcccccgatcctccacggcgacgtcaagtccgccaacatcctgctcgacgccgggctcacggccaaggtgtccgacttcggcgcgtcgaggctcgcgccggcggccgacgaggccgaggtggcgacgctggtgcaggggacttgcgggtacctcgacccggagtacctgctgacgtgccagctcaccagcaagagcgacgtgtacagcttcgcggtggtgctcctcgagctgctcacggggaggaaggccttctgcccgccgccggacagcgccgccggctcgcaggacgacgacgacgacgacgacgaccggagcctcgcgttcttcttcctcactgcggcgcacaagggacggccccgggagatcatggacgggtgggtcagggaggaggtcggaggcgaggtgctcgacaacgccgcggagctggtgatgcagtgcctgagcatggccggagaggagaggccgaccatgaaggaggtcgccgacag

SEQ ID NO: 41930 - DNA, 816 bp, Oryza sativa
cgtgcgtcgccgccgcctctactccccgtcccatccagatttgagccgccgccgccgtcttctccatgttgccgacctccccaaaaccgtcgacgccgacctccgggccaagtcgccgacgccgccgacctcctccccaagttgccgacgccgccgccctcgtccccaagccgccgacaccgacctcctacccaagtcaccgacgccgtcgacctcctccccatgttgccgactccaccgccctcatccccaagccgcctcctcgccgacctccgccgccggcctccccgaccacctccccaagccgccggccgaccatctcctccggtaagccattttttacttttttatattttgcatgttgtgatatatgcatgttgtgatgatttttgatgtggattagtatatgatgtggtgatttgtgagatgagatgagataagatgttgatatatgcagggatgatgatttgtgatgaggattagtatatgatgtggtgatttgtgagatgagatgagatgatatgttgatatatgcacgtagggatgatgatttgtgatgtggatttgtatatgatgtggtgatgtgcatatagatgagatgaatgcatagatgagatgatatgttgatttgtgatgttgatttctggttatgtgcatatagtgagtttcgcattttagggtatttgtgatgttaattagatggactttgtgaattaaatggaatttatgatgttaatgctgcttttagtatatgatgtggtaatttgatttaatttgatgtttcgcctaattttccatctaatgtcccgtgagggg

SEQ ID NO: 41931 - DNA, 8078 bp, Oryza sativa
  unsure (1)..(8078): unsure at all n locations
ataagaattccagagaaaatgagagtgctgtagaataaaatcctcctatagtataaataaagctactttatgtgcttatatttttttttctaaaagtaaatattaaagaaaatgtcttttgtggccctccaaccccaatgatgcccattgcgagggttttttttttttatatataaataagcgacccaaccattccccgggagtcaaggtggaagagacggacagaggccactacccgtgcaccacgccccctctcccacaatctcgcaaaaaagttgattttctttttcagcttcctcctcccctcctccgcttctcatcaatccactagcatatcagatcagattcctgtacacttccctttcctcgcatccaatcccgactatcaaatcatcaccatccttttgcaaaaccaaaaaaaaaaaagtagataaaagaagaaggttcttgcatccaagagaggaggacactgtccgtcgtgcagcgtttcttgcttggttgaatcgggtggttttgggggggatggcggggaaggtggagaagatggcgtcnatcgacgcgcagctgcggatgctggcgccggcgaagctgtcggaggacgacaagctggtggagtacgacgccctcctcctcgaccgcttcctcgacatcctccaggacctccacggcgacgacctccgcgagctggtatgctggtgctactctctctattcgatccccaatgaccgataattcttttttcatcatctgctactcctactctgctacctgcatgttcatgctccagatcagcagataatgcttgcttgtttgcttgctgcctgcgtgtgcgcgcttgtgaatatcttctttttttttaatggagtgatttggttgcttgtggactgattgactgactcactcactgaatgattggattagcttttgtgagtgggattgtggggattctgtgcttcagcataattggaacatggagagtgcccatgtttttgggggtgctttctgctttttctttattttaatttgggggtaaaaaaccaaaatattccaacagtttcttcctttattttttagtttgtcggttgacaagttggtgcttccagtgagggtactgagtggagttttcgttctggggcctgcccctttcttcttcttcttttttagagtattcggattatgtttctgggttaaaatatgtgtttgaattattgtgttcgtataatggaaattcagaaaaaaaactggcatcttttgcatttggagctgttttccaggggtgtatgtactgaaatctgaatatttactgtttgagtcaaatctgagctgaactttaattatctatcctgaattcctgattgattaacaactgccactttgtataaacaacagtttcatagacatccatcgtaactgaacacttcatttttatcaaattttaagcagaggaagtcaaagacatgggtgtcaaatgtttgtgttttttatttttgttgtttcgtcaaactgaatgtgacatgtactcattagttggatctttaggatatcaggaaatgacaactgtatattaaaagttttatattgacaaaccaacatgaattctttggtattgctagagccttgcttaagtacttactcctgtgcaaaaattttgaggtttagtgccctagtgtgctcaggtttggtgcttttgtatttgaagtcttcatttgcagacgtggctgcaattttttatagaagggtaaattgtgaatgaaatctgagttgatctttaattgtatattctgtatatctatcaaccactttaatgattacaacaaaaattccagctttacatgaacatgccatgaacttccgttgaaagtgaataacttggctttgtcagttccccgtgtggccaatgttcatgcacgagactaatattgaatacaatttgttttgtcaaaataaactgatacctttgttgcagacccttccatggatgtatgacaaggaattttttttttactttgatgtatagtcaattagtttgatttttttttgttctgaattgattggaaaataatgcctgtatttacaattttatatcaacggaaaaaccatggattgctaatttgttattgatatgtgtaggtccaagaatgctatgagatcgctgctgagtatgaagggaagcatgactcccaaaagctcgatgaacttggcaacatgttgacaagcttggatcctggtgactccattgtgatggccaaagctttctcccacatgcttaatttggctaacttggccgaggaggtccagattgcatacaggaggagaatcaagctcaagaagggtgactttgctgatgagaactcggcactgacagaatctgacattgaagaaacttttaagaggcttgttgttgacctgaagaaatcaccagcagaggtctttgatgcccttaagagtcagactgttgacctggttttgactgcacatccaacacagtcagtgaggaggtcactgcttcaaaaacactcaaggtgagttacagaaacaatactatgatatcaaacatcctatggtttcttatcatctaattgtgaaatttcaaatataatttaggataaggaattgtttggttcaactatactcaaaggatatcacaccagatgataaacaggagcttgatgaggctctccagagggaggtaagataatcaagttaatcactgactcatttatagtcttgattttttttttcaaattgtatgtgccttttcgattatttatagaaattataaattactttcagcatgatgctcaacatgccagattttgtgctccaactaaatttattaatgcattaataaggtgaatcagaacatgttcttatttttcagattcaagcagcctttagaactgatgagatccgaagaacccagccaactcctcaagatgaaatgagggctggtatgagttactttcatgagacaatctggaaaggtgttccgaagttcttacgccgtctggacactgccttgaagaacatcggaattgatgagcgtgttccttataatgcacctctcattcagttctcttcttggatgggaggagaccgtgatggtatgcaaaggatggcttttgacttctgtatagttcagttcttgtgcatttaataattttgtgcattgcaccaatttaggaaatccaagagtgacaccagaagtcacaagggatgtatgcttgcttgctagaatgatggcttcaaatttatactgctcgcaaattgaggatctcatgtttgaggtaagaattacttcatcccttatcttccacacatataaatcaattttattaaattctccaaattctggcagctgtctatgtggcgatgcaatgatgagcttcgggcacgagcagatgagctgcatctctcctcaaagaaagatgcaaagcactatataggtaaatatcgactacccattttaatagtgatggctatctgttatgattgacaatgttggcataatatcgtttccttgttcgtcttagaattctggaagaaggttccgcccagtgagccataccgagttgttctaggtgatgtgagagacaagctgtacaacacacgtgaacgagcacgccagttattatccagcggatattctgacattcctgaagaaaccactctcaccagtgttgaacaggtaaagtattgatcaaagaaccattggatgcttgtaactctgaaatgggcattctttcttcatcacctttgttcttaagtctaaacaactgtcttaccttgcagttcttagagcctctggagctatgttacaggtcactctgcgattgcggtgaccgtgtaattgctgatgggacccttctggacttcttgcgccaggtgtctacctttgggctgtgccttgtgaggcttgacattaggcaagaatctgacaggcacaccgatgtcctcgatgccatcaccacatacctgggaataggatcataccgtgagtggtccgaggaacgccgtcaggactggctcttgtctgaactcaatgggaagcgcccattgtttggcccagaccttcccaagaccgatgagattgctgacgttctagacacgttccgcgtgatagctgagcttcccgctgacaattttggggcctatatcatttccatggcgacagctccgtcagacgtgcttgctgttgagctcctccaacgtgaatgccatgtgaagacaccacttagagttgtcccactgtttgagaagttggctgatcttgaatctgccccagcagcagtggccagactgttctccatagattggtacagagaaaggataaatnnnnnnnnnnnnnnnnnnnnnnnnnnnnnnnnnnngggtaaggacgccggtcgtctctcggcagcttggcagctgtacaagtctcaggaggagctcatcaacgttgccaaggagtttggggtgaagttgacaatgttccatgggcgcggtgggactgtcggaagaggcggaggtcccactcatcttgccatcttggctcagccaccagacacaatccatggatctctccgggtcactgtccagggtgaagtcattgagcagtcctttggtgaggagcacctttgcttcaggacactgcagcgtttcacggctgccactctggagcatggcatgcatccaccaattgcgccgaaaccagaatggcgtgctctgcttgatgagatggctgtggtggctacaaaggaataccggtccatcgtcttccaggaaccacgctttgtcgagtatttccgccttgtgagtgttttgtttcttcataatcatcagacttggaacatttcatataatgcatttaaggcacttagctaaacattgttcatttcaggcaaaacctttgtaaattaattttctttacatttttcatgaaatcaggcaacaccagagatggagtatggaaggatgaatataggaagcaggccatccaagagaaagccgagtggtggcatcgagtcactccgtgccatcccatggatcttcgcgtggacgcaaactcgcttccaccttcctgtctggcttggcttcggttctgccttcaagcacatcctggagaaggacatcaggaacctccacatgctccaggagatgtacaatgagtggccgttcttcagagtcacgatcgatctggttgagatggttttcgccaagggtgaccctggcatcgccgcattgtacgacaagctccttgtctccgaggagctatggcctctgggagagaaactgagggccaactgtgaagaaaccaaacagcttctccttcaggtgcgtcgactgaccttgctagagctgattacactttggaaaccaatgatgcaacatctatgagatactgaaatgttccattgtcattcactcaatgaaattctttggccacttttgaccttcaggttgctggacacaaggatcttctcgaaggtgatctctacctgaagcagcgccttcgcctccgcaatgcctacatcaccaccctgaatgtctgccaggcttacacgatgaagcgaatccgcgacccggactaccatgtcacgctgcgcccccacatgtccaaggagatcatggactggtctaagccggctgcggagctggtgaagctgaacccgaccagtgagtatgcgccggggctggaggacaccctcatcctgaccatgaagggaattgctgctggaatgcagaacaccggctaagcgaactatcaactatgaagtgcctgaattcacaccgttttatatggactcttatcttgatttcggtcatttgctctcggccatttaattttgccgatgcagaggctcgtgcagtttctaatttctttcggaagatattttcaataatggagttgtacaagaacatcaattaatcaaaataaagtggatattatgttcattatcgtttagagcaacctggtaaagccatttttttgtgtagaccacatagtgagtgtgttgaaattccatttgcttaatgaaactgccattatctaagtaaagtcaaagggctcctttatattgaaagaaattcaaaagaattttgaaggattacaaacctactccctccgtcccataatacaagggattatggagggatatgtgatacatccctccaaaatattatgggacttcttgttcaaattcataatattagaatgtgtcacatctatctactatatactaaaagtccattaaacttcctagaaacgctatcaggtcgccacgtggcattcctacaaatactcttaagacgccacatggcactgtttaatctcaccgtcgattttcacttaaatttgtggacccattattttacatcattagattagatctattattaaaaataataataaatttctcctatacttatatcatacacatagtataactgttctacgtgcgtacgattgaaagcaattacctactgttcacaaaaagaatcatacaaagttagataaaaaaagacagtcaaaatacatgcatccataaaaatcgatggtcaacagacatacgtaggtgagagagaggacaggaagaaattatttattcaatctaatctaataggttaaaacactaaacccatcgatttaaatgaaaatcgagggctatgtttgtttaaaaactatctatctatctattatatgctaaaagtccattaacctttatacaaacacttttaaatcatcatatgtcacttctataaacactcctaagacgtcacgtggcgttctaataaatcaaagaaaatcataagaattctaataaaaacaaaatctaaccattgattttcctttcaataaggtggacccatcatgcattctctaccattagattcatcttaataaaaaaataagacacggaaaagacccatgtttttctaaggtggactcggacggtccatcatgctataccgtgcgtccggttacgagccggtttggccgcggcggcaagtttatcgctaattaatttatctctgtatatacgtagcacaagctaagattaattagctcccatattatgttactactaactcatagctatatttattatatatacgacaatatatataaatggaagctaggagattaacactaagattatacatatatagctaattaaattagttatacatgatttgtgaaaggagattaacggcaatataacatagctaattaaatcagtttgcatggtttgcggcaacattacatagctaattcgaaccaatgcatttggcagtctctagataaattgtccagcttaaatcgttgtatctaagatctgatctgttttaagtcatcgtgatgtctttaaaatttaaaaaagattttttaaaaaacaaaatgcatgataatcggttttaacttaaattgtttagaaaattagaaaaacaaagtcccctccacctcaccctcaccatcacatacgcacaacacttttcgccccatccatttttggcttgggttctccactctccacttctctctgtatcttttggagtagcaatgataaaaagagaaacaaccaataatatcgaaacatccacagttatattaagctacatgtcgcatatctattctaattgttgatctatacataattaaactaacaaattaagattcataataacttgtataaaatagaaaaaaattatcaatagaggctaaattgagccaattgtagaacatctaacaaattcgtaaagaaatagtttttaattttcacttaaactgaaacaaccgttgccatatcaattaaattggccttccctctatctatgatgccatggcattatgagttccttcacgtattattatatatgtaattcacactaaaatagcaatatttgttagtattagaataaaaatttaactcatattgactaggtatatttaaaaagctctataggacacacgtatcatagggaagcgaggtctagattatgtatatctccttcgcatttattgatcatgtagagtatgtgtaacaaattacatcaatatgaacaaattagagagagggttagcttgatagtaaaaataa

SEQ ID NO: 41932 - DNA, 6271 bp, Oryza sativa
ggaaaacgaacttacgaagcatggtatgtgccatctgtttgatattccaccgatataaattcatcaaaacgtaactatgatacatgcccgcgtgtatgtacgggctaccttcctagtttctctaaaatctcttatattatgaaacggggggagcataattttttcctatgtgtcatttggaacaaaggatttgatcatgtcaaattctctattgtatgcaccgaaaaattaccatgagctaaaattctcattttatttttcttttaagaagtccaatacagaactctttgtatttcctctcttaatccatcaaattcctatagttatattgaaccatccaaaaacaacatacctcaaattcttgtgttttgaattcctatgggacttatacatcccaacattctaactatatttttttctgtttctagtattcttgtgggatttatacatacgtgacattctaatcctatttattgtgttcctgcgtttctcaaatcagatcctgcattttacagaaaccctactaggaagcttgtttatgatggagctataagtagatatcatgcttataccattcgacatgtacttgtcattgatccattcatttccacaggctattgacattttcctgatacttggcataattaatactctgaaaatttttattgtaaattgtatttgaacaacaactattgaatgattttcttttaaacatatgtttatgggcatataaatgttctttttacagttaatagtctaacattttatcaaaaaaatacataatttaatttttcaatgttcttgaaatgatagttttattaattagttcaaaataaagttaataatcccttctttctataaaggtaatgcccactaaacacctaaagctcaacatgcaagcacaatatttattagcactcctaaaatctatatgtaagtacgtcacatcaacttattaagcacacaaaactcaacatgcaagcatatactgtagtaattatatctataattttttttcattctaaaactaaacatatacatgctaaatcatcactctcaaatcattttcaaaatatttcaatccaaattatttcatctagttacataatgcatttaattatagagttcatctaaacgtcgctgtttcggattggattcttgttttttcccttatatttacgtatttgtttggcatagctatctgtgcgcattgaatttgaaatttgtaagttaaaatataaaaatttgaaaatttatatttcattaaagtaggaagaaatataatttttcctcctactttaatgaaatataaatttccaaaatttttggatagctctcacttataaacaagtatacacataataatagtatggtatcaccgtataagaataaatggatgacttgcaacggatgatatgcaattaatgttatattagttattcaaagctatttgtttaagtatgcaaaatatgcaaaaccactatccaaaatcatcttaaagggtaatatggatggtattataaagttcagggggttagatatccggttttaaagtttagggtgctaggtggacttacatccaatgtttataggggtatttagattttttttatgatttattaactagtagtagatttgaagttcttaagtttaataagtttattagtggagtcatatctccacccacataagcaaaaaaaaaaaaatccaacctagcttttagcttaagggcatcaataatgtatatagaccaagtggtctttattattcccatttccacgatgtatatataaatagtaattgacattaagaatgggacccacactctaaaaaactttatatccaaatgctatagttctcttgtagaaaaagcaaaaggagggagatattatattttaatttatatggatgatccttatagctatgggtagctgatcatatgactctttctaatatcatctctcacaatggcaaaggtacctatataaagttataaggatggccttttgtcacattgtgaatgccctaatcgtgtaaaagagagtggcttattgctttaaaagaccaaacaaaaaaaactgtttgtttgtttagatttaaaatattcagctcataagctagcttataaaactaaacaaagaaggccagttaaacaaagcagagttactgcgagaaccaaattctatttcttataaaactttggttacctatgtttgggaaacttctgacaactacagtctttttttagagttcagctatcaaagtccctgaatagtttagatttacattcaaattctgagaaacgttattatagttataaaattcagaagatgaaatccaatttcctcatattctcaccgtgcctgcgtgccaagcaaacagggtgtagaaaactagaaaccctcgcaaaccccagacgcgttgggcgtcgtctccctgcgccgcctcccctcccttctctccccattccgcatcctcccttctgcgcgcaatcgcttacaggagcccctcccgccgcagccgcagatggattcctccgcctccgcctccgcctcccccacggcggcggcggcggctgacgcggaccggtacacgtacagcccgaggctgcggtggcagccggaggtcgaggagtacttcgccgccgcgtacggccgcgaccgcttcgcccgcatctccgaagccctcgcgtgagccgccccttccccctctcttgcttcattcctattctattcattgatgaatgggtgtgccttaacttttaggtcatctagtgtcttggtgttgtagtttgttgctttcctcgatttagacaagctggagcaaattctgttgcgtgcagctccaaaattttgcgcgcgcttggtcctgggcagagcggccattgcttgttttatactttgttttttctcagtttagggaacttggagcaaattctatccgaacagatgctctgattaacatgaaaaggattggctgttatgttatcctgtaactggtttagtaaaatgattgctcgagcggagttcgatcaagctaaaccatgctagattctggagctagccaaaccaagtatgattcgaattgatgtggcaaagcgattacaattagcaaaaggagcaaattccagcttccctccaaaaaatgaacactgcttaactgtaaatgctgtctcacgattatttatactcgttttaactttccaaaaaagttcttttcatttggcatttttcaaatagttgtcatgcaaaaaagcttgaactagtgcttgagaatcttctggctatcaggctatatagtgctaatagcacagaatattgatttgttagccgtaattattacatatatgacccatcatttgataaacatatcttatcacttttaaacaaaaggggaaaaccacccgttgctactaccattggattagcgaaggatatagatttagcttttgcgaagtttgcacccatttgctggattgtttttacttctccattctttttctccaaatttcatgctaatcaacacatccatcagagaccatttctagatttgctggattatgccatctaatcaaatgtaccatgtttcaatcagttctggtacttgcagttgctattttcttgttctgaactttcagcttttaaggacaatgtcttaatactcaggcaaatgatttgtgtacgaacaaaactgcatggatgtacttgattggatttacttagtgataaattctctgtggttccaaggtggtgaacaattcaaatgtttaggctggagaaaatgattcaaggaataatatcttggagcagcaatgcgtcaatctactagtgtttttttcgtagaaattgataagactcttagctaaagactgttactggttgttgacttatctggttccatgattttcatttagcttcctttttcaatgtaactaaagaacatggttttccagggaagagatgaaaatgaagaggcttctgtgatattggaaacgacaatctttatctatgctcacctttttattggattctctgttcttgcatgtctactataaagattcttttgctatgctcacctactcagtagttactaactacagatcagtgaaagactgaagttcttgatgacttgaccaaaacggtcaaataaaagattgagccagttctacagtttcatgctagtttccattataagtaaatagtgttaattttgtactaactattactttcttgattaggcatccttcttgttactcttgtattcgtgtcaatactctgaagtcttccactgatgctgtcatgcataaactgatgaatttggtagatcagaacggactctgtggtggaattaatggtttggagattggtcagcagaatggtggagagcaagcacatgaagggaattctgtggtgcataagtgcccatattctggccttgacaacgttttgtttgtacaaggttcaggaccacatgcactgcactacaatagccaacctgaccaatctattaaggaagtgattgtaagtcgaaaatgtgcagagtcggttcttagaggagcccaggtatgttttcttatgtttgtgtgtttgtgtgcttttgtatgtgcattatgttgagatgtaccgaaaaatggctagtcctagcataggagaataagttgtttcaaactttccgttgatcattctgtaattctttttttttttgctgcatcacctcaatcctatgtggagcatggggagtgctatataagtgtatgaattcactgtagtacttgctgttggactggatggtgactagtagccttcaatacctatcttgtttttttaaataatgcttttccgctcatgttgctgattgtcttttactttttccttttggatttggaaaattcaacatttcagttcgaggttgtatctttgcatgcttgttgccagttcatgctactagaaagtccacactcccaaatattttaactttccttttcattttctttatattcaggtgtacatcccaggagttttagcttgcagctcacatgttgaaaagggtgacaaagttgcagtgtcggttgctattgaacaacctgctgaggatggtggttggaccgttggtataacacgaggaactgttttacagggattgcagtcaggcaagcttttcaactgaaaaatttaaatcctttttgatagcttattgataaactgcaaatactctttttttttttctgtacttcatgtatgttagtcactgttacagttttaagtgtgaggttgttttccccagctaaaagtcatacacataacgctatgaaattcaattctttgcagatgcacatcatgaagaaagaaagggtttgtacattggtcaagggatcactgcaatgtcaaggtccggaatatttcgtgttcctcatggagttgcagtggagatgactgagagggtgtacaagctcccatctttcaatggtacatttacttctttgctgcatttcttggctatttgtatgtaacacgggtacaaatacactattgtatttcattcttttaatataaggatagaactggcaatttgataggtgaattattttcccccatatagtatgttgtgtgccaattcatgcaactaactttgaaagatgtgagatctccagtttggcgatcacattcatagctgacttctttagaaggagcattcattataagtagtcatgcatgggtttgacagccaccacgaaccaaacaatgaaggatatgaattagttcacgaacaaagtaattcctttatcttgtcatttgaattagactatttcttgaagatacagagttcagtgttaccgggacccgcgtgtccaaaaaagttttgccgcgtcgacacacatctctatgtcgacgcaggatgacatgcatcggacactgctagcgcgagtccaagtccaaaaggagagttgcaatcgctactgctgtgctgcagcctgcagggtgaagaaataaagctctagcagcagtcttgtagtgtggagtagtactactctactccgtagggataaagcatgtggggggagagagagcaggtggggggagagcagtgttactgggacttggactcgggtgtacgacttggcgagctctagaaaataagattcggtgactcgtctaatatatagaagttctaataaaaaatattatataaaataagataccaacacataaaatagttggttagacacaatactactgcacagaagatgccatttatatgaaacaaggaagtc

SEQ ID NO: 41933 - DNA, 4155 bp, Oryza sativa
tatgcatgaaaaaaaacatctgagcttaattgttattaggactgtcagtgagttctgactgcaggcttgatcttggttcggattcggaggaaacttggtcaggcttgagcttggcttgtgtaagctcgtgaacagtatagcatatgtttcaagaacaatctcttgataaagacaataaatttattgttaatcacattggcaacaggacgaggactaagagaaatatgtgatgctaagctgctgtgtatgcatactaatttatacttgatctactagtttatcaaatacaaaaaaattgtgcgcacagccaggttggcgatctattcaagctcggttcaacaaagcctgagagcctaggctttggcttcggctaagctcatttaattttcatttcacttctgattgtagattatgcctactattgtggcctactgatcacatgaccacgcaaatcctcatattagagtttgggctttgcatattcttggtttgatgcatggtaaaaatattgcgatctctgcatagagccaaatggtatagggttgttgatgggcatccctacttttgaaggttgatcggttgacctcttctttgattcgaatttcttaactgaatacccttgttaatgcctctatgaatacttacatttttcatttcatatttgcattttatttatttagtattgactgatcttcaaatgcatgatcctaaattttgtttctttatgtcgtctagatgtgctcgaaggggagatatttcttcagaatcttccaagtgttgtggctgctcgtgtccttggtatgaatataatttttaagttagcaaaattttcaaatttatggcaatatggctgttttctgaaagtcttaagtcatcttttatctgatattatgtcctttgctgtgtgatgtatcgtatatttatgtggtagaaatgctgaaaatcttaggtttgaatatagttattgaagcaacaaataaataagcaaatgttactgctaaaagattgaactagcaaatgttacagtaattgaatagttgtcacttgtcagtttgtacatagcatatagtttgctgacttttctttctatgcagaatatgataaatatttttctttttagttctgaatagcttaggtcaaaattttacagcctaatttgttatgtacagtacataattttctatttatttgtagatccccagcctggagagcggattctggacatgtgtgctgccccatgtgggaaaacaacagcaattgctatcctgatgaaagaccaaggagaaattattgcccttgatagatctcacaataaggttaattcttatgtcagattgattatatgatgtcaaatggagttattctaaacagataaaatgaatatgagggaacttacctggttacgtttttccctgcatgtcgtgtctgggtcatggcttcatgaacagtctacaaaaggttatatactcagataaagacaacaaattgaagtgttaatagacttacaacggctataaaaatgaatataaaaatttattattcagccaaaacacaaagtttgttttagcatatgtaaagaacagtaaataatgtccctatgttttgcaatgcaatatggcatcttgtgaaattataatgtgctaaaagatatactacattttatcaccatcttttggctaatttttgttggttggaagctaaaatccataacatgcaagatggagcagcagcaacacttcttccagtttcttggccaatttgtttattatgtcttcttccagtttcttggccaatttgtttattaggtcatttagtgtagcatacttataaactattgttttgcatatcttatctcctacccttattgattactctctccatcccaacaaaaactcaacctaggataggatgtgacctatccttgtccagattccttgtcctagtataggccccatgctatcctaggttgagtttttttgggatggagggagtagatatgattttaggctaggtggtccagcttcatgcaagggcattttttttgtggggcacttaagggcatttgtctatgtaatttatgaaggaaatagaaagataaccccaagtctcctattcctaattacttttttctggaacatgcagaggaactggcatgtcattattttaagatgaaagacaaggccttggacaaggtcatggccctataacccaaactcaaacactaagtatgaagggaaacctacaagaaatacaaaaccaaccaaacaatcatgaaacagagctatctatctaataataatgcatcaatacaaatagctccaagccacaagagcatccttgaagttcttctagtctttcacttaaccagctattttggttatattccttcctcaatcagtcccccgtccttcacaaagtgccattttattaaagtaatcatcccccagacagatttttaccccttttttatgtactatcctgcatgccagcattcttctagaaaacccccaaaatatatttccacattttttagctgtatggaaacagaaactagttattatgcaacataagggtctttgaaggtcattttcatgtcacggtgtaggttgtttgaaggccattttcaaatcgacacattaggaaattttgtgtggcatcaagaactgagtaacacatgtactccctctggttccataattcttgacgttttggacaatgacacggtctccaaaatatatgttttgactttatttttctattataatatatgcaataaataaatgcatgtttacttttttcatagtactttgaaggacaaatttatatatgttgttctagttcctttaaactaaatacttttaaagttattgataatcaaagttacaaaagtttgacctcaaccttatccaaaacgtcaagaattatggaaccggagggagtaatgtgcaatgacgatacctataaaactaacccttttttcaatcatgtgctcccactttacatagggtgtatttttcatcttagaagtcatattactttgcactttcataatattgaagtagattacaggtgatggatattttgaagttggccgctgagatggacctaaattgcataaaagcttataagcttgatgcactcaaatctgtacggaagaccaatgaagcaaaatatattggcgaagcaggcagccgcactgatgcaattgtgacactggcagaggactctgagccttgtattaataaagtcgatgctgggactactaatgccagtgaagacagttctactacatcagttgttcagactggtaagggacatgcaaatttgtacccatttctcttcattttttattatttaattttataatggtgggtgaatgcgcatgacacaccctgggatcacttatatttaattttattatttattatttaaatctaacctttttttattactgaagttacagctattttatatggttacactttgcactttgcggagaccaactaaacactcagaacataattttccctaatagatatatgcacctgtgccttaagtatatgtcgttcttaagctgaattcagaaatttgataattttgttttgttagataacaaaaaaacagatgataaaagatatgtgagcaaggcagacctcaggaagaacttaaggcgaatgaggaatggaccaggaagaaataactgctcaggtggtagagttgaaaattctaaaggatttttgcccaatagctttgatcgtgtcctccttgatgctccatgttctgcacttggcttaaggcctcgcctctttgctggtgaggtaagggtattgctagtttgcctcaccatatttagagatgcggttggtcataaattgagaatgccttttagaattgcccttttactttgtctgtatgtactcgttccaattctaaatgtagattgttttagccttcttaactctttcctaatataggtcattttaaaacttgtatgcaccttgttcacattttcttgttttgccttgccaaataaatggtactactcccgcaaataaatgactcatcttttccaacgtaatataagtgatggacaacaaaatcttttcagttactttcttaatcctcgtgcacaagtaaaaagacttacaattggaa

SEQ ID NO: 41934 - DNA, 1632 bp, Oryza sativa
  unsure (1)..(1632): unsure at all n locations
tttagtaaattaaaatattggacatccaggccaattatgttcattcataatttgtaatcaatattgaaaatgttaaccaaagattcgagtttaccatattttaaaataaaagaatggtatgtgtggcattatatgtatttgaggtattttaaagagtaaattgcattggtggtacacgaacttattaggtgggtgcaatttagtacatgaatttgtaaaatgcacgttttggcacacggacttatctaatccgtgcgaactaggtccaaaatggtttagcaaggttaattttacctagctgatgttaattaggatgtggcatgcatacgtatagtgagtatgcataaaacatgctatatttataaatttattctctactttatcttgaattttgtatgtttctaacccatgcatcattgctcatttgcccggtattttatatctttctctacaatcactatatctcattatatctttttattgaacaggtgcatgtctaagtagcaaccttctcatatatatgtttacgtagtatcctaatcagcacctaaagcaacaaaattagtcatgtaatgtccttttgaccttagttcgcacacgcaagataagttcatgtaccaaaacgagcattnnacaagntcatgnannananngcacccacctaacaagttcgtgtaccgctgatgcaatttactctattttaaaagttgaaattacatattttaatatgttggttaaaattatctttgtaatgcttattctgattaaggaaacatttttatactgtaatgatatgctaggtacatgaaattcattaataagttgaaatttatcagcctatggcatctcatattctgtaaacctgtaccttgccatgttattggaatttccaaatatgtcatgttgtaataatcttctaattgttatagaagtttgatttgcatctttgcattccaccaagctcaagtatttatcattttatgagttgctacaacttctaatatttagtgcatttcaatgtggcaggaaacgctggaatcactgagaaatcatgcgacgtaccagagaagaatgtttgatcaagctgtcaagctagttcaccctggtggggtgattgtttattccacgtgagtgttcaacattttatgttattactgtgtatgagaacaaaaattatgttactaagaaagatgttaaacacacacacgtgtgtggtaatcagatatccattctatttgtacttgaaattgcgataaactacagagctctagacaaacttagtgttggatccagaagagtagtgttcaacggctatagacgtatcagtcgaggatattacttactgagcatagctttaaaattagataccttctgtattccctaaacccaatagtaggtctcccctttcctctgtttatagattgtacataaataacataatccagatttcgtgtacagtacagttagctagctgatgtaccagtactaaagaaaacataataatgttgggcatgacattctagtcatacatgcacattttgttggtattcaggtagtgaaacagtcaaatttgtcccatctatatgtattgatcggtatttggtggaagctttttatgtggtcattccaaaa

SEQ ID NO: 41935 - DNA, 2187 bp, Oryza sativa
tgaagaaaagttgcaaagaaccctactcagatgagggctttaccctctcaaaaacttctctgaaatatttccctcaagactatatatgacaagatagatttaggaggagcttaaaaaagctgcaaagaatcaaagggcctttttggggagctttaagattctgagaagtagctggttgatagccagcttctgagaatctaattcattttctggattctacaactacagcttctcagaatctagaccaaaagttggactgtttggggggagcttctgattctgggagaagctctagtagctagaagctccccaaacaggcccaaagtatctcgcttaaacccacaaaatccccaaatccttcgcctccctcattgctattccgtacttcaccacccactgctccctcgtcactacctcgtacttcaccgcctcagtcgctaacctaagccatcgggggagaaaggcgagggattttgtgggtttcagggtggtattgtagtgcgaaggggcaaatttgtaattcttccaccactcttctctgcggaggggctagctgtaaatgtgttgcctacgtggaatgccacgtcggtggttagctttggtcaaacgagatttggatcggctatggttcattaaaccaagattgtggacctggatgtgcaattttcaagtttacggacctaagtgacacccgctctcaagtttaaagactggccatatattttactcatttgaatttatttatgcagtttaaattcccgtcatttaaattccgcagaggtttctgcttctcttccttcctgtttcttcgtgaaccctatgcttgcacaccaaaccttgtgaagcccgttgcaaagatcgccctacacggtgtacgtccatcgtgtgccaccttgtgtccaatcttgtcacccggcgtactgatcgttctggaccccaactcctctctgtgtttagtcccgatccccgccactgaccaagattgacctctaaggatcttaacttcagttacaccttgtcacatggcatcccgatcgtgctagacctctgctcctcccttagcataattctggtcctcaccattgaacaaggttgacctaaatcacctgcacacacatagactaaacaactgattttgggcacaggggaacctgacccacgttagtcgcacgcaagtccataatcgccaacattccaaactaaatttccaaccaaaaccaactcgtggtgttcccaaattccttgccaattttccaccacaagtaaaccaaaacaacacttggtttcacaagttcctgatgagaataccattttgcatgcctaggcattagcaatctttgttagcttgatgtgttgtccttgtacaagagaactgtttttgccaaatgagctggtgggtcaatcaaactgatggatgggccattttaataatcctatcgttatgtgctatatggataataatctccttgctatttgctactgaaactatgtttttactttttccccccaacagtatgttgaactgatagaatgcttatgcagggagtggttgacaaagcatgaatcacaacttgtccagagattcgatccatcatcaactctggatacaattggtttcttcattgcaaagtttgatgttgggcagaaagacgactgacgtaaggggttctcttgagcattctattttggatcctacactctgaaacttgctgttcctgacttcaaatatctcagcattaacacttgctgcagttagatcatttcagggccccaatcatttttcagtatgaatgggaaccaatatcccatatctggtttcccagaaattttgtgctcaactgtcaatattaaattattctttgtccaagggattattgtttgttgtaatgaaatgccaagggtgactggttgaaagtagaaacatttgtaaacccaaaatgatagggacttgagattttagatgttgggtggtggggatatggagctggaagagtggagttgtgctttgtatggcttagcatatttaactaaatcaatttcttttctatcacatggcagtatagcatactttctccgaggaaggtggtttctgacctgcatttttaagaatattcttcatagtgtttgtgattttacatgtgtgcttccattggcttcttctgccagcaaaagtcattcgtgtgcttt

SEQ ID NO: 41936 - DNA, 1395 bp, Oryza sativa
ctaattacgctgtaatgtggtgctacagtaaacatttgctaatgacgaataattaggcttaatagattcgtctcgtagtttggcggtatctataatttattttcttattagtctatccgtatacgtcacaattttttttggctaaacaactaaacacagcctaagttcagctacctggccacctcactgccatgcagaccacaaagaagtttgcgccagctgctcatattcatataaatgtcatacatatgttagaatatatatatatatatatatatatatatatatatatatatatatatatatatatatatatatatatatatatatatataacatctatataaatatggacaatgctaaaaagacttacaatgctaacggatgaagtaccttattaatagccggtattgttagaaaataaacagatcaatatttccttttttgtaaaatggttcatgttttaatgaactatcccgtgtgggtgttcattcacaatggtaatatataattttatttatatagcaaaaatgtcagagggttctaatatctagaagagggttttcggaaaataactggtattaatatatttcgtaatcatggttctttaaataaataatatttgaaaccaaaatagacacatattaccaaatgctcatcatttagcccatgcataacaagaaaacgaaaaataaaatcaaataaattccaacatgcacgggagttagaaaagatttttgattattccgaatttttaattatgtatttcagaattgaaaatttcagggtgttacacttatcaatggcatttcttagattatctccaagttaatacatattgctttacttttcattgtgtgagccacgtatttctacgtaggcagttgtcgatcgacaacaattttcttaagacatgcttgaaaggaggcatcagttcgctgtagaggatagaaattctcgtattattcagtgaaaaatgaaaaggagagttcaagtatgaaaacaatttataaataacttaaattcgaaattaaacaaagggatattggaataacggtccatatataacgtaatacgagattaattaaaattcgaaattagaaaagaaaaaattttaagtaggaatgcaattttaaaaaaactgaaataccgagattaaaacataataaattcctaaattagaaaaggaaaaaaagtttaagtaggaatgcaatttcaaaataactgaaattcggaataaaaataagaaatattaaaaagatagtcaatctagaacaaaacacatgattaattaaaattcaaaatagaaagtaaaataaattcagaagttagaaaaataaaaataagaattgaagtaggaatacaatttaaaataactaaaattcgggggtgcag

SEQ ID NO: 41937 - DNA, 4657 bp, Oryza sativa
atggtgatgtttttctggcctttaattaattacttctcatgttatttgtggatttaaattgaaacaaattattaagacatcaacgagtgcgagcacaaagatgagtacccctgctacggcgtctgcaccaatacggcaggcagctacgcttgctcttgccccaagggatccagtggaaatgccagcgtggagggtggctgccgccgcgacgacaagttcactctagcactcaagacggtcacaggtacctacgaaagattttttttatatattttatatattttttatatacctttccaaaaagtatttttaaatatgaattttgactacgccagcctgtggccaaataactttgtcacgtcacgcacagctggcgcggcagtgctgtcctgccacactagcctcttgccacgctaccatggctggcgtggcaaaacaacgcttcaacgccaaaaggtttagtttttgaaatattttttaagaacggtatattaataaaattaaaaaataaaaagtctaaaaaaataaaaaaattctcctacaaaacgggattcttcaccttaacaacaaataatcttgactttatatcactatgtcactgaaccgaaaatcacctgacactgacgttacagcagaggatccatatctgttgtaccaatatatgatacctctgtcccaaaatattaggacaagatgatattacttgttcggattcgtaatattaggaaatatcaccttctacactagtcgtaataatttgagtttggagaaagcagtgacagataagccagcagcttagtaaaaagctaatccctccgtcttaaaatttttcagatgtattttgtttgattaggacaagactttaaccaataattgcttcattagtatattatttatgtggcacaaacttatgatcataagaaattacttttcactataaatttggtaaattttactacaatacatctaaatcaatctatctatatatctatctattatatactaaaactccatgaaacttcctacaaacgctcctaagccgccatgtgtactcctacaaatactcctaaaccaccacatgacatcttaacaaattggtgggcctaatatttttatctattaaaattttattaaaaaaataaccccacaaacttccctcccctcttctctccccatgggcccatccttcaaccggacgaacaactcaagttcgtacgtacttaggtacggtctccctcccctcctatccaatctcttcttcttttttttctttagttataaaaatttttaaacaataataaatcttaaataaccatattttttctatagttatttgcatgttgtctatcaacaattaaaaaatataaggtgttctttaacctatatgaaatatttaatttttttatcacatcctaaactttgcatatcacgtaaaactgtcatataaaataggtaaaaattgataatgtagattacacgatcatatatcaattgacagaatatacataaacaaattaagttagatctattatataacaaacgtttctaagccaccacgtggcatcctgcaaacgctatgtactacgatgccacgtgtcactataataaattagagaaatttttaaaatttttaagaaaaagaaaacatctagacattaatttttattaaattaggtagacccattatttaccactattatatttatctttaaaagaactccttaacctccaaaccggatccaaattggacctgtacgtagcgtacgttttcttaaggatagtacgtacgtacgttagtaacgtacttccaccccttcttccctcaatttcttcatatttttgcacatatttcttcccctattatcatatactttattagttagaaaatatattttgtgttaaacaattcaacaactataacatctaaatcatacaactaacttttaattcgcttatatcttaaaattattttatgactaaatctacaggcaaataccaaatttccacaataattcaactttgagaaagaaaatgacactttggattatatttccagacttttgcgtaccgttgaagcaattacaaaaaaaatgaaataataatattgtagactctatcattgtgcataacttcataagaattaaattatatctacaatcataaaatctaaaataaaaatagctatgagtaatgttcccaaaatatataagttagaaagcaagagttacacgaaaaaaataagcagctataacatctcaatcatgggatcccctaaatcatacgagtaatatttttcttatgtattttgattattttacatttaaaaacccatatttgaggttatattatctgacttttatatgcaattcaaacaattataaaattgtgaatagtaacgatatatattttatcattgtatatgtcagggttacgggtcaggcataccctctacccttcgatatacgttacatatcgacatggcatacccacgcgcacgcggatgttttctacatatcctaaggaaacctttgacgaaatctacagatgggaagagtccttctcggacagaactgggtcgtcgacgtatcgtattgggtctgatatctctgagtcctacttgaaaacctccagatctatgatataaaagggaccccccggggagggcatggatcatcgaatctcagagccaacacaacccacacagcctacaaagccgaagtctgcgaggagccaagtcgtcgagagctagtcgaatccactcgactacaatctcgccggatccgacaagttccatcgttccctttgtaacctgtgttttccaccatataatcccatatcaactggattagggctattacctaccaagggacctaaaccagtataattcttttcttttgattgttcgatgtcgtactacgtagatccttgtaccaacgtaccccaataccctctatatccggtctacgggtatcacccgtcgacagtatataagttcacaataattcaattagacctgtaatgacaaaaagtaaaataaacctaataacactatgtattgttaaaaaaatttactcctcccattctgatattataataaataaaaataacattagtagatttttagtgttcacattttcaatattgtatactatgtaggaaaagacgagtagaaaagatagatcttaatcaatcaataaaatttttattctatttttagttaataaagtaatagtaagtaaaacacaataaatgtaaaaaaataattatatgtgcacgtactttgtcccattcgactttctcttcttctcctatctcactcaactcctttttcttataatttttaactaattaacaaaataataaaaaatgatcaataattacaaagctaaataattatgattcttatgtcatatctgtttttagtttatttgaactgttattttgtttataattaaataaataattcaagatgcatattactcatatttcacttcgtaaaaatgaaaatataccatttaagcatacacacctatcctttgcatggtaaccaaatagaaaaaaaatagagcattataaaaaaatgacaataagtattacatcacctcaaatcattatacatcctctgtagcgcatgtagcgcatttacagtggtacgtaacttacgtgctacatcttaattaaaagtaagaccttagaaattgtaagaaaagacatttgaccatcaattttcacttaataggtggatccattattttaaccaatagatataatattagagaaaatcttaagctgccatgtgttacgtcttaaaatttagacgcaaaggatatgaaaaattttgacaaaaaaaagcggatcatcaattttcacttaaatcattagaaaaaaagcccccccccacttcgccctccctcacatgtgcacaacacaacactacccgtgtcccctcctcccctcctgtctcagcttgagttctccactctctcctttacccctcctttctatagtgagaaataatcaataatattaaacatgcaaattttttagctgtacatctgatttctaatctaactattgctctattcataattaaatcaacaatttaaaggttcataacctctatagtttgaactggtataaaataaaatttaaaatataaaatatcaatagggactaaattgaactatttggagaaaatcaaataagttcgcacctttcactaaaattagacaacccattacatgttccatttttataatattttttaaatgcttacatgttaatggccttgcatctatcctatactatagtattatgagtttgtcagcctattaagccacactatggtagcagtatagatatagttagttgaaaagatatatttattactattaaatttaatttttcgaactcatgttaactatattttattttagaaaagatactataggtcaaacgtattactacgatatgtctttgttaacttatatgtaaatatgtaacaacttgcatgaatctaaaccaactaaggctatgttcgggagtgagggtgtcgcgaccgggaaaattgccttttcccgaacgctagtgtattaatccccgtcccaggaaaagccggggtacaccacacaaacatgatataaaagacacatctttg

SEQ ID NO: 41938 - DNA, 10115 bp, Oryza sativa
gccaatctcaaccggtcctccaatgaccggaaacgagaacgcagtggctacaaaccaaggcgactccatgtcaaaaaatcacccgtcgaaacggagaacggatcatcgacgacatccaagcacgggaaggattctgatacggccaaaccttgtccttccaacataaaccacgagccggcaaagatgacttccgaagccacaaggtcttggtgtcctatccacaaaaccaagaaacacaccttgcaagattgttgggttttcctcaacgtccgtgttgaaattcgcgcctgcaaagaacgtggaattcagcgtacttctccaactcgggatgtctattgtcctattcacaagacaaataatcacgacctctcgagctacaaagtcttcctcggcgccatgaaagctccgtctcctaagtcatacgtccccgtcagggataacggcaaggaacaaggagcgactccagcctcagatcgattcgttggggtaatcgatatcgatcctcacgaaccatcggtcttacatcttctcgaagactatgggtcatcaacaacgagcgtgccacgggaggtattggctatcgatgacgttggcacgtcagcgcaagccaacgcagaagcggcgaatcaatcgactactccagcccaacacatcagggtcgttcaagctatactgagggaaactccttacgatcccgttctgaacgatgacctcgagcgttggacagaacgactacgggaatcggtgaccaacctcagcaacgcgtttgaagaagccgctaccgcagcgcaccaagatcagccgccaactggcgacgccaatggtgaagatcggaacggagggaatcacctcaacgagccactcctccacctcgcggagctggcgatctctgagatcaaatcaatggccgccgagaagcacgacgcacacgagacaatgtaaatcgctctcggcgtcatgtctcttcacgactccatgataacggaaatcgaggagaccgctcaaacgaggaccgggatcacgacaaccaccacgatcgcaacgatcgcgaacgacgggggccagacaatactggtcatggccgccgccgtaacggcgacgataatggagatcggcaccgagacaacagcgagagacaacgacaggattcccgagatccaggccgttatcctcgtaatcgtacgccagaaccaagcgacccatcgtcatcatcatcatctgcgtcctcctcatcgtcagacagacatccacgaaggacacacgaccgccgacaacccaccgtccccaacgctcggtcgttccctacatgatgtccgatggcctaagagattctgacccggagcaattgaaaagtatgatgggagcaccgacccagaagaattccttcaagtctactccacagtactctgctaccggagcagacaacaacgcactagcaaactatttaccaaccgcgttgaagggttctgcacgttcatggctgatgaatcttcctccctactcaatctcttcatgggtagacctgtggcaacaattcgtcgccaatttccaaggaatgtacaagcgccacgcgatcgaagacgacctacacgcgttgacacagaactcaggtgaatcattgaggaaatatgttcgacgcttcaacgaacgcagaaacacaattcctgaaatcaccgatgcttctgtaatccgtgccttcaaatccggtgtcagagattgctacactacccatgaattggcgacaagatgcatcacaaccactcagaggttattcgagatcgttgagcgatgcgcccatgtggacgatgcgctaagatgcaagaacgacaagccgaagaccgggggagagaagaaatcagccacagacgcatctgagtcaagcaagaagaaaaatcacaaaaatgggaaaaggaaagctcaagtggaagtcctcacagcagaatacgcgaaccctcccaagcgcccagacccacaaggcagcgacacaaagaaatcttggtgccccatacacaagacggacagacattctctgaaagattgccttgttttcaaaaagtcgctcgagaagcacatggcgtttgaaaaaggcaagcgagtacgcgttgtcgagaagaacgaagagacggctcctcacgaatcggattctgcatatccggactccgacctccacgtctcacacattttcggcggctccacaacgtactcctccaagcgagaatacaagaaagtggaacgtgaagtctgttcgacatggcgggggggggggggggctgcacccaaaatgaagtggtctgagcagaaaatagagttctcggaagaagaccaccccaagagcgccgttatcccaggacgatatccgatcgtggtcgaacccactattcggaacattaaggtagcgcgagttctcatcgacggtggcagctcgatcaatcttcttttcgccagtactctaggcgcaatgggaattccgcatagtgagttgacaccaactgatcaacccttccatggaattactccccgatcatcatccagacctttgggcaagattacgttgcctgtgactttcggccaagccaacagcttccgaacagaatggatcaccttcgatatagcttacaacgccatcatcgggagaactgcacttgcgaagttcatggccgcatcccactacacgtatcaagtactcaagatgccgggaccgaagggaacaatcactattcaggggaatgcaaagctggcggtgtagtgcgacaagcggagcctcgacatagtcgagcaaacgcccagcccacccgccacgactgagccacccaagaaagtgagcaagacaaataagacgccgaagccggacggcgccatcaagatctttccactctccagtgccaatcccgacaagactgtcaagatcggggcgacactaaacgagaaataggaactcgcgctcatcaccttcctccgcgataatgccgacgtgttcgcttggcagccgtccgacatgccgggggtccccagggaggtgattgagcacaaactaatggtgcgacccgatgccaagccagtaaagcaaagactgcggagatttgcaccagaccggaaacaagccatacgagaagagctcaacaaacttctcaaagctggcttcatcagagaagtacttcatctagagtggctagccaatccagtcatggtgcggaaggccaacggaaaatggagaatgtgtgttgacttcaccgacctcaacaaggcgtgtcacaaggatcacttttctctccctcgaatagatcaattggtggattcaacagccggttgcgagctattgagcttcctcgacgcttattctagctaccatcaaatcagcatggcaaaagaggacgaagagaagacagcattcatcacgccgttcggggtattttgctatgttaagatgccgttcggactcataaccgccgggaatactttccagcgcacggttcagggcacacttagcaaccagcttggcaacaatgtcgaggcttacgttgacgacatcgttgtcaaaaccaagacaagcgactcattgattaacgatctgcgggaaacattcgacaacctccgacgatatcgcctcatgctcaatcctgagaagtgcacgttcagagtaccgtcgggcaagctactcggattccttgtctctggcagagcaatagaggcaaatcccgagaagatcaaagcaatcgagaacatgaagtcgcccacgagactcaaggaggtacaaaagctaaccggatgcatggcagcactaagcagattcgtcgctaggatgggagaacgagcacaacctttcttcgctctattaaagaaacaagacaaatttatatggacacaggaagccgaagaggtatttattgcactcaagcgctacctatcaaaccccgctgtacttgttgctccccaacctaatgaagaattattcctctatattgccgccacgccatattccgttagcactgtcattgttgtcaagagagagaaagtacagcgacaagtttattacgtaagcgaagctctccatgatgcaaagacaagatacccacagatccaaaaactgctttacgcagtcatcatgacatcaaggaagctgcgccactacttccaagctcacagagtcacagttgtatcctccttcccccttggagaagttgtgagaaacaaagacgttgttggccgcattgcgaaatgggtagtcgagctaagccaatttgatgtccactttctaccgcgaacagccatcaaatcccaggtactcaccgacttcgttgccgattggactatgccagacaacaaatcagacaaccaaggcgacaacgaaacatggacaatggcgttcgatggcgcactcaacagccaaggagcaggggcaggatttatcttgacgtctccttccggagatcaattcaagcacgcaatccacctcaactttagggcgaccaataacactgcagaatacgaaggactactcgccggatacgagctgcagccgcacttggggccaagcgactaatcgtcaaaggggactccgagctagtcgcgaaccaggtgcacaaagactacaaatgctctaacgccgagttatccaagtaactcgcagaagtcaggaagctagagaagaggttcgatgggatcgaggtccgacacgtctatcgcaaggacaacgtcaagccagatgaccaagcacgacgcgtgtccagacgagaaccgctcgaacctggcacctttctcgatatcctgacgaagccatcggtgaaagaagttagcccgaacacccccgacattagctcggaggtcactgaggcagaacgcgccgttgctgacatcgaaactacagacgactggcgcaccccattaatcaaattcatcagcagcgaggagttgcccgaggacgatacagaggccgagaaaataacccgtaaagcaaagatctactgtatggtcggtaatgatttatacaaaaaagcgctaaacggggtacttctcaaatgcgtctctaccgacgacggcagacacctcctcctcgacatacatgaaggcatatgtgggtcacacgccgccggtcggacattggtcagcaaagcttttcgacaagactttttctggccaaccgcccttaaagatgcatgcgacatggtccagcgatgtgaaacctgtcaattccacagtaaacacacaaagctacccgcgcaagcgctccagactatccctctgacttggccgttctcgtgctgggggctagatatacttgggccattcccacgaggacagggcggctacagattcctattcgtggcgatcgacaaattcaccaaatggatagaagcagtgcccacgggggaaatcaaggccgacaacgccatcaaattcatcagagggaaattctgcagatacggactaccgcaccgcatcgtaactgacaacggctcccaattcatcagcgccaacttccaagattactgcatcgggttgggagtcaaaatatgtttcgcctcggtctctcaccctcaaagcaacggacaagtcgaaagggcaaacggcatagtactacaagggatgaaaacccgcgtctacgacaggctcatgtcataagacaaaaagtgggttgaagaactcccatcagtactatgggccgtacgcaccacaccgacaacgtccaataaggaaacacccttcttcctcgtgtacggctccgaggccatgctccccggcgagctacgacatcaaagtacacgagtacagaagtattccgacgagaaccaggaggaacagcgagacatcgatgtaaatcttctcgaggagcatcgtgagcgagttgccgtctgagcatccagctatcaacagtccctccgccgttatcacgagaagcgcatccgagcacgcatactttcgatcagcgactatgtcctccaacgagttcaaacccaagcagggcgaaacaaactctcaccaaaatgggaaggaccttacacgatcacacaagtcttgcggccaggcgcattcaaaatcgcagacggcgacggtcgcgaattagcaaattcttggaacattgaccaactacataaattctatgtatgagtcaataccactgtacctataagtacccttacagcatcaataaagcctatttctaggtcccatatcacaatcaaagtgttttcacccgatgatcccttactctgatgacacctagcgttgaaacttgtccttatgtccctttacgctgtctcgacaaggcctccgaggaacctaagggatcttcggctggggacgcccagagccgataaggccttgtcagatcctgtatagacaaaagaccatgtaagatctggtcgtgtaagagttctcgccgtgcgtattaaccaagccgtgaaatcggaaatcaactttccaacctcacggctgggggctaggatcagagcttattcaaccaaggcaggtcaagggtccaagagccttatcccccgagaaaattcctccgatgacaaggctgggggttagtgagagtgtacgactcaaacggctgaccaaagtcgttaactgagaatacactcttacacacgacatctagagtaagatatatttgtttaaggaatatttctttattcacaaaataattcttacagtttttacataaattttccactacattacatctttccctaagatatctgtgacaggacacgagtactaccaagaaggccaacgccagtccatagactggaagatcttctcggccagcggcgacatcgacctcgccagatggtctatctccgccggagttctccgagaacgagcaaaaccatggcggagaaactcgaggtcctggcgcgggcggtgatctcgtaggcaagccagcatgtgccctccggcatatcggctcgctcgacgacactcttgcttcaaggcctcgtcgatatgcttgccgatgccatcgagttgggcacaggccccgtttagccaagagatgtacccggccgccgactcctcgggatcaccgcggactactcgaagttccctgcatactctagccatggaggcacagcaacttctcaagtaagagttgaaccacacctcgcgacctcggagcatctccacaacctgctcttttttcacggccagcatggttctctcaagttccgccacttcaaatttcgtcttccagtattggatacgacgatcttgatttgcaagggcaccctcgagatctgctaaacgtgacgaccactaagacaagctagatacctcctttacaacataaataacctaatcaggaggttactgagaggtgaaaaagctattcacttgaggtggccgttgccatcccggcctccgcatcaagagtttgatccacattgtcagacgaaacatgtggttcaaaatcgagtaccggaatcattgccagtgactcaggctgcccgcgctgctggacatcttcgtcatcaacatctctacaatggacaaaaactcccgagatcaacatacaaaattggacaagggtggtaatcgcacgaacgaaggcggccggagttcaagatttacacaatatataacaaatacaagaagtcctactctttaaaaagggagagaatagactcccccagatcaccgacttcttccatcacctccttacgcgtgtcgcttgccgccccctgatccaagatctcgcgcagatcgagctcaggacgcgacaaccttacacacgcgaggacgtgacacgccccagtgtagatgccattcgacgtctccttcgcgatcctggccgcatgcttggaggggatttccccaatcgctgtcgccagttccgcaagagaggaagtcagcgaaaactcgtcgggattcgccgggatcgtggacttgacgccgcactcctcggcgagctgatggaggccagtgtaggtgacccgcaacgagccacggatcttggagatattgttcccgagttccgacattcggtcctcgagcgccttccgttgacgatcgttgccggccaccaactccctcatcttcgtgaggtcctcacgggcttcagctagctcgcgcactaatctctcagcacgcgcgttcgccgtcgccgcttccgacctcgcctccgagatctcgcggccgatgccgcgagcaccagcttcgagaaggcgccccatctcgacttggagctcctcccaggtgagaatggccgctgcagaccacaacccgcagcgagatcgctgacggggctgctaggcgtcgcctctcggctcccggtcacgggcatgacatctgtcgaggccgtggcaggcgatgcgctggaagctcccccggacttggcccgtgcagccttcgcccgcgcctccctacggacaaccatgaatcaaacaccatttgaacgaaaagcacgagaatccaagaatctatttacttacttctcgccaatcgtcacaatgcgctgtcgtcgtggaggtggagaggacgcgtctgaagcctgaaagacaatcaatacagagtaagaagaaaccctccttgctgcacgatctgatgacaagatgaaattactgagggggtcgctgccttgcggcgatgtccgagtatagacgagaatttcctcgccttggtcaagactttgccaccgctagtggtggccgcatcagatgcctccttgacaaccttctcctttagagatgtcgccacctgatggtccgcgagtggcccgatgatgtcagtcaaaggaagggcctacgcttaatcaggtcataaggtgatttcgaaaggagaatacgagatgcttatcaattacacttacgttgatggcttcatcgcgttccgccgcccccttttcacaaaggggcacggggatgtcgctagccgtggtcggaccgctgatcatcacctgaccaacgcgccgctccacagctttgctgctcagacctgttaaacgggaaccaacttttgataagtcaagaggaacgcgagtacaagcacgccaagatgaatacgagaaagataccccgaggagaaacccgggtcgcgtcatccggcccgagatagttataggctggatgggtccgagcctggagcggctggatccgcctaccgatgaagtctgcagcgacttcatatcccgacaagccccgttctcggagatcatcgatgatgtcgataaacgactgaagagagggggtcaaagggggcttggcggtccaggtcggaatcttgtccggttgattctcgggaacaacgaagacagggttcgagtccttgatctcaagatagaaccacctattccgccacttactgcgggaaggacactggaaggggatataacgcgacttcatgccatcacgaagtcggaacccgacgcaaccagacaccctattggattccatccaacgcagttcatagtagaaacggaagagatcgagaaaaagctctaccccaatgtaggcctcacagagatgaacaaagatactaagaaaggcgatggaattagaattcaaatggagaagagaaagaccatagaaattcaacaccaggagaagaaactcggaaggtggagaaagaaaatcgcagagaacgtaatctttgatcgcaaccatgcgacccaagaggggccgaggatcagtacctcctgcttctctctccatgtctccacggccgggaagggcgccgtcctcctgaaggttcttcaacgtcgcgccggtggaagacgacttgccgagatccattgctgtgccaagatcgccggaaaacaagcctgagttggcgaactagggtttcttgtggtggcggagaaggcaaggagcgctggcaggtggtgtgtgttcaacaaggttggcagacttgaaaatgagctcccaaaattcctttaaataagcgcactaccgacggtgcgaattccaaggaacggagagagatccccgccggaaatctctgggcccgttacgcgcagcagttttctggacttcaattcaaaattcactcatgaccgttgggcttcaaacggcatgctcgactacgttctatctccacggtcctcgcaccaggaatgacaacgttctcgacacccgaagtcgtaaatggttgcacgagttcattttaagcagaagttgggg

SEQ ID NO: 41939 - DNA, 1454 bp, Oryza sativa
ttaaacggctggacggttttatagcattgagcacatactaatacatgttcttttaagtaagtgatgtcattaacttttttatgatgtttgatcatcttatttttttaaaaaaaatgattcagtatcatttattttgttgttatttgttttatcattaacggaattcaagaatgactttttttaatggctgtagtaaatttttgaataactgaataagacaaatatttaaatttcaatcaaaagttaacaacgtcatctattaaaaatgagatggagtatcaatgacgtacctacatgtaactacccgatgtccttagacaccaggtagcttgtctatttctagctattttatatcatattaatcatcatataactcaaaaattagactataagtaatttttattttgagttcaccaacggaggatattatgtaggcacacgaattaattagttggagtaaccagtgatcaagaaaaatggtttccaaacggatatatgttgagtatcgtgtaatgtcccttcaggtcaccaactagctctcatatgattattcaacagagtattcacaccttgttaacgttccctttctgtttctattttacagtttctccaccagccggcttccatgatcatccccacagaggtttgtgatttcttaatccccgttgatacagctgtgcatagttttatatttacacgctaatctcatgaacaattaatttagcttaagttttaataaagtatagttattatatgttattcctgaattctgatcttacaattttcttccattttgtatgtggcacctgttccttcaggattcgagaatgttacctacatgctcgaggtaactaattaacagtttgattcatttccatcaacaatattgtagtattggcgtatcagttgtaataggaaaaccaccaagaatatatttaatctgtcacacaattccatctcattctttctaaaagaatatttagtgacaaattaactgttgttcttaactaattttaatctgttgttttcagggaggcttcagttaccatgacttttcaggccacaagggcaccatcaacacaggagatgttcaggttaggtctccaactgtaccattaaacttagagttggactactcagagcaatatcctttataacttgtccctgttttcctttttccttattttcgttgaaattaacagcctaacaacaactatgaatagtgttatagtactgttcttcaagtaattacttctccatttcaaattacttgtcgttctaactttatctaaagccaaacatttatatcattgacatttactttctaaaagttcatataatttaacatcataagtttattttttagattcaccataaaaaagactttcataatatataattcacttgtagttataatagctagacgaatttttagaaatatatattaatggcta

SEQ ID NO: 41940 - DNA, 11793 bp, Oryza sativa
  unsure (1)..(11793): unsure at all n locations
ttatttatggctctttgaaacgtaggaatcttacaggagaagtcctctaaaactcctccattccgaatgcgacctgaacttaaacttccactggataccttttgattgactataagactattttctgtgcattttgcagtgcatgagatgcaactttgcttgttacttttgataaccacaaaaggatttttgacaacaaacagtaggggtcatttttaaaataaattgatcaaacgaattcatgtgcagattaattggaaaggaaaagagggaatattggttatgttcttccctcttctttcgcaacttacctccattgttttccgtgcatgttttttaaaatgttaaatgtatgtcttttcaaaaaaaatattacagaaaaattgctttaaaaatcatattaatctatttttcaagtttttttagtttaataattaattaatctcgctctgatcacttgctttgttttccatgtaacttgcctcccgaactcagcccggtaaagagagctaacttggtgtatgcatggttgtcgttggcagtggatgacggcggggcgcggcgtggtgcacgcggagatgcccggcggccatggcgtccagaggggcatcaacctctggatcaacctctcctccaaggacaaaatgtactcttcttcctgtgcctctctcatcagccgcagcaatggcggctactacgtaacagttgctgaccactcgctgtgccgtgccgtgccgtggccatgatgcgtgcgtgcgtgcagggtggagccgaggtaccaggagctggcgagccacgacatccccgccgcggagcgcgacggcgtgtccgtcaaggtgatcgccggcgaggccctgggcgcgcgctcgccgctccagacgcgcaccccggcgctctgcctcgacgtcgccatgcggcccggcgcgcgcctgcgagcgcccgtcccgcccgggtggagcgcgtgctcgtacgtcatcgacggcgaggccgtcttcggggacgaggccgcggcggcgggcgcgcacacctgcgtcgtgttcggcggcggcggcgacggcgtggccgcgcgggcgacggagcgctccgcggcgaggttcctgctggtggcggcgcggccgcacggcgaggccgtggtgaaggacgggccgttcgtgatgaacacccgggaggaggtggagcaggccagggaagactaccggaaccgccgcaacggcttcgagatggccgccggctggagctccgaccacgttgccaccgccgccgcggcgcatgatggtcaccggcgacggcgaggccggtgcaccatggtnngtcatcagnnctcatccaggtcgcaggtcaacgctgcgtttgcgcgggaggataggaattttgggaatttcgttgcaaagttgatgtaagataaaatggaggattaggtgtgccgtgtgaaactcctgtaaaataaccttatgcgaatattgaatttcgttcaatttttgtgtttgaaacgatgttaaaacttactgatcaaatttatgggtggtcatcttgtgtgagaataacatgtatgccattgaatcatcttgcagaatatctacttgagctgctacattgctaatatgaatttcattgtttaaaatacaaatggagaactaagtgttcattatttctttttgttgttctgggtggtcatcttgtttatgtttccatggaacgtcaaacatgcctttgtgccaaaatgccattttagaaaacagagctagtttgttctctccatggtatatcctttgtagtgtcttgttaaatgcagaacataatgtatatcagtttgatgaaaaactaggcgataaacctgccgattgtgaataggattaaacaaacaatttaaggtgcaacacagctgcatggtcaaactatttttcacctgtttcagtgatatcctctctacagctccccataaattttgatacaaaatttgaacttgaatattaaaatcagttaaagcagaaaaaaataacaggccaaaaatatttggattcgtcatacttgagaagttctggagatgggcaccaacatttcaagaaactggtggtaccagccgttacactggtttcctgaactctgcttctgaatttgtaagataaggtcataagggaatttcacgatcaactgaactttggaacaataacttactgtttacttccagtcgaatgtcagttcgtttcagttttttccacctgttacatctgttgtttcgttctttgattgcctgcctccagatttttctttttttttttgcaactaggaaggtagcccgtgcgatgcgcgggcatgtatattaattcgttaaaatcatgcttgacaagttaaattaatatgttttttcctttctttttaattgaatgttcatcgtctcgctcttttcttatgaaatattaagaatttattaattaatgaatatattttatgtgtatccagctatccttacctctaattcatatgcatgcaagtatattcttgcacaagatctatctatctatgatatgtggcacccatatgatatttttctaaaaatacctagtcaacaggagtaataaaatgtaaatttaatatgaaaaatataacttttaaatatgaaaggccatcaattatgtaatgctattagtggcttatatacacgcaagagtaaaaaacccatgacacattggaatttaggatagcacatatttatcattggcttttgtgtctttatatgtgtgaaagcaaatatgactcgtttgaaatatatataaaaaagtaaataaaaaaatattgttgggacataaaatgagatattttgtatagttaagggagtacactgattcaaactcggtgtaagtgatctatataattgtatgagtaaaagcactgcgatgaatataattgtttaaacgattaaaaaagttggataagagacttaaaattatttgtgccaatattcgatagttcgtatgtgaaataacattagcaatgcatgctagatattataactcattcattgtgtcctgctctgatactgttaattttctatttcttttctcaaagtattggattttttccattgctaaaataaaaagtttcgtgaggtccaatttaattgtgcgatgtggaatacaacccatatgccatttcataaagattgtgcgaggctccacgtagttcgatggaaatatgatttgatgtctaaacataaccgctcacgtgtcattgcttttacaatgtgaaatttttgttgatatcatagattgaatatttttctgtaaaattatattagagttataatttatttactacaaattgacattttttttaattttttagctagcttgtagtgggcataaattagtgcctatcatctttccacttctaaatttttgttacatagttaggctttttttttatgttcgtgccaatttattatatctgctacaatcatatatataattatacatttaactctcactaagtatagttaatgttatttttctaatctctatatttctagcacctcgatgatttgtctggtcgaaaactctctcttttgtttcttctttcataaagccataccaccttagttttgtcttatgatgttgaatctatatttgatctaaattttcaaagcacataatcttaactgtgtttatagcttttttggatgattaactaaagatgcaaactgtacaaagtaacatataagattacgttgtttagctacgaaataaatttattttgtactatgtttctgtcattatcattcatcatttctgcagcaacgtttccttatacagggttttatctaattaggttagttgtgacttatttttcttgattgtcatctcatgctatgttaagccatacttcctccatgcatgatacgatcaaatttcctgttctgttcatttaggtcacgtcaaactttgtttgtgcttattctttgatgtttcgtatcttaatttatatgcagtgaacatatacaaaaattaatttttggactgcaacactgcattacgattaggctggaagattttatcatatgaatgatgcctctctctctctctcgttaacggaacatatgcgcggagtatgtgtggttgactcatggatagcgtcatcaagcgacagaacacgcgtgccatcttgaattttttaagtaggttaagattaagattagatctagtgattgaaaatatttgccctaccaatttaaagaaaaaaatcaatggtgagatgtttttcttttttttcttataatttctgtgtttttttcataatttattagagtatcatatggtggtttaggagcatttgtaggattgccacgtggtgacttaggagcgtttatcgaatctaaatttaatatttgtgtaatatggtgcttaaaaatttgctcttaaaacatttatattagaaatctaagctatttatatgtatatggattcatcaattaaagttgaatagttaagttagagaaagaaatgaaggaaagtgggagggatgaatgtacgtagtcaccgtgaggggaggaggtccaggagaaaagggcggtggagatgatttttgatgggttttgggatttttttaaaagatagatctgacggtgtaaaatattgggtccaccgtattaacttaaaattgatggctatatgtatttcttttttcttataatttcttcgatttctctgatttattgagtgctggttgttgtaaataatggacacatacaaggccagccacgtggcatattgatggtccataattggcacctataagtcggtataggtgtcgattattggtacaaaacaggcacctacacacattataggtgccgattctaccaccaacaccgatgactaaagtcatccgtgctattatctgggtatcggttagaaaaaccggcatgtaaaagggtttcttgttacctatggtgtagttgaatgtgctcccagtaaaattattgatttaaccccagtccacctggtccatcttgtatgagcacagctactaattaaaatttttgtgattagctggctggtttgcaagctcattggatgattttctagcaacagtgtagaagaaaaaaaaaatatcggtgttgtttttttttcaaaactccgtaataaaaaagagagttctcaaactactggattgacgtacgaaaaccatgcagttttcatggttttatttatcggtaatattggttcacagtgatgaccccacgtccttttttggttggctccaccgctgatggcaggtatagatctaatctaacgatacagaataatgggtccaccaatttaaatgaaaatcgatggtaagattagactctgccatgtggcggcctaggaacgcttgtaggagcaccacgtgacggcttgggagcgtttataggaagtttaatggacttttagtatataatagataatagaagataatagatagatagatagataagcttttcagcactttttttcttccctctatgttttccatttcctctttccgccggcgacaacttgtttttcttttcggaactggaagagtcacttaagcatcacattttactcgagattccgagagcgtctcaactgctgcgccagcttaccgtccccagagctcttttgtttttacaatgaaaatactgtcatggaacgtaagaggtctcggagacaaagaaaagagggatttagttcagtcaaccctgtttgagcacaagccggatattgtttgcatccaagaatctaagttaagcaatatagacagcttcacagccccagcttcttaagaaacttccactaccagtcttccaccggttcttcaggaggactgatcacagcctggagaaatgcaaagttcaaagctgccctcacctgctccttccattccaccatcgatcaaacatccttcctaatcacaaacatctatgctccccatgccaactccgagagacaagaagtgtttgatctgctcactgccttgaggaccacacgccttgagccctggatgcgcatcggcgatttcaacatatacagattcccacatgagaagaacaatgacagcataaatacaagaggaatggaagagttcaacagttggattaatggtgaggggttgtttgacatagacatccctagtagaaagttcacttggtcaaacaagagaagatgcccgacttcggtaaaacttgacagagttctgatcgacaccgcctggaaccaaactttcgccaacgcctccgccaaagcactaatagcaacaacttcagaccacatccccatcctcgctgagttctcggacaactgttcaaaatcagacatttttcgtttagaaaattactggttgcagatgcctgatttcatcgcgatgacagaaacaaactggagcagaggaaccagacccctgacagcaatctccaagctcaaccacaaactcagacggcttcgagccagcacgaaagcctggaacagaaataagcgcagcattccaaccctcctgtcagccaacaaagacacattggaatacctagacaaaattgaggagtggcgtcaactgactgatttggaatactacctgagacagaggattcaaaaacactgcaatgagctaaatgatttcatcacgcaaaaatggaagagaagagctcgtatcagattctgcacactaggtgatgaaaacacaagattttatcacactctggcttcagtaagtagacaaaaaaattcaatcagactttttattgaagatggtgttaaattttatgacgatagcaaaaagctagatattgtaacctccttcttcaggcagctgttcagtgaaacttccccttcggacccaacattcacactacctctgctctaccctcaacaagaatgtcttcagagcctgtgtacacccttcaccaaggaagaaattgtaaaagtcatccatagtgcgccaaataacaagagtcccggacccgatggattcacgaatgagttttacaagcgattcatcaacaatatttaaccggatctgcaagcagtctttcaagacctctttgacaacaacatagatctttcaggtgtcaaccaatcctacattaccctgattccaaaggtcacagcagcagctcacatcaaagacttcagacctatatccctactgcacagtgtcccaaaactgctcagcaaaaccttaaccaacaggctgcaaaaggaaatattaaagttgatcgaccctatgcagtcaggcttcatccgtggccggtcgatcacagagaacttcattctcgcctcagaactggtacagtcagctttgaagggcaagaaaccaatgatagtcctcaagctagattttcacaaggcctttgataccgtcagttgggacgcactgttccgaatcatggaagcaagaggtttcccggacaaaaggattggttggatcaaagcactattatgcacaggcaaagctcagatcaccaacaatggacaaaagggagaacagatacagtacaaaagaggggtacggcaaggagaccctctatcaccctatctattcattttagtagctgatgtgctccaaaaaatgattcagcaagcattcagcacaggaatcctaaagcacccacttgacattgaaggagcaccgcccaatttgcaaatacgcagatgataccctgatcctactaaaaggagaagctgaccaagcaacagcaattaaagaaattttggattcctttgcaaatttctcaggtctgcaaataaattaccataagagcactctagtacccatacacctgaatgaggcaacaaaaactatggtgacgcaaattctacattgccctgctagttcactcccttgcagctaccttgggttacctctttcaaccacaaaaatctcgcataacatgctgctgccagtcatctcaaaagttgacagatatctagccggatggttgcctctatcaaagggaggaaggctaactatgatcaacgcagtcatgtcagctatcccgacatactacatgtcatgttgtatctggccggaaaaatctatcgaagcaccggacaagataaggcgtgctttcttttggaaaggggaaaaatccataaaaggaggtcactgcttggtggcatggcaaacagttctactacaaaaacagcaaggtggtcaaagatctcagggcacataacacagctttaattttaaagctaggacataaggtactcttttgcccaaacaatccaatgactaacttggtttagaaggcgatatctgaagcatactgtacagttactccccagatccagtgatacccccacttggaagctcattatatctcagtttaacaccttaagtgctgcaactcaggtaacccttggtaacggcaaaactactctgttttggaaggataattggctgcaccaacggttacaattcacacacccaattctattctcctttgctctggatcaggactgcacggtagattcacagtttacacaaaactcctggcatgtcaaattgcatcctaacctctcctaccaagcagaattagagctgcactcgcttatgcaaattctgcacaggcttagccccatccctgagattcctgacacaagagttcttttgcattctgtacccaagttctcaacctcaaatgcctaccaacttctgacttaccatggagccctttggaaaccggcagaatatgtctggatacacaccatcccacaaaactgtaagatcttcctttggttggctttcaaagacaggcttaacaccaaggcgaatatggtcagcaaatgctggagcgaagatccgcactgcccgctttgcccggcattagaatcagctgaccacatcatcctgagatgcaagaatgctaatagcctatgggaaaaaatgaacctactgcacctggcaaaccattctgaatcatcctcagctttccttcaagcagtcgttgacagaaatcattcaaatagaggaattgaacctatctggtttgcagcttgcgcatacacgctgtggaaagcacgcaacaacatgatttttgagagacaaattgacaacatgcaatcatcattcaacaaatctcagacacactaaagctccggagcatgagagccaatgaagcaaccaaagaacgaattctctcctggtgtgcagggctgtagttgtgacattactttgtatatacccttgtaattccagccccctgttttgtttcttttcttttcttttcttttgtctattttatttttcccgtttcccctttcttaataccccctctgctataacctgtaacttgtaaacctcatttctcttaatgaaatgactataaggtagagcacgctctaccttcttgcttcaaaaaaaaaaacatcgcttattttccatttagattgaacatggaaatgcacatatgtgaaggactagatcattggcatttgaactgtgaaacacggtgtatagccataaaatttaaatggtgctaaacaattaaaactgtccaatgaattgtacatcatcgctcaatcagtatatcagaaaggagatattgacttattgcaataccattgacaagaacatactgtattcatgtttgtgtcttggaagtaccataaacctaactcactcttctagcttgagattttctaacatggaaatgattaaccattacagctgtatcttgatgaaggagagctaagctatcccataagtaatagaaaacacctctaaaaaagacgaaaataggtatggcactgtcatgaagagaacaagtcatcctataaaaaccacatgagtaacttagagaacaacagggcacatgaacacatctaagattctaagtaaaagtgtaactgtaatgtgagtgcaggtaccatgctacaataacaatactacctcttcaatttcctgtgggatatgattatgaaaatcttgaagcatccgatgcctatccaaacaaaagaacaaaactggatttatgatggaaagattgtagttcagacttcagacagtagagtccttaggagaagaaaccaagcttttgcttctcctcatctaactcagctgtatcattatcagcattcccttgcttagctacagcctcacgcggcagtggagaattccattttgttgtaactgattgctgatagagtaccccgccagccagagtgaagagcaagcaaaccaaaccaattgaactcgcatgtttatcccagatcataacattgattgcaaccgtgagaaacttgttgacaacacgcctgttactgtgaaagccgtggcagagattgttttccttgctgcgaaaccaaagaagctaatgagcagcccaaacacaggacaaggaaactgtcacaaaggcatcaagttcaaaccaactctggccccttgattcaatggctgatctgaagactgataagtgctctccagtcaaaaaccaaaatacaggagcgattaccagctagagaagattgttgtagagtacgaagccccatgtgttcagcccagtttatgagaacttaagattctgagaagtagctggtgagaagctagctggtaagaatctgtagaagctgagaaacccagcttctagcttctaatttatttttggatttcataactatagattcttataatctgagtgaaaatctggactatttggtggagcttctagcagtaatagcttctaaaaaaatcttcagctcctagaagctcctccaagcaggcccatagttactagataagcaactgcccatgggtaggctgtgaggctgaaccccgaatatgtcatcacgtaaccaacagcacctcctaaaatagtcacaagggacaaaattgtaagcttggaaggacatggctgcttcctgaatcctgaaggcagtatcatcagcgatggcaaccaaaagcggggtcaacgatctgaacactataaaggtatccacattagcacgcttcaggagatgtgtaggtgttggtgaagatggcaaggtagaacacaagcgccgccggcgcaaacttctttgcggtctggaagttgaagggatcatggtagagtagtccaagctttgcgagggtccagacaccagccactgatgtcaagtactgaagtgcagtcaggaggccagggtagctgaacttggtcatggcatacttgttgatgatcgccagcaagctcgagcacagagaggcagccgaaccacggagccctagcagctacaaacgcctctcaccaatcggccgagatgcagatcccgcaggtgagattcggattccgatcgcattcgtgaggaaaggggaaatgcagagcagtcaccgctccgacgaggggtcttaccaagaaagctcaagacagtatatatctcgggtggacggattcccgcgggagggggagggagagctccgccgctggcggccggccggcagctgccgcgacccgcgcgtgggcgaggttgagcggatcgggagaagagggaggggcatgtttgtggtgtaatttggcttctattatttaatcttggtaggccaaattatttagtttagctttcattatttattgaatgtttggagacgtatacgcgtcggacgtacggcgcgagccgaaaaatcggacgcctcgcacgaccgtccgatgcagcacgcgcgcgccagccgtccgattggagaaacaactgtcacccgacgcccgcgccgttgcaacacccaaacacattaatctgtttcattcaatgtgtcccgccgttgaccactagcacgaggggagatcttcgcggagcgactggcgct

SEQ ID NO: 41941 - DNA, 3300 bp, Oryza sativa
atgtcttccctcatgcaacatttatattcatgtcttatttttaattgtaacttctgtataaatttggactggaatttgacttgaacaataatccttaacttgctaaaacataattgtacaagttaatgaaacaagataaaatgttacagattgatgtccaagcaccaagctcatctggtggcttccttgatgtgctattatccaaatcctctgggcatgaaactgacttggtgagttgtccttggatttgaaatatcacaaatgtaggggggatattttgctttgaaaacacagtatgtaacttagtgaaacttttttgtgtactaggttgtggatgtggaaagtgttgacaacacagatgtggctgctgtgactgttgaaattgatgaacaattggatgaagatgcatctgaaaatgatgaaaaagaaaaggatgttgtttgttccccaccaattgttccatacattggaatggagttcgatatagtggaagaggcaagaaatgtttacaacgcttatgcttataagctaggatttggaacaagaattgcatcatctagaaacagccaggcatcatcaggggaaaaaaagcatcgaagaaatgtaaagtatctgaaaatggagacaatcatgatgatgaaccgaagttgataaggagagaatttgagtgtgttcatgcacgtaagccagaaaataccacaaaagatagtgctggtggcagtagcttcatttctgaagagaacaaggaaaatccgcccctgcttgaaggtaacaaaaagaaggctcccttgctggtggaagggaagaggaaacgaccaaaggttgcaaagtatgattgcaaagctcatatggctgtagggcttagggacaacaagtggagagtcattgctttccaaccaaaacacacgcatccgatggtgaagcgccttggaagaaggagatattacagatctcataggcacatctcaaatgaagactatgaatttctaaagactttgcattatcgaaacattgcaacatcgcagattttggcgttgttaggagatttgcacggtggtgtaaggaatctaactttcattgctaaagatgtctcaaatttgaggacaaaactgagacaacaagtttcactcaaagatgttgcaatgactattgattatttccagtaaactcaagcagatagcccctccttcttctatgctgcaagatatgatgaagacaacgtgttgaaggcgttgttttgggtggatggcagaacacggaaactgtatcaaagctataaagactgtgtcttctttgacacaacctttatgactaaccgttacaacatgccatttgcacctattgttggaattaataaccacctgcaaacaatattgcttggatgtgctttgatttgtgatgaaacaactgaaacattcatatgggtctttgaaacatggatgcaagcaatgaatggacagaaggtaggttcagtgatgacagtccgagataaagcaatgagagcagcgattaaaaaggtgttccccggtacaattcatagatgttgcttatggcacgtgacaacaaaagcagatcagcaactcctgcccgtgtatacttcaaagaaaggcttccgtgaagctctgtatagatgcatatatgactctgaaacaatagatcagtttctatcagattggcaaaaaatggtagatgaatatgacctccatggaaaccaaactttgaataacttgtgggaaacaaaagaaatgtgggctccggtatactttaacacaagttttttcccttttactgggacgacagggagatcagaaggtctaaatggactattcaaattatttgtacacccacaagattcagtgtggatctttgtcaaacaatatgagcatataattgagacaaggcttgacagagaggacagggagggctacagagtagagacaacagaacctagaatgtattcaaggtaatgtgatatgcctgtcttgaaacaatttgaaaaagatgtgctttctgtttttaattagaaaaattgatgaaacaaataatatctgtactgtgtaacataaactgtgcaagtgtggaacaattgacattaatgggttgaaacattgaattatgcaggtcactgattgagaaacaagcatcgcagttttacactacaagtgtgtttgcagacaaattctagtatgaaatatatgaagcaacagggctggatgcagaaaaaacacaagaagtccccgacataatatataatgttatgccaagtgacatagaaagaacaggtaaaaaatatagggtcacagttgatgcagcacactcaacctactcctgctcgtgccacaaatttgaaagagatggacttctttgctcacacatcttgagggtgatggctgtccttaacatccatgagattccaagtaagtacttgctgaaatggtggtcagagcaagcgacattgcaaatacgtgatgagtacaatggtccagcaccatcaattggagtcccggcaacaagcaagctgagattcaacgcattatgcagggcaatgacaagccttgcttcagatgcatgtgttaatgaggaaaagtacttgattgtttcagctgggattcagaacctacacgcaatggttgcaacaccacacactgttgagacacaacatcagtaaggtatttttcctagtcaacaagacccatcaagttcagctaagaatccagcaaccaagaaaaggacagggaggctggtagaaaaaactcataggatgaagccaataggggaacaaataactgaaagcagcaagaagaggaggacaaaaaagaagagctcatgctcatattgcttcaacgagacacacaatgtttcaacatggccgtatctcaagatagcgaacatgcgagacgctctactaaaccaaaaatggtgcaagagacggagttgacactctgagaaaaaagagtttcaagagctataaatttagatgcgatgcactatactgttagaaaatatagtggtaattgccatattacaatataaaactatcttcttgtgttaggtgaaacaaattatgttgtgagatgcaacagacatattttttttaattcacatatgggcagaatgttggatgattatgtgaaatgagtctttcttatgatttatgtgaatgattgttaagtggaaagaagggaatgccaaaaaaaaaattacatctctgcactaatgattacagtggaaaaagaatatgtagagctggtgaaacattcattaagtgtagggtgagacaactgtataacagtaggtgaa

SEQ ID NO: 41942 - DNA, 4695 bp, Oryza sativa
caattttcaatgtatctcaaggtgaagaaactgcaatcaaacctaatgcatggaaaagcaagtgataagttaaaatgacacacttgtgcacaaaaaaaaaagaaaaatgaaacaacaatttggaaacaaaacatataaattgctttgtactggatactgtggaggagagcaagtctgaaactttgatatatctttgattggaattttagcatccactgcaaccttggtgaaatttgtgacctgaacggcacatcggcattgggacaaaaaaaagaacttaaaactcaatgaaacaattaaaaaattataatggaacacatggtgttccagtgaacatcttaccaggttttgagagagtatgaaccactgagaaatatcatccctcttgattgaatcaaagtaatttatttgttcccgcaaatggttgatgcaagtcagcacccaatgcttgtcacgtacaattgggaagaacaacttgatggggtgggaggcaaaaaaagtagcatatattaaatgataactggaacaaggaacagctatgaatgaaacaatatgttagcatatggtgaaactaacaattgaaacaaataaatgatcattgaaacatagtgttaaaaatagctgaaacattgtattagtatgttgtgaaacatatcagcagactaactgaaacatgaaaaaaaatcagagggatgggaaactggtaccagatctagtttaggaagtttatgctccttgttgattgatttcagccattttacacagctttcagacacaaacttctcaggattgcaaatcaatttatcctaaggaaaaaaagggaacaattgaattaaaagcaaaaaaacaaaaacaaaaatagatgtaataaaaagggggtggttaaaacatgttaccgtcaagccaggggaaaaacaaatttttttatgcttgatttcatcttagaatcttccctacagtttgcattgaacatctcaatccaacatgacataacttcattgttcaactctcctctaggtttcattgcttcacggaaatactcaagtgagacatggaattctccaatccttaagaatggagttgtcctgtttttcccaaaaaaaaagttgggaaaaaattcagataaagctgttctgaaacaaatgttttgcatttattgagacatgtcatagtgactgatgaaacaataggggaacctacactgaaacatattaataataaaaaggttgaaacatattttgcgcaaaaaaaagtgtgaaaacacttacaactctttggcatctgccttccttgacctatttggcaaagaatcaacaacagatcttctgtacacatcatctatttcagaagcggtcttcaacttcttcgcctctacatcactatcacctttctgtgcccttttcttcctatttttcttctcatgggtgcttggaccactactaccagcacctactatagaggaaaaaacattagagaggggtaggggtgttgttcatagttactttacccacaccgaaaagagagagagagagagatagagaaagagaaggaacaaaaaagtggtgattttacctagaggagcgagcttgtagcacgtggcggtgaagatgtagctgggatgttgcccttactgctgctagagagagaactactgaagttgatgtttttgttgcaatgggtgaagggggggctggagaaggtgtccttgcagtgggtgaaggagttgcagaagatgtccttgcagaaacaggtgactgaggtgatggagaaggtatccttccatccattgccgattgaggaacatttgaaacatccaaggagagcatctcaacagccaagtcctgagtactaatgaaatcaggatcagattcattgaagagtctgaatgacggtgcatcacatgcatcatctagatttgagatatcagagtgggaagcaaaaatataatcatcaatagctgggctgcttggcacagaaccgccagaagcttcctggcttggtccatcaaaatctgtagcctcagctgccccctcaatgcttgatggttttgaaacggcctcagctaccccctcagtgcttggtgtgtttgaaacaacctcagctgccaacccagtgcttggtgggtttgaaacagcctcggaaatgcccactgcagtgttgctgtcagctagcaccttgcttatgtcagaaatcatatcacatgttctttttgcacgcaaatcaatcatgtccctcttgaagttgtcaagtgctgaaacaaactcatcctgccacatggcactgcgcttctcaatactagattttaagcttgctgaaaactgagacaaaatgaaacaaaagagaggaacaagttagaaacaaaaaaaaaggcaaaaatgtagataagagaagagggtcagtgaaaaagtgaagaaaatttttaccgtagtcccttggctgcttgaggcagatagcctgatccattcattcaatgaagcagaatcttgagcaacactatcttgggcgacagcagctccaatgcctacaccatcttgaacagcaccaattggaacatcctcagcccttgcaaccccagcattctcagcctcagacccaccaacaacagcatggacttgggctagatatgggatctcattccgtggatggaactgaagaaataaaaagatgaaacatagtcttaataagtggtgaaacacataatgtatatatactaaaacattcaaagttgtgaaacataccgggcgagacccatatgtgacatagccaaggttcatcctacaacggtctacaacagcaacatactcaaagtcctcatcagtgacatgacaaaatcttggtgtgttgtagtcaatgatgcggagatgcagtccagttgttggcatttgcaaatgatccatgtaagcaatctaaaaaatggcatttgatataggtagttagcaggagcacattggccaaaaaaatatgaaatggaacatatggtagcattgcatgaaacagatcctatgtgtaatatgaaacaattgatatattttgctgaaacatatacgtaggttattagcatgctagactgattatttactgaaacatatgacagcagttgtgtgaaacaaaacatatatgttaaatgagacaaatggatgtattttactgaaatattggatcaagcacgacaatgaaaacaataaaacatatatatagcagggtgaaacaataaaaaacttacaacaagcaaggggaggcactctccaatctgaaaaatggaatctcgttgctcagtagagaatccctgatatttcctgatttcccgcatcaaacagctcgccacatgtgtgcaccaatcatactgactacacatcttgacatcaaccaaagaatgcaaatagtcgagattcacataattgccggtggcaggacacaagatggtggcaagcaagtacaaaatgaaagtcctcaagaacttctcttcatcatgcagagaaagcaacaatttctcgcacatgcctgtaccaagtctattgctgacaaaatatggatggtacagggtcctgatctcttttacaacttcactgttggcaccactaagcttaacaggtagatcgccatcatttagcccagtaatcttctgtactaacaacttatcaaacacgataaccttgccacggaacctaaactcacaaatctctgggttcatcttttgcataatccattctgcaagtcgactatggaccttgaaattgcttagtgatagaaaagactcaaagccattatctatgatgaatttcttttgatcgggtttcaactcaagcatagtgcgcttaaacctcacaccgccccatctatgcttgaagttggaaccactacaccaatcaggcatccttgaaaaaaaacacatagaacacaaaaaagtctgagacaaaaatacaacatgtgctctgcaacaaaaaaaaatgtgtatactactatgtaagacaaaccagggaaaactatgaaacataatattaatgtgtactacaacattgtatatgcatggatgggaacacaaaaaagggaaaaaataaaaaaatgcataatagattataacagtacaaaaatggtaaaacaaaaaaaccaccatatgaaaacaatcacagtgcaaactatatattatagattatcaaatatatctcataatagatcatcatagattatccttctgtgacaaattaatataactactagagtacaatcacatctaggaggccacatgcaacacagacaataaaaaaattcctttcacatctagggggatctcataaatgcatcctcataaattatacctaaaaacattctgaaaaaaaattaatgtcattactagaacacattcacatctagtagaccacatgcaaaacacaaaaaaaaaaacttttcggatttgggggagaaaaagcatggggtagcaagaggttgggtgtggagtggggaaagggggtaaacgaagggctcacctcgacgccggggatggagctagaagccgccgccggggatggagacagctgccgccgccgctggtcggaaccgcagcaacacgcagccgcagggtgagagtgtggtgggggtagagctgtagaggggaatgcgacgattggagaagccgctgcgacagcttctagtgctgagtcagtgttgccatcctgttacagtgtggaggcattttca

SEQ ID NO: 41943 - DNA, 1268 bp, Oryza sativa
ctgaggcccacacaacagccacagagggctgccactactactgttgaggaatctgatccaatcagcccagaggtaatgcaatttcaaattttaaactgttatgactaactgtcaccttagaggtttgatttgcaactgtcatgatatggttttgttttgtaggctcaatctcaacctcattttcctacccatgaccaactgttgacacaaatacctaatgcaatggtatcacagatgtttgatgagtcatctcaagtttctcaaatgaacctagcacctgggcctttacctgacaatcaatttgtcatgactaacactccaactgtcaggccaacccttctcaccactgcaacaaaggcaggaaaagcaagagcaaccaaaagaaaggctgcagttgttgctccagcaaagaaagctactaagaagaggtagaaggattgtgctgatggtgcaaagaaataacttaggattaggaacagattaagaagcaactgaatgctagaagttaagcatgcttgtccttttgtaatgccaaactaatggcctacctttattcttttgtagctgccaacctaatggcctaccttaccttcttttgtaatgccaaactatggctcactgctatgcaaaactgatggatgttgggctgccatttactctagactttatgtcatgaaatatttggcatctactgtgcacaactgatggatgctatgcaaaactgatggctcactgctatgcaaaactgatggatatgctatgcaaaactgctatgcaaaattgtttgcatctactgtcagtctgtaaatattttcattttgtttgcatctccataatcaatttcagatgacaaatgtactaaagactgcaaacctgacattaccatttcaaaagtttcacatctcattgcacattgcaaaccaacacagtatggtttagcctgaatacaacccaaaattcactgatacaatgggcacacatcacttaaaccatagaacaaggaaacaacacactatcaaaccaactgaacacacaccaccaactagcatgagcttcatcatcaccatcatctccctcaaaatgagcaacatatgatcagcctgcttaaattcttcaacatctgcatcttttctaatctcttgaaccgtgctcttcttcttcacatctgcatccagcttgatttcttcagttcccctctgcatttccctctggtttgcttcattcagcaactttgcacaagtgttttgctcaatcaagcctttcctatt

SEQ ID NO: 41944 - DNA, 11508 bp, Oryza sativa
gttagcctaaggattaatattaaagctcggctgtcagtacctttctctgtctgaacgctcggttcaagaatttcagctttgcgttaattactctacgtgcagattgaagagatcatagaaaatcattgacagttgcatcacatcttgttatgtatgattccacttgagatatagtactataacttggttgatttcaggtcaactaccgtaattagatttgatgtgcctccaaactcgacggaaaaccttactctctgtttggggaggttgttgtaactgtagtttctcttgaaattttcagctcagcttttcatccgaaatctaaaaatacgatggtatagaatctaagacgtaaactagaagccaacagttgaaaaactcaatttatccaaattctaattagctgcttctcgaaatcttcagctcccttgaacatggtctaagtcagatctttatgtcatgaatttgtggtggtctagactctaggatgtttttcttactttaacacattacctgcttttaattttttgcgataatacatcacctactttttttcgataatatatatgttcataaatcgctagtagacttgctagtgtttgtaaaccgtcggtaattgttggaaggtaatttttcaagaattttgcagggaaagataaatgcaggaatttctgcaaagtttgtaatgaaaaccactttttgcggttaacacctactctctctgtgaaaaaaaaacctagtactaaatatgatatattctagtacaacgaatatggatagaggtatgtccatattcgtaatgctaagatttgtcacgtctagtactaggttgatttttatggaaggaagtaagttgaaagcattataagtctaggggggtatgtccattgttttttattatttgtcttgaagttaacaatgtccgctaggcgtgcaatttatgatatactatacaattaacctctctaggtgctagcttcaagagtgtgtgtgtgtgaacacaaacacacaatttgtgcaaaaagtcactgtaccgtatgaactcaaaaccatggaacttgtatatcaattactcaaaatttgactcttccgtgtgacggtggcacaggttgatggtgccgtaccgactaggcgaggtagaatagcactgacacgatcgcgatgcaatggttggtttctctcatttctatatcagaaaacacaattcggctgacctgtcaggaagatgtcacattggcaattggcaagtgctagtttcaaattggaggcgcctccaatccattttgtcttgatggtccatgcatgtatgatggtcatacatatgtgttggaaccggttctcatagctttaggctgtgggtgcactaatctttcccctcctttccgaactcacttccctagttttttacgcgcacgctttccaagctattaaatggtgtgttttttaatttaaaaatttctatacaaaagcttctttaaaaaattatattaatttattttttaaaatagattagctaatacttaaattaatcaatcgtgtgctaatgagttactccgtttcacatgggtagggattagtcccaacaccaacgaaagaagacagcctaataagcaaagcattgccttctgaaagtatgagccttggataaagatacaatggcctactccctcggatttttaaattaatagatgacacaacattcatcttaaaaataatattaatattaaaactgtaagtcatactaaaagatttttaataaaaaaccaagtcagaacaaaataaataataatcacgtaactttttagtaataaaacatatgatcaaacgtatggcaaaaaataatagcgtcatctgctaaaaaacgaatggacaaacatatgtgttcatccgtgatgtcgaggctgaaaaaaaacgcataaactttttcgatactaagtagaaattctcactataggggcatatttggtttcttttgcttaatcaccgatctagtatagcttattcatgtttggttttcctttgcctaaccttggcggaatctgccgcagtagagaacctatccgtgcaaaagcagacaaaaattatactcctccgtgagtgtacatatggtttgatggttgtgaaaacgaaagggagaaaagaaccggaaaaggttcaggccgttttggggacagttcacacgcacgcagggccagcagccacagccaccaattcagcgcctgtctttagttcgcgaaaagaaaatttttaagtgtcagatgtcgaaaagagttttcggacacgaatgaaaaaaactaaattcataactcgtctggaaaccgcgagacgaatgttttgagcctaattaatccgttattagcacccccgcaaaaaaaaatccgttattagcacatgtgggttactgtagcacttatgactaattatggactaattaggctcaatattcgtctcgcgatttccccctaactgtgcaattatttttttaatctatatttaatgctctatacatatgtttaaagattcgatgtaatgttttcgggaaaaaattttgggaacttaaaccaggcctcaatctgcatgaacaaatccaggagttaaaaaggaaaggtgagtagcagtagcagtagcagtagcaggtagctgagggtaggcaacgtgcgatgcactacactctcacatcatctcatcatggttggttggagcagagcagtttgccggtggttcggctcaaaatcgatcccttattcgcttggccgcttgctttcatggtggctggctagctcatcaagcccccgtccccattgtgccggtcgccgtcgatcgggtttatgttatttcaggacgaaaattaaaaacatttcagcatcaaaatttcaggcaaagattgaatatgtcataattttttaacaaattgttgacgaccaaatttagcgttggaacgaatttgtagcaagtttgaaccaaaaattttaaaaagatggagcttatgcgagaagaccggttcaatcttctttatggtttgagtggcagtatgagtgtgatccaaccgataaaccttaaatccgatttcaattgttgtagatcccgtgtttttttttttttgcttggatccgaggttttcttgagttctgattgatttctaaacttactggaatgtacaaaagctctggttttactagagcaatccttttatgtggactatgaccagcttaattggaaacaatcaaccagaatttcacacgattaaccttttgaatgatgtttttcatgttccatctagttttgtccctacttcatccatatttatcgatttgcgctataaacgttcatctttatcatgagagcgcggattacttcgtaggtttcaaaacctacctttctgctcacgagatgggtgtgttatgcttgtcccaatttatctaagggatgtttgggtgggagggactaaatttcaggaatttgtaaatttttggcaccgattatgtgtatgtgaaaaccgtattctgataggttcagtttgttcatggggaagagggcgggagttgaccttctcgaaggcttaccatttccttggtgggttttgaaagaatatatttgactctgaactccttttatcagttgacaacatagtttagtggtcatactctcatagcatgatatatcaagcaaagtcggatttttaattcgacttttcttcactgaaattatatggtgctgcaccaaaagcatgtactagctaccgtgcgcggaattcaccaatatgggctgtattttgaccacttcacaacgatcattagtgagatatcaggtggaacttagaaagtataaatgggacaaatggcataaagtgttcatcatatggttctctttcaaagatgccaaaaaaaaattatgtgaccaaaatgagtaaatgcatgggatagtaggatatacagataagtaccattctttttcccgcatccaataggggtgcaatagtagggaatacttgcaatacatctaaacgtaaccttatacttgttattaataaactgtctaccaaccctgtatttctcaatggtgatagtaattaataactgaattaaattaaatagcacaaaagcatgcaatggttgaaggtaaagggaactgaattatattgcacaaaagcatgggatggtgaaatataatgtttcccatgatggacaaaatagcgaactgattgagtataatatagaatattatcaacatctgatgacacatgcaaatacaccggttattttcttccaaccatggacaaaaagaattgaagattagtaattttactccatttgagtttgtaagtttttactcacaggatgattcatcacctgcaaaattttgcacttgttctgtctctactttccctgatattttgtaattttgtggtttgtgataaaaaagaattccagtctattaaagaaaaataaaaacatcatctcctccatataacctagttagaatcttctcatgggagatcttctgacctactgactcactaccttcctttttgccctgtttttcaggaatgaccatttaataaatttatatgccttaagacttaagaatgaaactttcagctctcacgtgggcacaagatgctatgtaaaaatcaacttatcttaaaactcaagcggagcagttttagttggtctagcttttctacaagataatacaagagacgcacatgctctttacaaatcgacgtaccctaacttgcgaattcatctttccttctcatttcctgagatgatgctttttattaaaaacaaaagctctgaagctagagaatatataaatgtgcattttctgagggcattaatgcaaataaaaggaagcattctgagaacagcactatatatgcctacatataccagaccagctcttccaaaatgataacgcctttgaggatgaagcaaatttaacatttaggcaaacatctgaatcatataaatgatgttgaatcatatctttggttgtaagcgtggctcttttcctgttaaatatcttggtatcccaatgcattatagaaaattaaataataaggattggaaggtgattgagcaaagaattgagaaaaaacttagtagttggaaaggaaaacatttatctgttgggggtagactggttttgattaactctgtgctttcaagtctagctatgtttatgatatcattttttgagatacgtaaaggggttcttcaaaaaattgattattatagatctcgtttctttttggcaaggggatgattataaaaaaaagtatagacttactagataggatataatttgtcaacccaaagatcagggaggtttaggggtccataatttggaaatataaaataaatgcctcttgaataaatggttgtttaaattgattaatgaggaaggggtctggcagaccttattaaagagaaagtatctttataatcagtctataacccaagttaataggaaacaaggggattcacaattttggtcagggctcatgaaggtcaaaaataccttcttaaatatgggttcttggattgtaaataatggaagacaaataaggttctgggaagataaatggctgggtaacttggcttttaaagacaaatatccatctttatattctattgttcgaaggaaaagttctactattgctagtgttatgagttctgttccacttaatgtttcctttaggagagccttagttggccataatcttacatattggcatgaattgtgtacttctattatacatattcaatcgaaccattcttctgattgctttagatggaattatcatcagagtggtagtttttttgttaggtcaatgtatctagctttaattaataatggatatatcgaaagaaataagattatttggaagcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactgtcattatgcaagatttgtttggagagcagtacaattctcttttggtttaaaccttccaagtatcatatctaatatgtttgatgggtggcttatgggggttaataagaagaaatgtaatctcatacttgtaggagcatctgccatatgttgggccctatggttgagtaggaatgatttagtgtttaacaaatcaccatatactttatatatgcaggtaatattcaaggtaatatattggctccggttttgggcaaagctgcaaaagtgtgaagaggatggtgaacttatgaaggttgcatgtcgcaaactcgagacgacggtgacgtaactctttgcaaactatggatggagattcacaaatagacttgaataaatgtgtactctttatcttggtttgctttttattttgttgagtgtgtttgattacatttgaactacactctttgtatgagtgatactttgtaataattggttgtaactctgttgagtcaaggccgggatataaattccattatctaaaaatataaatgatgttgatatatatgctagttgaagctgaagttaacaagcattttactccaattgtctttccttttccctcctcttttcacacagtgccaccaaagatgttgatacaaagctaccaaggtgaaaaatagcatgctaacacatgtggattaaatcatagtaagacacgtcaaagccattgccatcagcacctgaaaacaggacaatggtagggtctataacgtcaagaatagaggccttgttctggggaaaggaggatgagctgaagttgttaatcaaacaaaacaccaatgggacagctctagatgctagctagctgaagaaaaggaaaaaagaaatgtagtttcaaattaagctacagctagtttgaagtgctattgtgtattatactgtttgagctctaaatcatggtcacagtcataaagttagtagtaactagataagatgctaacctttcttttcctggatggaacacaggatcccagctcctatggagaatgtggtaaggtggttgtcaattgtcctcctgaagatcctgccccagtgtcatcttctgacaaccgccgtagaattttaagagcactgagttctggatcatacgccacaaagataaagaacacaagagcaaccatagtagcattcaccggagcaacctccaggtcatgcaaggcgatgagtcatgattcaagtggttcaaccaagcagcatgtgagtcgtccgcaggtaagaggaaatggcaaaaagaaagtgttgaggtaaatagagatgattaacaagatatctgtgatcccgtatatcatggttatccttcgtattttctgaatggactgcttgacatcatgggccatgagaagttcagtccaaaactcctaatatcttgttctgaaagatgacgactgaaaaattgctatcgctacttgtttataatcaagctaattttcatttgtgtatgtttctaaaatatagcggttgctcacatttgtctgtattgcatggcatttgaacacatgttttgcaaccataatgtaaatagacaacccaccaatggagaaaactgttgagaattactacaattagtcacacaatagtattatgtttcagtagcatgtggcaatggacttcacttactagttagaaggtacagtaccgctgttgattcctcatttagggcatacaaaagattcctcagatgctatatttgtttaatcctaagttgaatcaaatcctttcgaccacagggcagagaataatccaaattatataagacatgggtatgcattgaataccacatattcaaatctctttaaaagcctaatttgctactgggagtggcacttgttgactgcatgtatcatataatctagtgttaaacaactaagaatgggttcatacgtaaccgtattgaatgttcaaattaaaaatgagtatagcaaactacatttgacagcaaaaatgcactgttttcagtttcacatatatggacaatatgggcaaaagtattcatatgaaagaatagtaggatcacaatgcagacatgagaaggtattcagtcatcatatgaacagtgaggagaagcagtacagccaacatcaaaaggatcttccgatccacaacaatgccaatactggaacactttgcctgaatctggagtatccagagtcccacccgcatagacactttcaaattttctcttcgtttctcctggatagacagagattggccattcagatattagactaacacaagcagacaatgttaactagttcaaaataaacaactcagtcagaatttctgtctaggtcatatgccaatagcccctcggatgtttggattttccataggaacattggactataaaatatccttaacacaatttttcccctcaggattatgttgggagaaaacgttatgcacccaattctactgaaatctcttgctaaatctcgaattcgtttctctcaaagaagccctcagctacacatatgaatagctcgagcaatcaaatgaatctgaaagaaactactccagcttccttccatttctccgacgagttcctcacctccgaagtgggcggtgtggtggcggcacgccgaggggtggttcgccgccgggtcgtaatgcttcttgcagttcttgcacgtgcgcagctcgggccctcctccgccgccgactccggccgaggcggccacgggtagccggactagccgacggcgcgtggcgagctgggcggcggggcacgcccggggcggagcccgtagcaacggcggcgcgcgcgcttgcggcgtcgccattgggagggatgagcaagtgcggcggagagggagaaggggttggtgggatcgggtcgagaggcggaaccgagagcgacaaatgcgggtgggccgctagtctgtagttgggctcaaatgcgggtaaggatcagaagcagcccatgaagcccacgttggaatcgtggtagaggtagcccatatgcaagcctagggattgggtgctcggcctaaaattcagactatcaaaattgataaaatttgctatataacacttaaagtcaccgaaacaacgcgtatcttcttgtgaacagcataaaaatattataattagctagatactcaccgcattattttattattttgggtggaaacggagagagaaactttcataaaagacgacgagtttgcccgtggggtcattgtgtataaccctcacgccggtgaagacgttgacggccggccgcgaatcctcgccacggcgcacgggtcgacggcgacggtgacccagccgccgtcatgagcgccgcacaagcacgtgtcccagacgccttccaggaggctgaggtggcgggtgaagccggagagtcggagtagaggctgaagtaggacgatgtgtcgtgggacgggaggagcagccacgggagcccgcagtgcagggcgttgacgaaggccgcggcagtgcgccatgggcggtagacggccgtgaagccaatgcggtcgacgaggcagttcagttgcttgaagatgacgccgagtagcttgggcaggaggccatctgaccacggcagccgtgacgaatgcctcggatctgccctagctcctccgtcgcgcgtcgccggctgacggcgaaatttggcactggtcgtcgacggtgagcggcgagctctgaccctgcgcgtctctggcggggatcaaccgaccctgtgaccagcgtttcggctatcgccggtcaattcggtacatttatcgttctttctctctctccgttccaccaaaaataataaaataatttagcgagtgtcgggcaactaattttcacatttttgcgatgtctacaagaagatatgtgttctttggtgtcttacaacaaaaaccacaattttttagtgtcctgtaacaaattctgccatcatccccgaaaaaaaaattctggcatcaatttgacggattaagttataaaaaggtgtttagtcattgagacatctgaaacaagatatatgagaaattatcacaccacaaagctagaatacatagttaaaacatctttaaaaataaattcattaattggaacattataacattttctgcaggtatggaacatacaaaccaaagatgtaaaacacggttccaaacatatctctctcgtgcttgaagtatatttatttcaaaagtagaataatgtgaattgttgtttcaaatatttaatttaatacacgacataattagatcgcatatcaaaataatcccccatccctacttctaacccacccaacaacgttgcgcctccctctcgacctcgcacctgtactgctagctacctactcatctgtggtgcaccgtctcaggtgaaggccgccgactgctctctccacgctaaatccgtcccactgatctcctctgtttccaatggttcacacccacccactccaccttctaatcactctgcccaccacggccgccgccgggcacgggcccgccgcccgcccgcccgccgccagatgggaagggaggagggggggagaggggaggaggaaggggagggggaggaggagagggatctgtgaagaggataagtgcgacgaaggggaggaggaagagaaagggatttgtgaggatgtggttgcgattgtggaggagaggataagtgctaggaattacatactacgcattgaattttagtcccgattagtattaccaatcgggattaaagtggtgatctttagatccggttggtgtcaccaaccgggactaaagatcctcggtcccctgacaggggatgaactgggactaaagattgtattaccaacagtaacctcaaacagtatttacgtcagaggtactgttttacactgtagtgctaacttaaaaaaactgtgcgcctctgacgttaccgtccaaagtcagaggagccggttcccgaccagtgtatctatgggtggaagtgcaactaccaggataccattccctactttattttattaactggcgtaatacaaagcaacaattaatatatccaaggtaacacacggtagtctatagctaggcgcacttgaaaccctctggcacgttgcggccgcagtagttgacgaggagcgggaggtcgacagcgacatcctcgagcttgacgccatcgccgagcacgctggccttgatggcgaggcagaggcacacggcagcacactgctagaaaaagcattttcatcaatattgggtatttattttcacatacgaacatgacccttagagccaaacagccacctacaaaaatataaatcgggcgtgcctacgaaaatgattttcgtagacggaccacatgaggtgcgcctgcaaaaattagcgtggtatatatatatgacacatcagttgatatttttctaagtgtccttacctctccccttcaccctcctctcccctccccttcacctctcccctcccctcccct

SEQ ID NO: 41945 - DNA, 2471 bp, Oryza sativa
atttgatttgattgtgaaccactatgatgtctgttaatctgtgatgtttttgtgtatttgatttggtttgatgttgaatctagatgggggaaatgggaggagaatgagaagctactgctaccggccgaaacggcggtgggcggtggctgcctattttttttaatgccaggtgctattttcgcaggcggaccagttgtccgtctacgaaaatcaactattttaacagtcgttcagttgcagacggacaattggcccgcctgtgaaatcctgtttaggccgcctgcgaatttctagtagtggcgtcgacgtcggcgagcacggcgatgagcgggcagcacggctccctgctgggcggcggcgccgcccccaccaccgcgtggatcagcgcgttcagcacgctcccgcacacccctagcttccccacctccaccggtcacttgccattgccatccgccttctccaccgccggcggcgcggcccgcggaacgatcggtggcaggcagttggatttcccgagtttgcacgccgccgacggcttagcgccggtgaggcacagcacggccaccgccaccacggcgacgagggcagcgtgcgccgtgatgctgctccctgtttgcgccattaattcgctacagctaagctagcttttgcttgttagttgtattgtgcttattcttcagctaacttgctttgatagagtatttgtaggggattataggaggatatgtatggctaaattaggcatcggtgattagcctgcttaaataaggagtttcatccaggtattatgcaggggactttgtggcagtttttgccatcttaaatggaaaagattcagttgtcatatcgtgtatctgtggtaaatacacggtatgagaaccgaagcttttgcccagaagataggggtaattattcacgtaggattattttttgatgagttggagaagagacgatagaagagatagcatgggtaactataaacaggtacaatagcatacgataagccagttataaatatattttaaagagataaaagaggagagagtagagcagcgggctacagatctgtagccagctgcagcacggattccaagataaaacgtgtgtatgacatgtgggaccagattaatagtgtagtaagtaactattatacgaattggctattaatttggctatagatgatttggagctagtagttggctatactattaaacttgctctaattggtcgtgtggctgcacactcagcccaaggacggagtcctcaccggagtcgtcgatgttgcatcccacgggctactgccctcgtccatggacaccgacgccaacgcctacgtcctcgtctgatgtcaccaccgccatcctcgcccacgaacgccgacgctgccctcgtcctcttccgccaccaccttcatcctcgtccgcgtccgttactgacaccatagtgtgccactgtcgatgcccttgtcctcgtccgtcgtgtcctccaccgcgctgccgctgccctcatctattgttggtgccaccgtccttgtcctcatttgttgcagctgccgactccctcgtcctcttccaccgcgctcgtcgcctccatcagtcactgctgttgcgctcgtcctccgtgtcctctgccaccgccgccatcatccaccatgaccgctgcagccagcgctatcaccgtcttctcgagctggcgaccaccgagcataaagaagacaaggaaaacggtaaaaaagaaaaataggcactgaagaagtggtgggaggaagaaagagaagggacaggagaagatagcaggccccacaaaaatagtagactaatatttgtgtggtagtataatatttttattgtatctttacaatccgcttctcctctcttctctcctccaccttagtatttagctggcttatagcctactattatacttgctcttaattacaacagcctgcaggctagctgcttcatgcatgtcacagtgatagtcgtcagtccgattgagtatgcatagctatggtcggcctgttagtgtggtgacatggtgagtgtgtggctatcctgctcagtcccaactacaatctgcctccttccaatcaggccttcttctccgccaatcaactcgttgattatccccgtcgcttcgtggttgaagttctggtttttataaatacatgactatgaatctgtacagtctatcatcatgatctccaggtcccttctagccaaacataaatatttgagctctgttttgccaagatgctttaactctagttctcgatgcatccagttcctagcagattctcaccggtcactaccatctccttcctgctagcaccctcacttagcaaggataaatgcatgtaatgacaggaacaggctggtcaggctctatagttttgacgtgtttatatatggggccttccccagcattccacatcaactacatcactactacagaggtgatttttctggaca

SEQ ID NO: 41946 - DNA, 4710 bp, Oryza sativa
tggtcggggggcatataagccccagcccgaccgttggtatgaaattccgacggtttctctctcataaacatccacaaaattaggggggaaggttttcgacctcaaatctttgattgggttccatataaaaggtgtagagcttgttctcctccttcatttgcttccatttttgtcagttttcatcggtggaatacgaagaaacttgcacttttataaatggaatagtgtaggcacctttttgttttttttatttttttagcaaatacataatgattccattacatgtttataaaagtatttagtacctacattgaaaagttgggtttgcctctattaaatttattttcatttggatgaaaggatgattttttttcattttttagaaatggacagtattttattaatgcttaaaatcactgtgcggctatttaaatagttcgtaaaactttaaattaccatgtgattcgttccctccaatttaaatacattcgtgtttgaatcgggcatggatgtattaatgacaagctttattgtaagtcatggatcagacatggatgtacaacacgaaaagagctcatccaacgttcttgaaggaagcagccaaatttgttgagctcgcaaaggcacatgctgtgagggagaatttgaggaacattttttgcccatgcaaagtttgtaagaatgaaattttgctgcaagatccgaataaagtattgtcgcacatcgtagaatgaggatttaagaagggctacgagatatggacctttcatggggaagtcaatggtcgtaatgaagagttagatgatttctgttttgatgatgcagaaaattttattgtcgaagacatgtcacagggaaacatcccggaatacggtggctctggtatagagaatgaaggtattgattttgatctggaagatatgttgcggcacgttgaaccagagatcctaactggtacaagacgagggttggacaattgggaagcgttggaaaaagcagcgaaggagcttctgaacgacgaagccaaaggatgcgacaaggactattcggtcctgcgctcggtgctcgaacttctcagattgaaggccagacatggatggtcggacatgagcttcaatgatttgatggatcttttgagagttatgcttcctaagctgaacctgctaccgacgaacacatatcaagcgaagaaattgatatgtccattgtctctaggtgttcagaagatccatgcatgtgaaaatcattgcatactgtaccgcaaggaattcgcggatttagactcttgcccaacatgtgggacgagtcggtacaagacgggcaacggagcctccgatagagaggtggtcgacaaagatgatgcaccggtggatgagaaaaaaaagattcttaggatggtgatgttggtacctgccagttaaagatcgcctgaagcggctattttccaaccatgacgacgccgagttgatgagatggcaccaggagggtaggaaaaatgacggtaagatccgacaccccgccgatgttcgacagtggaaaaactttgatgcactacactcggaatttgcaaaggacccgagaaatgtaaggtttgcattgagcacggacggaatgaacccgttcggtgccctaagcagcacacacagcacctggctagttctgctaacgatgtacaacttgcctacatggatttgccagaagcgaaagtatattcttttgtctatccttatacaaggatcaagacagcctgggattaacatagatgtgtttctggaaccattgatggaggacatgcaagaactgtgggaggaagggttacgaatgtgggacgagtaccgtagggaacattttactctgcatgccatcatattcgttacgatcaacgacttaccggcaaacttttcgctctcgggctagtttaaggggaagttcggatgcctcctatgtatcgacaagacgtcgtacaagtacctcacctcatcaaccaagggtgtttacatgcgtcatcgtcggttcttacctcagaggcataggtggcgtgcgaaggccagattattcgacaatacagtagagaacgatctagctcctgaaacacgaacatgtggctctgtcttcgagctgacaaagaacattaaggttgtcttcggcaagccaaaaaagaagcccgtcaagaggaagaaacggacggatcaggaaacaactgatgcacctttagaggaaagtaacctgccctttaagaagcactcaatttttttcaggtatcttgattactggaaagacctggaggttcggcatgccatcgacgtaatgcaccttgagaagaatgtgtttgatagcaccattggcactttactggacatcccgagtaagacgaaagatgggttgaagtcccggaccgacctcgtcaatttggacataaggcatgagctttacccaaaagagctgccaaatggaaagatcgatattcctccggcttgctactcactaacacttgacgagaaaaaatctttatgtagatgcttgcatagtgtgaaagtcccgactggtttctcagcgaacgtcagaaaacttgtatctttgaaagatttgaccatttctgggtacaatgctcatgattgtcacaagatgttaacagtcttcctaccgattgctataagagcggtcaagccagttcacactcgattagtgataacaaagttgtgctactttttcaatcgagtatcacagaaggtttttgatcctgaagagttaggcccccttcaaaaatttgcaatcgagacagcgtgccagcttgagatgtttttccctccagcttacttcaacatgatggagcatctgattgtccacatcgtacctcagattatcgagattggtcccctgtacctacaccagatgtgggcgtacgagaggtacatgtccgtcctgaaagggtatgtccataaccgagctcatccggagggatcaatgatagaggggtacacaactgaggaggtggtagaatgctgcatagattacatgaaggacgccgaacccatcggtgtgaccccccctttacacgaggggcggttagctgggatggggatcgtaggcaagaaaatgttctatgatgaggactacaaagatgtagcggaagcacgtagcagcgttttgcaatagctcgccatcgtcgagccatacattcaggaacacatgaacgagataagagcccacaaccctagaagaacggccatttggatttgtaaagaacagaaacggaaatttcctgaatggttgaaggagaaagatctgccgttgggtgattcgctgaaggaaaaaactttgcgcaggctagcaaatagcccaactagccttgtgacctcatggcaagggtacgacatcagcggatataggttttacacgatgttcaaggacaggaaaagcgcagctcagaacagcggagttcgggtggaggcgtttgacgcatcaggtgagaagaagtcttactacaggatcatacaagacatttgggagctggactatggccttaacatacagatcccagtgctacgatggcaatgggtcagagacacaataggcgtattcgtcgatgactacgacctgacggttgtgaatcgtagcaagctaggacacaaggatgatccgtgggttcttgctgagcgtgttgctcaggttttctatgtcaatgaccctccgacgataagatggccattgctgtaccgggaaagcaaaacatcattggcattgatagcattgaatatgcgtcagattacaatcaatacgacgacgtccctttgttcacagattttcctaaccggatcaaggaagttgagacaagccttgacgaagatctgttttcgtgtgtgcgtaccgatggtgtttccaaaattgtgaaacattagtacatattttggagtgtacaacttagcttgtaaacaattaatggatgagacttattttgcgaatgaatgtatttctcactttatctggtcaaatacttgacttatattaatcaatcgatgatgaattatatgcgaattaaattcatgtgcttaattctttgtgggttgaaaaatattatttgattaaataattacttgattactttattacataatttatttaatgtaggttgaataatttgtgggttaattaacccgaactatttttaattcgtggtttagtaatgtacattaaatatatttaatttgtggttcaataattatatggattaattaactacaatttatataagatttattaattaaatgtatttaattgtgctatattatacattataattaataaatgccaactaaattaaaattttgcaaaaaaaaaatggtaggagccttcccgtgtgggccacttaagcctattatcccgtgcgggcgtattaggtcacccgcacaggatgcccatgtatatatagaggaggcgggtagaagggctgaaattttctaagtccactccaccgacgctgccaggctgctgaaaaatccaaccgccaccgccctcccaaatccccctcgccctcgccgctgccgcctcctctcctcctcggccttgccgccgccgcctctcctcgagctcctccccctcgtccccggttgccgcctcctcgacgccggccagatccgggccggcgccgcctcttctcctccccccaagtcgccctccgcagccaccctcctctcctcctcccctccccgc

SEQ ID NO: 41947 - DNA, 1618 bp, Oryza sativa
  unsure (1)..(1618): unsure at all n locations
ccctagcacgtgctaaccgtggggggtaacctattatcctgtgcggttggtataatttgaccgcattatcccgtgcggtcggccttattacaccgcatgggataatacattatcccgtgcggtccgtataacccgaccgcacaagataatcgattatcccgtacgggcaggccgaccgcacacgaaaataaagattttcccagacgaggagctgcaggcgggccgggcaaccgcacgggataatctattcaaccgcccggaaaaatgggtattgtagtagtgcatatttagggcctcttatatataggcaccgggaacatgaggtacatggagtgatgtacacaagcagatcctctgatcacttacttcccactgactttgaatcactggtacgtgggttgttgggtagatggcccacatatcagtgacccacgttagagaaaagtaacttggaggatctcaatctgtaatatactacttctcataatttggtttataataacaatccattgattccaaatagttcagtgaatactacggattagtctacaaatgcaacacatatagtagaatcaaagtagcaagtcgatcatggcacgctgcaatggaacacttcgggctagacccttttgttttatgaaagaacatgcgacccttcttgccttaatgagcaaatataaaaaatggtgagtgcatcaaaacatgtctctggacgaggggttctgttttttctggaacttgttgatggatgtagagtggagatggctagggacagtgttgtggatctgagagaaagggtggtcatggcggccatacatggtgaagaagaggatgggaaagttgagggcaaactcttaccgaggcgattttggtgtgacggagatgtggagggcaaggtgcgggagtgtcttagcgatcatcgatgacattttagtagttagagacttagaggcagggcctatgtgcgaagagagatagagatagagagatgggggacttgacatgtggacctagggtatttcaaagaattcacatgatttctctcttcaatttaaccgaaaataaatattctaatggacgcggtgtccatgatctaattttcatgtttacagagtgtttctccccaaagtcacttcatgtagtgttctacagctaaaaccgtgaagtcatgatgtcctgttgttaacagtgaaatttggtaaagcccgaagacatcatcggctgagagtcagtgtcggcttccgagttctagagacagccaatggtagtcattaagtcgccatgctgtcgtgttcctggtggaatcggatcagtcaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41948 - DNA, 1712 bp, Oryza sativa
gccccgggtgtgtgggcgtagaagctggtggcgccgtcgatgggggcggtcgctcgtcgtcttcgtcgcagccgccgttggcgtcgttgtagtcgcagccaccatcaccatcgtcgttgtcgcagctaccgccgccatggccgctcgctcccacccgtctaagcccgccgccgccgctcccgagggcggagacggccagatctgctgccgccgagccgccgtcgcctcccctcccgccggatctagcggaggggagggcgtgacccctgccgccgtggggccaccaccgcctcccctccctcagtcgggcctccagatctggcggagggaaggcactcccaccatccgccgcctcctcctaccgtcccgccatctacagccgttgcacctccacgccgtccgccgccaccacgcctcctttcccgcgcctcccctctcgcccctgccaggccggcgccggcgccgctgctacacacagagaaaggaagaaagggagagagaagtccagagaaatggagaaaagagagagaagacagccttatctcctctgagtgtgggccccaccgggagaagacatatctcctccggctcggcttgggaaggtaggtgacggcttcgagtatatatagtgggacaactcacctcaaacggtttagggtttgaacccgtgtgaggtgagtaaacctcacctctgacgggccatccggttgcatctcgtcacaggtaactagtcacatgtgacgggccggaagtagaaaccgtcagaggtgaggtttaactcatctttgacgggttccgttttcgacccgtcataggtgactagttacttgtgatgggtcgcagctgaatagctcaccgatgatgaaatcctttaggacccgtcaaaggtgaccatcatcactgactaccacttatgaccgtcacagatatgccgtcacaggtgtgaggatctggtgtagtgagccaagatgtatatatgcacgtcattgatttttttttatacatacatatcttggaagagtacatgtgctttgcttgaccttattgagattagatatatatttgccaataattaactaatcgcatgattgagtttgtcctacatggctcattgaagagtcgttcacactggaacagagcttagcgtgctggttatagatagagatccaacaaaataaagttgttaagttctcaaaataaaaaggctgaaaagaggcatatctttcgtgctctcttttcctatagacattgggttgtccccaaggaagcaaatggttggtgcagattcaatgcaaatataggaacaagacggaaattctgttcaaacagctcttggctcatttttatgggttttttcgctttgaactaacattgagttaaattgaccttagttaagccgcaaaacaggtctaatttattagttggaatgtctgttagcatttgaccaaaaatacctctaaaatccagtgaattcaggaccgtaggactgctttgagattcgtgcaacaacatccaatcctaatacatctttcctctccccccagtcccgattcccgtcgccgccatagcttcgcttcctcgcgcacgcagccgaaagacgtcaacgatacccctcgaccttgatagctagctgaaaaacatcaacagctccagcgcggctccccttctccccttctcccctctcctcctcctaaagctgccctcacccccat

SEQ ID NO: 41949 - DNA, 3994 bp, Oryza sativa
attcctgcagcccgcacaaatattcaagcagatagggtgtttcaaaatatataagaaattctcttcattttctgtcgaatgttatttaacagttgtctggaaccaagaataaagccaagcagtactactagtactagtgtacttcgatgacattggcagctaaccgtgtcaccggtagtttgattctttaagataatgaaaaatcacagcctttgcttccacagttacagcttattattaattaatactacaatgctcacagcataaaaaactgaaagtgccaaagtattaagatgacaagataacataccaaaacactgaggtaaaaatttgtatgaacgtcgagatccgtcatgcaagctggatattgtccatatatatattcttaatgcttagagatattatagcaatataagatgggacccatagtcctatattcttttatgtatagcacaatatataatgtatatggttttcttttgatcttaagttagggctcactaagaaaagggaactctatttagcaggattaaaagagcaatatgttgcaaaggcttaaatttttttttatggtctagctttaagtttaaggttcgtcatagcaatattctctcatttgcttctctcccaatgtataaaggtagaaaaaatattactttattgcttgaggtactttttatgcaactagaaaggtagcccgcgcattcgcgcgggcatgtttttatttcgtttcgaaaacagatctatcaaaataagtttaaattaaagtgaggtattttgcttcttaactgaatgttcattgtattttttctttaaaagtcttgagaaactttcattgctcataaatatataatttttaccatcctactatctcctttttagttgatcaaatatacatatcttagatagtgcttcttatacataggaccctacaatatttttaagaaaaatacctagtccatatgagtcttaaaataaaaattagtaggaaatttataatcatatcgttatacgaaatgctattgattttgtattgacaccttagaggcatttacatgcaagtcgtggaatttagtgtattcatttaattattattgacctttgtctcttgatgtgtcaaagggaaatatgacttgtatgactaaaatagttcactgtgtaaaagcttcaacactatcttgtgggttaagtgctccactaaaatagttctgtgtaaaaacattacaaaagttatttctacaggtagcccatgagtccgaggcaaaaggcttatcacataggaggctgcacatttgaggaacatgtaaaaagtcttctcgtggaaatcatttgtttaggagtgtgctgaacataattgtatattcaattaaaaaagttggaaaagtggcttaaagttgtcatttcacattgattggttatgaaaataatggtatatacaaatctttgtgcccatatcattgtttcgcaacaatcaatagaacttgatagttacttttggtattccttttggtatgtagcaaattggctaaatattttacaacttattgtatcgtttacaaagatgcacctgctttatttctctgtatactggattgtctcattgtttattaatggatgccttgggcgcatgcgacactatatatatttggaaaaagtacgaagcttgcgcccgccccctgcaccgccctgcctcgccaccgctgccgcctcgcctcactactgcctctgccgtcgcctatgttggagagaagagagagagtgtgtgtgtgtgtgatagattgggaaagagatagaatagagactgacaggtggggtctatctatttttttataaaagaattgctgactggactgccacgtagaccaaaaccaccgtggattgggtcgaggggggtatttcgtcctgtttgcataattgggggtgaagaatgtccggttttcggattcaagggggtaatttcggtcgaccgcgatagttcggggggaggggggtaattcgtactttttcctatatatttcaaataaaaagccttctcgagtctaaattgatttcgcagtgtgggaaactccacgtagcttagcaggaacataatttcatagctaaaaatactccacatgtgtgattataatgtagtgtggtttgattgttgtcatgatttaaatattttttactctaaaatttatgattaaacattaggaatttacataatgcaaacgatcacttgtgtgattttattttagctaacatgcattgggcctttagttattatatttatattgcataatcctaaatacgaagcatacaatgcttatcctattttatctttcttgtttgaaagaattagccatttatacaaccatggtagtttaaatactaaataacttttaacttttaagtttctaaaataattggtacaaaaaggttttagctcggtcatctgtggtacacatatagtcccaagcaaatttgccccctcacgctgacagtgtcccgggtaatgtcgatggggataaaactgtgaccgattaggagtattaattttttcagttccagaaagaaaaatgaatctcagttttttagaccactgtctaatgttttcttccgtaagtgtacaaatgaagctatagccgatctcatatcctttacattagatcgatgtatatggtccacatcattatattattttatatagatctaatggttaaaattaattggtccatcgatttaaatatttttattttttcttagaatttgcaggattttttctaatttatcagagagccacgtgacgatttagtagcgtttgtagtatataatataagacacgtataattatattattttgacttatgggggagtaatttcttttggaacatttaggtttattctaatttaattattgtgaaattatgtttgatgataaaatctatatcattatttttttcataatattttagaactatttaaatggcacgtaaaagtcagaaattataaccataatgtgacattctttttgaaagtttaaatacaagcagtttagatgttatattttttttaatcatcaactgtgcttgtctattcttctgtctaactaatatattaaataaaaataggaataagaaataagagagggaacaaagaaggagagagagagaggaggcataccggctgtcaagtacgtacgtacctacaacttcacgtatagtcggataggaggattgcttttttttttaatagattgatctaatggctaaaattgctgggtccaccgaattaaataaaattttaatagattgatctaatggctaaaaatactgggtcctccgaattaaataaaaatcaatggtcagatgttttgcttttttcctagaatttttaagaatttctctaatttattagagtgacatgtggcagtttaagagtgtttgtagggtacacgtggcagcttaggagcgtttgtaggaagtttaatggacttctagtatataatagatattgtggatgtccttatacttttgcaactaagtttagattgaactatggtactttttgtacaaaatgtggatgaccttatatttttcccttatgtattaatagtggtgtatcaacattttgttcctcggggtcactggatcacagctaactaaattaattatatcatgctaactagtactccctctatcccaaaataaatgcggttttgcactatttatgtccaacgttcgatcgttcatcttatttgaatatttttatgattaatattttttattgttattaaatgataaaacatgaataacactttatgtgtgactattttttttaatcttttataaatttttcaaataagacggacaatcaaacgttggacacggatacccacggctgcacttattttgggacagaggtagtactccctccatctacttttaatagtcatatttcatcttggcacacagaccaatgataagtaattctacttatcatccatttaaat

SEQ ID NO: 41950 - DNA, 6533 bp, Oryza sativa
catgtaaacattggccagcatcagctattcaacttatcagctactcattcaattcctcacattattcagctcctccatgaattcagcaaatgagtcaacctgtctcaatcttattctgttgagcccgtccttttactatgcacatatctcatatgccagatcctcattttcccccttcatttgaactgtatatatggcaccaaggaaggcctctttcagtcatttgtcttgaggtcagctacttgtcagtcacgaggtgagattgaaacaccccatatgttgtgtaatgaaagtattttgtctatttcatatgttgtgtaatgaaagtagtagccagatacaattcgaatcggagcgaatttgaaaaacccttctcggcccaagcctaaatgccttttgagagagtttaagatacaagagctgattggtagtcagcttctgaaaatttgaataaactaggttttctaccttatttagatttttgaaaaattggattctacaactacaacttttcagaatcttaacgaaaagttagattgttcagggaagattctgattctgagaaaatctaccgctgccaaaagtttctccaaccaggtcctaagtcgactaaataaccttatgccctgtttggactggcgaaaaaaaaaagaattcttgataatttgatcatgtttccatagcacgagtcacatatatacaattttctttttgtcaaaggcatatgtacaatttgataatgttggtgtcagtatcggattacgtacacgtcagcgatcctgtggcaccaaataaaaaggtagcttgaaaactatattcagttgagctcacaccgtttgtttgatatatctgggtgtactaaaccaaaggaaaatcagcaccaatcagccatcactaaatagtgccagaaagcgaccacccaattaacacgacgacaatacccccacagcggataagatctgtaacgcgtgtcctccacgctgacgtggaccgggggtatatgcacgtcacatgttccaacgtggatagttgctccttactctcttttgagtaataaactgcgtctacggtatataaacttagtatgtgggtgtaatctagtgaaaaacttaaaaatgagtatatagatgtaaaaacttggctagtgcgtgcattttggttaaaagatcaaaatattccacaccataccttttatgccatcttgataaagatctacatgtattatatgtattgcttttaattggttagttgtaataataaataatctatcgatttgaaaccaaaagatatatgattatcaaaagtaagtgcatgcaaataacataatttttgagcaatttgactaatcaacatattaattgtctcaggttatgaacatggcgaaacacgaaattgaatccatgagccaacaatctagtagttatgcttataatatcaggattaatgaaagacatatatcagtgttttttttttgactaaaatgcacgtgattgttaagttcatgtaccggtttacttatttcttgcactaaatcgcacccacttacggtgggcgcaatttactcttctctttttattcctttatttattttgtgaattgggtaaaataaaaaaacacccttaatgggctgggcccaactggactgtagtgggctaaggcacggcacgtgtacaatagcaacggtgcagcacgatatgtccgaagcatgagcacggcacaaacatggctcaaacaaacacctatagcttccctcttttgtttttaccgttatgttcatacgttgcaacgggtaaaaaccatataattagagatgtgttaggagggtgattgagaaacattggatctggtagttacgtaatcagagtggacacgccgcgtgcaattggaggggatggaagaagatgattcgctttttttttccttcccccgttcattttctttcattataaccattttctttaataaaaaagattaacataggctcatcaaagtcttgggtcatgtttgggcttcttgatcgacatgtgggccggtacaacatgacccgtttcgctagccgtgcttaacaagtcataccctaatgggtgctgtcctgttgcatattctatccgttctataaaaaaatgtcttagttcaaatctactctcttcatttcaaaataagccaagatcgtaccggtatatctagattcattgtgctacgatgcattacatctggtagtcattgatgtatagaaattaaagaaaacaaccatacaatgcgtgtaaccatacaaaagcttcaggcccagtagtgtatatgataggtgcatatgatatggtagtgtatcggtacgagattggtttattttgggatacaggagtagaagtttattttttatggcacaagtctcgttcacatttgttttcatatatttccaaaataaaaaatgtcttggaagctcgttatcgaacataacggagcgaataccaccaatagcaaaattctcacatatgagaatgaaaaaaaaacaatatttttggcgacttaaattgctgtgctatatacgcgatgagaaaaggtgacttggtcgcatgaatgaaacttataaaaagaaaaaaaaacataacgatgtgtttttcacacatatttataagcgcctgcgtttcactgtgtttttttaattaaaaagtaaaaataaaataaaaagcatatcgatttcaggactccccccccccccccccccaccaattccctccccttccccgtttcatctgctgcggccggactccctccacgaatcctcctccgccgccgtcgccgccgccgccgccgcaaggtacggtgtatgctgggtgccctctcctccgctctcctcctacggatctgctcgcttccgccttctctctgctcgttctgggaggacgtgtgatctgatggatgtttatggatggttgggagccgagggcgatctgttcttgccatgttagatctctgacgcgtggtgcgtagcgacgtgttatgttagatcccgagccttttttttttgttttttttggtctgagatttatgggggcggtgatcttccttccgcctcgttcatgaacggtttggatctctgatctgttcgttcttgttgttactacttgaattcctgatccgcgttactgcgtgcgtatcgtatccccgcgataattcagctcttcttctttgtctctgtgatctcttgcatatggtgctacaactacaagtgaagcatcgcataaggctcatttgtagatttgttcatgtctctgttgcctgttgatagtgtcatccaagtggtgttcgtttctaatgaagatgaagatgaagatgaagttgagttttaattatgacaaacttaaaagttggatttgtttgatattacaaagcaacttatatgtacgtacgaaacgtgttgtttagtagtttgaaagacgtgatgatggggattgaggtaaaatagaaacgaaaaccacctaagtctcacagtgtcgattcaattagaagatgcagtttagctagtctattagaaaactgtttattggtctcatgtcctttggggactgagtagattctacttcttatattcagccttttgccattgttatcctttcctatctgtcgtctgcaatttgtgcttccatcatatgatgggtgcctgtacttctgaatttcttgttgaacttattgatgcaacatgtttgattattgaactttgcattgtgtgtataccactagtgctgtcattctaatctttgaagcctgtattgcccttgcagagagctaaaacaagatgccggctaatggcgatggccctgccagagggagcgcagcagctgccgcaagcttgcgcaggcgcagaaccactggcggtgccggtgccggtgctagaggtggcaccagcacaatgcttcagttctacactgaagaggctgctgggtgcaagatgtcccccaatgctgttctgatcatgagcatcgggtttttcgcggtcgttgcccttctccatgttttcggcaagctataccgtacctcctccaactaggttgacaatgctattatccatgactagcagattcagtcaacagaggatttcgtttgtagagttccttcaatgcatagcaaattgctattcgattatgaaaagttttctgttatcatcatagaatgtcacatacctttcagtggagatgtttatggttgaattcttaaatgcgtcatttgttgatcattaatttgctgttgtggttattctcgcgaatgtttgtttctgcaatgaagtatgtcctgattatctgacatcctagattgattttggctatcttcagtctgatccttttgtatctcgccctttacattaagcaatggagcattgtgcaacagtacagtacatccatggcaatttcactattagggattttctccagtagaaaacaatgaatcccatacatacggatttgggttcacctgcagtcagtcattatgttataatgtattggctgcctatgcatgtgcatctgaaatgctcaaagctgtagctggcagtgtaatatggattcagaaatgctcttagttgaactggcttagtctccctgtccctaagccctcattaagtcattattcagacattgacagcaaagcaacactgttacttggcatcaaatctggcagaaagtattacaactccgtctagttatcctgtcaaaaacactatcgtattcccggttgggtatttgctgctgtgcttgttctgaagaatctgcagttgatcacgtacctggatacatatgagtcgccaatgaagctgcaaagcaaaaataactaaactcatgtgcaacataactatagttgggtatctttatgtcaccaattttattgtgaaagctctctatcataacattgttaattactccaatatagatgaggacatgaaacaaaatgcactgcactacatgtgaaatgttactggtaacaggaatgcacatctagtgcagcttaaatcgtcgacgagctcaacaaagcaatgtatcgagctaggcagctaactggatttgatatctggactcaagcattatgattgtttgggtgcccaaaaaaaagttatttgctacacaaaattgttagtacatcacttgggttgctgttgctattcaggtcatggaatgaagaatagtcatggtcttttcagacagagaatcgtatcaaccgataataaaacctcccctaaaaaagataaaatcgagagaggtccatgaagattaggcatttctgtatttctccaccttccatttcctcttgaataaattgccttctcttttgtgagtgtactctccctccaatagcttttatatgacgtttaggaacaaaaaaaaagtgagtgatttagtgcaatttttcttgtctgaaactccaaataattttgaccggagggagtacaagattgttacgacgcagccatccgttgggaaaaaaacgttctgaagatagttgaatgcaaagttcaaagtcatcatttataacgttcttctggtaaccatcttccaacagagagatttttttttctagtaatgcaatgatcaacatgataaatagtcggggtattgcccatgccacaaacctgacaacgatctggaattctaccaagatgcatttttctgccttcaaaacatttgtttctaacctttaggaatcatccagctgtggaggtatataagtagttaaatcaccctcgaaatatttagtcttaacaatttgtggccataataatccttgttcacattctaatttccaccaacacttgcaaagcaaattgatatttgaaagtctaaaggatttgatacgcggaccatcttaatgcttgggtttgcaaacaccttttcccatttcactgaaaatgccatattttctttagggtgaccaccctctcaaagaaaagccagaagcttagtcaattaaagatttataagcaaaaggatcattaacatgtgttacattggaatgctagtcaagcatgaatgaattaattgaagttattcttcctccaacagaaacatcacttcaataagataaatctagccttttggcaatttttccgacttgagaattccgaatcacaaactttcaccctggagaattcagcaggcactcccaactaacccaaacacaccatcaactcaagaaaaattattttaagcccagataattactttacatataacaatttttcatatttcttctttctaccacatcaccatccttttgccagatgacactgtcatctgcatccggtaaaatagccactcctcagatgaggaactgaaccacgcgctagattgtttaacttgttaagtctaatcagttctcaaaaattcaaaccagaaacaaacatggtttcatttctcaaatagcaatcacccactatcgaagtaatgtatagggatgaaaacggatcggaaacggatggaaactagctttatcatattcgttttcatattttttttcggaatcggactcggaaggggcgcaggaat

SEQ ID NO: 41951 - DNA, 4885 bp, Oryza sativa
aatcgaaaactcggatacggaaatgaaatcgaatattatcgaatatagatacggagcgaatacgagacggaacgaatacggtagcgaatatttaccgatatataaaaagcccctcaaattgagtttcttgataaaggaagagatatcacttattattttagttaaacatcgctaacaattatatcatcaattttgtagacggtctcacaaccgtatgtgaaaaatcgatttttattgttgttcctctaagagatccatatgcaaatatgattatcattttctattctcaagaccttttactatatgtataacttacttgccattgtataaattggagatgttatttattttacttcacatcctcgaaacttgcaatatttgttttatgctttaaatgctttcaaatacaaatgttataaactacaaagtggtagatcccgttgagctctacaactttgatatggaacacatctccatcagatatcgtttgaattgtaaatctgagattttgtaaaaattaatatggtatattataatgaatatttagacccttaaataacctcaaataataaaatagtcaatatgaaagttgtagatctcatcgagctctacaatgttgatataaagtttgtcttcatctgattccgtatgaaaaagttatgtatatatacatgttttttctaaaatttactcaatgtctgcggatatccgaaaaaaattccagatagtttccgaccgttttccgattccgacggatagtacccatactgtattcgttttcgtttccgagaaaaaaaatccgaattcgtttccgaatccgagaattttcggatagttccgaccgaaactatccgaatccgaaaaaaggtccggacggacggaactatccgaaccagtttcatccctagtaatgtagagtattcatctctatttgtgggattcagatatagtagaattggttctcggaatcgccaatacgactaggaaatgagaaactacatacactttgttactgatcacactgatctagctcctaaaaaaaatcttaacacctcatagttaatgtacgcctgaaaaaaattgcactgcaaacaacaaatggattaactgaaattgccacacaaatgccaacaaaggtatatcaaccggctggtcacaacttcacaagtacaaaagaaaccatcggcaccatcacatcacatcacatctagcttaattagttcaaagcagtacttgcaatttgacagaggcttaaaattagtactaagtgtcatcctcataaaggtagtagttagccatggattagtcaagcattgaatgcacatgagacatgaattaaggtagcactgaccaggcgatcatgaccgacatcctgcagaacccaagattgaatccacacctgcttctcaacgcatgcctaggcctgatgtccacctgtctcgtcacaatctcttcgctgccaatctctgcagcctccacaccaaggatcaggcttcccttctcctccaccaccacgacgcgccgctgcagcacgacgagtgggccactgtcgtcatcgtcattgaccaccgccaccttgccgtcaccggagtcgagcagcaccacgtcttcatcgatgccagcggtgcgagcggtgagacgggccctgaaatcggttgagccttcgatgacacgaactgcgatggtggcctccacggcgaatatcaggtgtgcgaagacgaactccattgtggagtgctccgtcgactcgacggatctccgggcgaagccagtgttgttcatgtgagctacgccgtcgtagaagaaggcgttgtagcttagcaccttatcgtcctcttcagattcagacaacggcaagccactattgttgtgggtgatcaccttgaggtcaacctcgaacatgacagggttgatcagcacgacggcacggctagggccagtgagcgtcagagatgaatcctgtatatatacatgcataaacacacataaatatatatgcacagtaagcaatatacagatcatgtctggattctgatcttacacattgatcttcagttcaaaaaatataagcaacaactgtgatccaggatgcaaaccccgaatttcagaccgataaaaccatactaactattacctccattttaaaaaggatgccagactgataaaactaaatactccatgcgtttacaaatataaatactttggacttagacacggtttccaatgtgctactttgacctgtatctataaaaataaattattccaaataaaaagagtcttatgataatttgtttaacgataaacctagcaacatctttcttacgtgatccatcattatgttctctttaacaatttggcagtcaaaactaaaaaggtttggcttgttctaaaagtgcttatatttatgatcaaagagaggagtaagctagtactagtataaatcatgggaaagataaatacgttgaatgtgatgcttgcctgtggcgaggtgagggtctggcagtcgtccctgtcgcggcggaagaggacgttcctcttgtgatccagcgagtcacggacagcaacgatgccgtagacacgcagtggccactcaaggttccccatgacctctgtcaccttgactgaaaatatttgtagcacgtccattggccacgaggatatcggcagcacaggtccatcagtgtgctgcatgggccggattgcagctgtaggcatatagatatagcactagttgaatcattattgaatacatggaatggaatttcagtgttctaaaagtccactgtgattttgtgtttgaatgtgcactaggcagctgtcctgtctggttatattgatataattctactttctttttggaaaaaagaaggcttgttaattgcttggaaagcgctagacaggtttgttataagagtttagccctatggaccaccttgcgtctagcaccttctcgaaccatgtggaatttcatagtgaaattctgtcgtgcgacctcattcctcctgacacatccagtgcagaccaggactgtttgtgtacgctcagattaacttacagcagagtggtcaatggtggtgtttgaatctcctgaagatgaatattaaatttttcacgcaaaacgaggtggtaataacgtgtgattaattgagttttaattatttcaaacttgaaaaatgtattaatctgatattttagaacaacttttatatagaaagttttcgcacgaaacgcaccgtttagcagtttgaaaagcgtgtcacgaatatctaaaacttaatccacttttttaagtggaaacgaacggagccatttgcctaataaaatttagagtgaattacgctttgggccacattttattacctaagtttcactttgaaccacccttaaacatatattttcactttggaccagatgactttgccattattgcgatttggaccaccatgaacgatttttttttcagtacaatcagcgaccttaaacacatcagctttagtacacggccgaactcctctatgtatagctcatatgtttgccgaaagggaagttagacatgatgagaaaaagttgtttatggtagtccaaaccgcaacaatggtaaatttacccggtccaaattaaaaagataggtttaagggtggtccaaattgaaacttaggtaataaaaggtggaccaaagtacaatttactttaaaatttatcttactagtatgcccaaaaaagaagggaaaaaaaactagtttgcacatgagcaaattgatggccatatatcgaaatcttgtccttaagattaagatgacgcctgtaaagaaattgtttgggcttcttgtccttaagattgtccttaagattaagatgatgagatgtgattggtgcgcaatgaattgtccttaagattaagatgatgagatgtgattggtgcgcaatgaagaagaagaagtgggggttactcactctcgtcctcaaaggaggatccgtcgtttttgccgtagttggtggcccaggtggtacggtaggagtcgaggaaattggagtcgtcgttgtagtagtcgttgtcctcgtcctcgtcttcttggcaggtggtggtggtgttgcggccgccctcctcgcgcgacctcttcgcgtctccgccggcggggatctcctcgtcggggccagcgatctggccgtggccggtcccgttccgacccgaatccacctccatcccctgtcgctcgcctcgccgccaagatcgatcgctagggttttttcttttttctttttctttccccggataagaaagctagggcttttgctcggctcgatgggaagtgtcggggaaatatagggatgatgaagaagcacgtcactggtgagatgggaagggaagtgggccgggccggagacaaatgagcctcaaatgaagcccacttggccatgggggcggttaccgattggaataagttcaccggaggtcctcaacttaacagcgagattttttgaaatcccttaaccacaaaaccataaatgtgtacccctaatctcacacaaaccgtgcactcagggtcctatggcagtatatatgggtggttttgcggacgtggcatcctagtcagtaaaaaaattaagaaaagtacgtggggcccacatatcagccgttatctcctcttttcttctccttctcttctcttttctctcttctctcttctcttcttcggtgaaggaaccggtggcgggtggagcggcgatcggcgagcgcgatgtgggtggcgggtggcgggcggagcgacggtgggtgagcgcgggagcgaagcacgcgatggtcgagcgcggcgacgggtgccaagagcgcgggagcggagcggcggtggcagcggttggcgagtgccgggcgaagcagtttggg

SEQ ID NO: 41952 - DNA, 4359 bp, Oryza sativa
cccgcagtgcagaagggcctcatgaataactttaatttttcatttcagcccttgcccctttcaatttcatccacatatttttttttgatttacaaagaagtccaaattttacactaaccacccctaaaattgagagaagaatataaatcccaccccaaacccaccaccggatccacccccacaacccctcctatccccccacacacccccacctcggcaagttcaccggcgacgaactcgcctccggtgtccccccactcccccacctctacgatgaactcccgctgccggcggcctctcccctctccccgttggcgcctctccacttccgaacgccgttctacctctcccatcttccctgacccagctacgagctcggcgttgagcggagcagcgacggcgacaacgtcctctctccccttccacggccacgagctccgtgacaaaccgtgtgaatcgagcgaccagatcgacgccatcctcgacgcctctctcctctaaggcttctagagtggacggatgcgaagcttgacggtgtcgccggatctggtgtggtgctgagcgacgtgggcagaggtggatcttggcggtgtaaattgggtcggcgagctcctcggcggcagtgtggagtgggaggccacagtcgcctggcttgaggcggcgggggcggagattgatgtcagcggcgcaaatcgagtcgacgagctccccgctgcaaccgtcgtcgagctcatccgatggtcatggaggcctccgttgtcgagctcatgtgcagtggttgtatgtggcgagagactaggcatggcaaacggctttgtgcgctttgtctgtgccttttcctcgcctcttcgttgaggaacgaaaagctttgtggaggtgtgagggaccacaccctctctcctccatggcatcacacagtctacgtggtgggatgaagaaacgctccaacatggagcactgtgaagggccttagctcccatcagaccgtccttgcctccgcctctgccgaccgagtctgcaatccctagggcatgtgggtccaaggctccaagacgagagggacgaggataagatatggtgcgtgtatttctctccaggggtatttaggtctttatcattttctaaatgtattttttaaaatatatttgtaacactagttagaatatagccaaacaacatgttcattctttaaaaagagggttaaataagcgaagttaataatttagggttaaattgatagttagctttccgtatgtgcaatggttccttctataaaaggcttggatgtcctgtcatgtcctaagtacccccatcatcctaccgggtcatgtgcacaattttcaataaaaagagttggatgtcctgtcacctattcatgtctcacgtatgtctcgcttagagtaaggctaataatacagacgatttgttggctataaggttctctgcagacttctcttagcccacacgtataatagttagctatttacaattaatacagtgtctctctcacataatttcatggttcttgtgtccaagccagctgtaagtttatagcccgcttctcctctctctcttctctcctctcctccaccttagcatttagccgacttacaacctcttattatacttgctcttagggatagcagttttacctacgggtcgggtacccgcagatacccgacccgatgggcatgggtatgggtgtaatattttatccgtgggcatgtccgcccgatacccgaacatatagtgggtagcagccgggttttattttttacccgtggataacccatgcccgacccgatacatatacatattagctatatttggcccatctcttaattcccatggccttcttcttagcccatttagcccattaactgagacatatatatactcactcaatgaaacctaacctaattcctcatttccccaccccatctttcccggatgcctctctcctctccataatccaaagcggcggcgcgtgcaggcagcggcggcggcaagggaacggcggcggtgctgtgcgtgcaggtgggggagcggcggcgcgcaggcggggcggcggcaggggaacggcggcggcggcgcacgtgcaggcaggggctgcggcaggggaacaagaggccgcggtgcgtgtgcaggtgggcgggcggcggcagtggaacaagcggcggctgcgcgcgtgcaggagggtgcggcggcgacggcgcgtgcagtgtggcggtagggggacaagcggcgacagcggcgcctgcaggtggtggcaacaacaagggaacaaacgggagcggcggtcaccatggtaggcaatagcgacttcgtcgtctccattgcgcatgaccacaatcttcgtcaaccgccgccgctcacctgacccagtcttcgtcactgcgcatgacccagtggatatccgtcggcgggcatgggcacgggcacgggcatggggttttgcccgattggctttgcgggcatgggtcgggcgtgggcacgtgggtcttgggtcaggcatggattcactctgctcgtgcccgacccgacccattgccatccctacttgctcttatgcgaccttgatacgggtgcatccgtaagatatgtatacaagtcatttttacgtaatatgcccatgaactaataaatgtcatcaagaaaattataaaaatacgtatcatcttcaaattcattataataggaagaaaagaagacaaaatctatcatacttatactcttaaaactgttaaaatttttatctttttgttatggttaaaataatgcattgaggttaagactttacatagcagtgtaatactactgaaaatacatgcatatttttctagaatttttttggtaaaatttataatattagaatatgtctcatcttttattagattggtttattttggtacaaaagtagtaggtaacaagatgtaacaagtagcgggtagtaagatgggggccatgatacaatagaaaaaaagacagatagatattggagggaagatgaacgtccgcggaggaatggagaattaagggaagagagtttttaagtatttgtttagtttttaatattttaagtatttgtttagtttttaatatccggtctatggctagatgatattacgcgcctcagccaaagcatctggccatacgacgaggccatacgacatatttggttggtaactaatgttgccacacattcttaactaaggtggctaagtttagtcttgtcacgcttttgtggaacaaaatgacaaactaaagcttagacagtaacaaaagtgtataacatgtgggccaaatgactagttagacaaaatagagttgtgataagaatcaaatactgcctatcaaaattgtggcttatctaaggatagacatggcaaatttaattgctaatcaaacatgtcctactatctgctttattgccaacctcacaataatgaaccaggtaatatagttttttacggtgccctaagttttattttttcttaatagaatctagaattaaaatattgtacatatttctagtaatgaattagcgcagttaatgcgacgcaaagtgtacatcctgtcggcccggtcttattgattttgttcttggttgaacggcagcacaataaatgaaatattactgtttattgttgaaacatacagctagctcgctgattaatactacctccgtcccatattacttgtctttttgagtttttgtttgtcaatgtttgatcattcgtcttattcaaaaaattttaaaattattatttattttatttatcatttgctttattatcaaaagtactttacatatgacttatctttttttatatttgcactaatttttcaaataaaacgaatggtcaaacgttgcaaataaaaagtcaaaaacatcacctattatgggacggagggagtaatatacacttacatgtgtgaatagccacttaagattaaaattttcatgtgatacttgcttaaaggggatgtgttaactaaggataatttgtcaaggcgtaactcgaatggcagcttgaggtgttctttttgtttgaagaatgagtctattcaacatctctttataaattgtcattttgcaaagttcatatagagagcagttcagttctcttttggttttaatcttccagttactatatctcatatttttaatgagtggcttttgggaattgataagaaaaaaagcaaactgatactttggagcttctgccatttgttgggcaatatggctaagtaggaacgatatggtttttgataaatcaccatcattttcctatatgcaggtcatttttagggcaactcattggcttcgattttgggcacaactacaaaggtgtgatg

SEQ ID NO: 41953 - DNA, 5047 bp, Oryza sativa
ccctaccaaacccctaaccccgacccccacagcgccgcgccgccattcccccatcctttcttccccaaccatcccagcgagtcgacacctggtgcccttgtgtcctcttggcacgcgacgcgaccgaggtcttcgtgctagctactaccactcgctaccgacgaggaggacagcgatggcactggcggtggatcccctcgcggtgcgatcgctaccccaccccacccctcctcctcctcctcctcctcaacctcttcctccccaatcattcaacggcatttgattcttcgtgaggcgagcgaggagttaagagtacaagcggtcaattgtgtcgggacgggaccagatcaggctagttgggcaagcatccggacgacacgcgccgaaattactgcggttagggtacgaaatcaatgcggttgaggcggtgattaggttagttaagtttggtataattagaaccgcgaggccccaggtggatacggcagattttttttttttgtttttggtgtgtgtgcgcttttagatccacttatgattggtggggtattgaatactgttgctgcgatcgggcggcacgaaagctacgctttagaaagggaagttttgtggatgcattcgttgcggataattagttatatatgactaatttgtctggtactagcagtctataaattgttgtgagatcagattcgtccatattctacctattggcatgacagatcccaaaaatcactcacctgactacatggctagtggatttattggacatatataatagcggcaagttggttggacgacctaaacacgtttaggagatagagtttttaagagaggataatatcattcactgtatttaaatgctttgttcattgtcggggccccttcattgtcactatcaacactaccaaattttgacatattttaatgttaccaaaatttttggtagtataacaatgataatgatatgaatagctttttgtctttttcgtattttgatatagttaaaagtggtaacaaaatagacaagccctaattttaacttgcatgtgttgtctgcaagttcttgttttcttttgcaaataatattgttgcttgtggattggttgtcgctaggccgcctcatgcaccaaatgcgtctattataatattctatgatactgatgtgtgagatgaggttgtacatatttaagtatatactccctttggtcacaataaattgtgttttggacatcatatggctttaagatgcgattttcgacgctaatttattttgctaaatattaaaaaaactgataggttataatattatgaaaggaaatttcaaggccaatatcactttgatggcttctttaatttagtaatatatcacgacatggttaaccaagaggcatttcccattttgccctatgtgaaactcatatgaaactttgttagtaaaggcagttagaactcataaattgttctttcaaacaagaaaaagaaaacatgcccccacataggggcattttttgtcatttaagtggaaagttgaatagataggtgtatgtgccatgttcaatagtgagaggtaaatgaaaaactagacaaattctttttggctctttatagtgttatacgagtacacatttgaaaagagaagcttccatttttgctacttccatttttcaagtatagtagctggccgtttccatactttctaacaaagtgattatcagttactatcactattaatgatattgatttttataccacaatattcactgtttctgtttatgaatgcaaaaacctttgcaaataaaccaaataaaatgtatcaagatgtttggaacttacatatttaaaaagcttggttaccatttgggtctgtgtacattattgaacacaattttatccagttgtatttagcacaactttttgatatggctgcttggcacataggtacacattgtcaagtctgctgtctattacttgtgtttgtcagtgacctactatacttatgaacttgagtgcatattgcattttccaacctaatttttatattagaagttcttcagattttattccatacaacttggtacatgaaccaaagatatttctatgtatgatgtgagaaatcctcttgttttggtgctttgagtactcatttcaatacaatatacttattgtgtatttatcctttttgcatatttatataggatttgtcgatagcttcagtcatgattctttaggttatcaaagggtcacttatgttatattccaaatatatgtgataattctctgaacttgcatagagcaatgttatattgttatggacagtgctatacatgcatgagaccatctaagaatacactactcaattcttattactatagatctaacgtattgtatacaaaaattatttacatctatttttaataaaaatgaatttccagtttttattaatcttaactaggctttgtttctttgagatcccagcttgaatatatatttgttgtggatacataaatccatccatttgtgcactttataatttccattaattgtaaattatgttaggagaacatttgcaaaaatgcctctctggtacaattttcgagaatgtatagtaaaacataccaattaattataggaaatataaatatcttgcaacctgtgtttaagattaacaatgtacgtactagctggtacccatatagcataggtgataccatttctctttgtcaagaagtcttgctgttatttcttggacttgttttgcattatttgagtaaagaaaaatagacatttcagcaggatctagctcaagactgctcaaatgaagcacgagcaggccacataaccaaatatgaatattttgtattagtattttgtactagtgtatagctacttcagggcgccttcacgatgtcgctgcttgtctctggttgcgtcctagagagtcggtgcctcctccgcaagcgcaatcaccattagggcatgttcaatggtagagacgagtatgatctcttaaacaataaaagattatttagagaccgtgtctttacaatagttgggacgacaaagactcaatcattaactcaaaaaatattccttttgttaatattctttccatttttttacccttatgtaactatatttctatattttagtgattaagagtcgttgttatgcataacaacgatgttttgtctctcctctttctatttcttccatgtcaacaagtattcctaattagcaacgctaagagaccactattgacaaaccattgtgtatgcctttactagataggacagacaagtgggagcataggatggcatggaatacactttatgaaaatgcagagatgctactggtgtgatcattgaagtcagtgacagtgtgcggatgatagattggcatttttggatgtctatatatatatatatatatatatatatataagttcacctagaaatgtgctttagacttgtgttttgcagaagtattatgaggtttttgtttgtcagttgggaactatattgcaagtaaagctgtgtatacacattagtagcaaattggcaatatgtgatgtgtggatattttgttttgattataaatcaaacctgcttgagcagctgtgttttttttgttctgcaaattgaactaaattggtgacaggaaagcacacatcctaggtcttgtttaatctggtatgggttgcttctttctcttatgtgactttgtctaatgctgttcaggacatatatactaggtcaagtttatgaatttccatataatgtttcaacttccagcttaattgtccttattggtaggcattttcggtagtatggaatgcatgttttaattaacttgaagtattctggtttgatgatctgatggcaacttggtttgtgaaaaacatacttttgcttttatacctgaaaaacaatcttttgccgtcatgctattattgtctttgcatcttattactttgagttatttaaatatgtggaatagctaatgacaatcattcatgatattgcagggccttcatcacatagatatcgatgttactgatccaactcagggaggatacacgacggcgcttaattccattcgagaacgggatcaagaacgtgctgggcagaatacttttcatggagtagcgatcacttcactgaacaaacaatggcgtcgcatcaacctcgttcatcaggacaggcctaccgtttcactgctgatagatgaatcgaatggatatctggttggatttcgcagaggagatggaacctggatgcattttaacgaccaagagctgccaaatgtgcctggcacagagcagagggtgccaggcataccaatccaattaagctcctcgtatatgaatttgattaaggataatgaaaggtttataataaaattcttcttattttaatgaaaaagttactacctaaggattcttacatgcaaagttcttataagtttcttcttttcaggccttacttttcagtggggagacagagtttacgccactcttactttgtgctgctcaattatgatgcggaggtggacttgaggagtgcaatgatgaagagacaaaggaaggcgttgacacagttgataatccttttctgtgaggcggcacggataaggccagttctggagttcatttctgaggccatgtcaaccgaggacaccacaccactggacgagacactctggacatggatcaagaactggtccaccctgtcccgtttcgcactccactgcagaagatgtgagcgtgatgctactccacttgaccccaacgaaatcaagcacgtctccccctacggcatcaccagcagggagcaagttctggaggtgctactcctcatcctgtcccgacctttgtcccaaccttgatcgtatggtggtcagctggtgatatgtacatattttttttcctagaaacttactagtcagacgaccaacctggtgataagtttgtcgacagcaccatcttgagatgtttacctttgtgagttctgtgaagccctggtttagcacctcaagtggagaatcc

SEQ ID NO: 41954 - DNA, 2944 bp, Oryza sativa
catgaattgggccaaaattcacaagtctacgaagtgaagcaacggaggaggccactagccgaaatgtgggctggttgggtcagccctggatccctttgttgtatatcaatcgtcaacattgcaatctggaacaatatgatcacagcatacacatgtcttttcatccatcagcaattgtgacctccatatcagtctgctgtatatcaatgatgttgtgaccttggcttatcttctgccaacaggaaacaaatcctctaccgtaccaccctctagcatacggatccgcatatccatctgtcctataatataagaagttttagggttggatacggttattaagaaagtatatactcctttcgttccaaaatataataagttttagagtttgacacgattacttaaaaaaagtaggtagaagtgaatgatggaaaattgtgattggatgagtagtgaatgtaggtgagaaaaatgaatggtggggggttgtaattggttgagaagagaatgttggttgataagttgttatattttgggataaatcctaagggctaaacgttgttatattttgggacggagggagtacgtcaggttaaatgcatcagaagagactcaggattactgatgcactgtaaatatcaggttaagtgcatcagtaatatgacattcttttttttttttgagaaacatagtacaaacgtgcgcacactcacccctatgaacgcacacacgcacaccctacccctatgagcacctccgaaagactgggccggcagtaatatgacattctgatcaactgatttgagagtttacagtgctgatcgatgtatgcacactgcagatgcttcttttcaactccctgatgatttttgagcgaaagaagtgtgatgataatggatgtgatcgatgtggggaaaatgtggtgttcttgatgatactgaagctgatccattgacttgtgatgacgaatccttaatttatttttgatttgcgggtgcatggcttgtgatgatgccactctgcatttgttgcagtaataaggaacaaatgttgaaatggtcgtggcttcgtttctgaatgttgtagggttattagaaatctggaacaatattcaggggaattgttgctacacaagttactgcatacggagtacgagttaacccgttagcactactacaactaaaagcaacgatcagatgattcgtatgacaacgccgatagtattaccactgaatgaatactaacaagatacaaaaacgagcatgtgtgcataaagaatctaaccatttaaattaagctcacatcgtgtcaactcaaatttttgttactcgaaattcaaatagtaacatcaaacttcatggaaatttggtattcatctgtttcatatgataagatgctttaaaattttcaatttaaaaacatagtaacactatcaacataaaataaacgtactattaaaatattttcaatgttgaatttagtgaaactaatctgacgttataaatgttgttaacttttttataaagtcaaagcgtattatagtatgaaatggttaaaataacatacaactgagtactacttgagaagttattgattttaaagttttcaattttttttatcaaatactatcactgtagacatcaatatttataaccaaattgaacggttgtcaaatgagaaacactcaagaatcttccggctagctccacaaggtagtggactagaaaatctgagttcgaagactcacctcttctaatttttgatattaggccattcttttatattcgcgttttttaacggccgttaaaaaggataaaataatcccttgctttcttattatagggctgtaattcgtaaaaagtctgtgcataaacagcaaagtaggcccagccaaagcccaaagcccttgagggcccaccactgcaccctaaattgccatcccaaccgccgccgccgaaccccatgcaccctctccccccactcccctcgccgccgccgccgccgacgccgccgccgtcgccgtcgaatcgaaaccaccgccatcccgcatcccgcgtcggagcagcgcggggtgggcccagatctgacccagccacacccatccctgtgtcgccgcgcgtctccgtcatgcggcggggaggcggcggcggcggcggaggaggaggaggaggaggaggaggaggaggtggtcgtggaggtaggggaggccacgcccgccgggacgcgcggccgcgtgatgacaggggcagggacggcccccgtgacgatagggttaggcacggcgaccgccgcccccacgactaccgcccccgccgcaccccgtcgccgggccgcgaccaccgcatccgccgcaccccgtcgccgtatcgtgaccgccgccgcatcccggactaccacccgcgccgcaccccgtcgccgcaccgcgaccgtgaccgtgaccgccacgcggcgggacgcccgaggggccgaggcgacgacgaccgggaccgcgacccgccccgcgggaggtcgccgccgccgtatcgcggcgatgatcgcgggaggtatgacgggccgccagactacatgctccctgaccacccgtcatccctgcgtcctgcgaggaaggacggtgagttcttcggggaacccggcatgacactccgggtttgttcgacggagatgggaaggaccagctcgctgtatctggacaggaggtcgccgccgctgccaccacggccgccacctccaccagtgcgagtggcgtcgccaccgctgtacaccttagtgccacctgcagagactggattcctgacagggggatccgcgatgaaggccggcgagaactttggcacgggaagtagcaggtcgctgcttgacggcggtggcgagtttcagtaccgtgaccgtttggatgacccgtatgttgagaggagtagagaaagagagatcgacaggctctatgctg

SEQ ID NO: 41955 - DNA, 6953 bp, Oryza sativa
attcctgcagccccaagatgaaaggattgaccaccaagtgaggctgccacttaggatggcagaagatgaggataccttccaaggcatgcatgatgggatggagcgtgatgtgcagcactcttaccgtggagatgcactaacacgtcatcgcaggacaaggaattctgatgtgcgctactcacgttctcctgaatctgagcgtattaaacttggaagacacccagttcaacatgggtattcttcatttgatgatacccatgagtttagtgaccaagaagtttctcctgtggtttctagaggaagaccccggaaggctatgtatcgtgatcatgtgacagaacactaccaaactgatgatagccctctaggacgggagtattatgatgatgatgtggattcatatgacctatcacctcagagaatggcagagccttatgatatggttgatgaccaagacaaatatgatgcaagatatgatttaccaaacaatcgtaatgttttctcaaggattactttgcgagatgacaacaatgatgggtgggctgatgaagatcaggaaaacaatcatcaatcgaactcaataacctatgggcattcacaaaacaagcctatatctcagaggctgtccagacccactggccactcacaatttgggggatttcccatgcatggaagaggaagaggaaaaagtgcaaaaaagagattaagatctgctcttcctcaattccatgttggatctacacaagggggagatggatttgttaggccaaataaacgtttcaagctgacagaagttaatcatgatgaccctgaaatgagccatgaggatgccccagaggacgaggacatttctatgcagaaagatcctcctgaaggctcagaagaattcactaagcaagttcaccaggcctttcttaagtacacaaagctattaaatgagagcccgaccgtgcagaagagatatcgtgaggcagcaaaaggatctttgtcttgctgtgtatgtggcaggtttgtatttcttcatctgtgctaacattctaccacctaaacagttcctcctatgactggaatggaggactccttgaaaactctataactttatcgtaccttggacctagatgttgcctagtcatgtttatcatacctggccctcgatcttgtagtttaggttacaatagctaaatcatattatgaattttatggtacttgacttccacatggttctacgagaaactttaggtgccctccacacagcgcatagaagttaaccttctagtttaattataggtcaagttatttcttgtatatggtactgttagggtgaaatcggacgatagggtagtatgtggcgggatgattttgaggaaatttcatgtagagttactgccaagattgtctgttcatggttcaatcaagagtcaggcaataaactaccgcatgttggcattttttatcagcttcaggcactgagagatagatgccaaagattttgatcagtgcagcaatggtctgttatatgagttgaccatttgacaatcttccctaatgccacagccaatagtgatgtacattctgtggactaatgcattgcaaggatttatcaggacaagatgacatgaagagtgtacaagtgaaatatggttctgttgactgattgttgcttttggttgctagtatctgggtctggggcagccaagtttgtatcctgttgaggtcaggagcatacaaaccaaattgctgttatgattctttggattaccataatcaaacacatggaaggcacaaaaacttgtgtttccttaatcaggcagaattgttatgtcttttttcaagggcattcaacgcttgccaagtcgttaaggctgatggataacatgtgttagtttgcgaactaagacacaaaccaatagcatcggctcttgcagtattacagcatgtcacttttttatattctggctagagagtagagactgtaggttgaaccaattgctgcatttgatgttgggtatttcgggtacacagtacatgctgcatattttgttatcttctattttgctctttccatcctggtgagtaatttatgcttgaaaattcacttttgcatttgcattagtcaattcctactgtttacaatatgagcattagtatagcgctgataagcttcatatggattgggatttcatttcatatctgtagcctttggtaggtatcagaaattgccattatttatgccttgacatcttcctagtcctaattaaattggaatctctatattgaatattactttttattgaagtaccaattactacagaagtttttgccagttaagtgacttaatgtttattttttttaacttttagctttgtttcaactttgttttattactcttctggttgctaagcatacaacaaaccttaaacacttggtttatttttcttgttcaaatcagatatcgttgatctttgctttcttggagtttgttatgtgtcatccttttttggtttattttaagctttagacttctattaaaatttattgcatgaagcaacagtttgtttttgctgggtgcatgaatcaacagtactgcatttcatttcttgagatagctgaaggtaaagtatcttcaattctgtatagttttccacctttaccatcttagttgcaacaatttgtttggctgatgtttttgctgttcctaaccatttattttgtttagggatactaaatatttggaatatttgcattgctatttcttatatactcttttcttttccactatgttttcgtctgctgcacagaagccacagccatgttctgcataaacccttctgaattcattacaatttgtcatacattatactgcactcaaaagcataatggataccatatttcttgtgtcgtagaattctgatttcattgaacatttacattggatgtctaacctgaagaactgctttgtttatttgttttcttttttgttcacttctttcgcataacagtgtcccaaggaagtttccggacatcgatgccttgatatcacatgcttatgatacatgcaaaatgggtttgaagacaaaacatttggggtttcacaaggcactctgtgttatgatgggatggaattggcatgttgctcctgacactaccaaaacctatcattccatgccagatgaggaagtaaatgccatgaaggatgatctcatgttgtggccaccagttgtcataatacataacagctccattgcaaccaaggcaaaggctaccgatgcaaagattgtgtcgaaagaagaaattgaaggtgtgctgacaggttagtaattcatttagtcccaatataatttacattctatcagtcccccttttatttgtttgtccctggagatattcaacctaaggatcgtggctatctagctcgaacaaaccatttttttggtcgcacgcttccttgaactagtatgcatcttcatttatggctataatctgttagaattttttataagatcagctgatacagtgtgaaatcatgtaactgcttttcccttctagatataatctgttagtacttttggataagaggaatgcttggtgttgtatatctgcagtttctggcacaaaatataatgttgagttttgaaaatgccctcatgcgttattcttagtgtcccttaagttgatattttcttctgtatccagaaattggggttgcatgtgacaaggcaaagattagccatggcagaccagccaatcagagcgtgttcctagtgaagtttcttccaacgatatctggatttcaggaggcgatgagaatccacgagcatttcaccgtcaaaagccacgggaaggaagagttccagcatatcaaaggtggcaaaggtaagaaggatgctcctgttgatgaactcgaggagttgctatatgcgcatattgcagtcgccgaagacttgggctacctggatgaggaaacaaagaagagatgcctggtcaggagcaagaatgacattgaggctaaagcagatgctacactgaacttggattcgtgaagtaacagcaacaaattaatctaggctaggtttactgcggctagttgaacagatcaagttatcctactttttgcttaaattgtatcgctgctcgaccacgtggctgcaaccttggaatccattatactgctacggttgaaccttaatgcaatttatccaagcccttgagcttttatattctagttttctgtcatttaatcgttttctttctcctgcaccttcaaattggagttgtgatattttccagatgatgcgtgatcaaatgaatgccacatgcacacatgattcttatgttaagtctccgtgatatcatttttgtttggaagtgttgggatggaaaatgatggaatgaaaatggttgattactggccagagatgtgctctcactgaaagagcatctgaaggccacaaagttgtgaaacttgtgcctcattactgttgctaatatgtactaagagtttaagaccatcttttaacactgttgggcatcagaacagagtgcggttaataggggtgttacactgttactgtattggtaatctaagattgcagcatgaaaatgcttcctgccaatttccatgcctgaaaattgacatctatcatggcatagaaatttgctaagctggaactggattgttatggtagtacttctattttgtctgtccccagctgtgtcagtaccagaataatctgtgccttgaatgtgcagaaacaaccaaccccttttgctatttctacgcaatacgaatttctgttgctgctacaataacactgttctgtaatagttgccattctcgtgtgctgctgccattgatgagattaagtggagaagagtagtacagtagatggcatcaaccaagcaaccaaagctttgaattgttgtttgcaccggtgcactgcagtgccagccactgacaggcttttcgagcaacggttgcctcttggcccgagaggactaggcacgggtattcatggcaaacgtcttcttttttccttctcttcttccccttcaaagctagggtgggtgccactttctttgtacacattcactagttcaagatcgataagtataatattgtactactccctctgtcccaaaaaaaaaagacaaaccctggtttccatgtccaatgtttgaccgtccgtcttatttaaaaaaattatgaaaaaaattaaaaagataagtcacgcataaagtattcatcatgttttatcatctaacaacaatgaaaatactaattataaaaaaatttcatataagacggacagtcaaacgttggcacgcaaaccgcgggtttgcctttttttttgggacggagggagtatgtagtagggttatcgtcaatgtcaagtagtacttcgtgattaataaataatattaatccctgttcgaatgtttatgagccgatgaagattatccatggcatgtttcctaagcttataaataatgtgatttttttgttacaactttttgcttctataccaaatatatatctataaccggatgagacaaattattgtactacgaatctggactagggcttgttcagattcatttctatctaaatttatagtactagattttttttaaagataatagtactataatgtttcatcaaattctagattactatattttaggacggagcgaataactttataacaattactccctttgttctttttatatgacgttggttagttcacgttatatattcagggatggaggtagtaattcattcgttggtacccttaaatattatcacaaaatcaggtaatccgtcatccgttcataagtttaaaaagtagttcagtgcatatgtagttatgtatgtataacatgttttacttcttggcttccatagttcagttggagaatgtataaagccttcccatccagcaactttttcccccttaaaacttttgtataaaaaacacgaatattaaggaatgacataatatcaaataattagaaggggcgaagcttcgaacccacgtcgtctagcccaccaccttgtgaagctagccagaaaacccttgtttggcaacttgagggaaggggattgggagtttacacgagggaattgatggtgagattaagatgtgaatttgatttttcatcccagtctcttgtttggtagaggtggtggaaattgacagggagtttagttagagattaggtcattaatgaaaacggatggctgagatttgtttaggcgaagtaaaggaggaattccctcccaattaccacccccacccgggtattgaaaaggagggagttcattcctcaattccccatccccatcccaccaaaatttccatgtctcccaaccaaacaaaacagttaatagcctcatccctctaaactctcaatccctcctaagccgtaggtgtttctgaaaaaaaaaagaacttttgtatcacatcaagctagttcggggaacccatgagaattgcaactactctggctattaacccttttcaattagtacatattcttaattcaggttgcgagactcgttgcctaaagagccgaaaaatgaataaataaaactggaaccagattcttaccaattgcaaatttgcaatatgagaatttctagttcccggagaaaagcccagatgaactcccaaatcataggccatccacgtggcattctaattaaaatgctgtatacttcacaatcgccatggatggtgattgcagcatcttaatttgatttttgctatgatgacactattaattaaggaagatggttagcagtagcagagagcttaattagtgctccctccactccccggtaaggcgacaataggatcgattttgacagtctgaaggccaaacaccacacgggtcacccgtagaccgttgaaagtcgcatcatccaagtccaacacaagtctccaaaaata

SEQ ID NO: 41956 - DNA, 3826 bp, Oryza sativa
ggatgctgctctgtgcccaatcttcagatcattttatttcaggatactatacagtttctattattaaaacaaaaaatggaattagttgtagctttaggatttgtatcggagtaatggtgtatttaaagagtcccatcttgagatgctatatatatggtgtgtaattacaagtttgccatgtttgaaaaacaaagggatggatataacttggtttgtcaaggcctgacatttattgcatcatgggataagtaggtgggcagtttattaaagaggaaataaacaagaaaaaaataatttctcattatagaaaaataactcaggattcttggctctttttaccagtttcgatcatttcgattatgacaactccattgatcacaccataattgttactaggtgattacgtgttgacgaattgactccaacagattggaaacatgaatatgcatttctatagtggtattacaaaagcagatagggacagacatgcttaaatattagccattgaaatgtgtctatccaaagatacactcgattaacatcgtttcaaagacaataaacttaaatatataaaaaatgccttctatatattaatactccatatatgatactaccaaaatgttctttaactttactccatatctctaaaggttttttttaaaaaaagtagttacacgaaactcgttcgatggtgctaaccacaatagctatttcacgaagctagcgcttgctattatagttgctgccagcttaaccatgcgtgcagagccatatactctctccatccttaaatgtttaacgttgttgacttttttaaacatgtttgaccgttcgtcttatttaaaaaatttaagtaattattaattctttttctatcatttgattcattgttaaatatacttttatgtatacatatagatttatatatttcataaaagtttttgaataaaacgaatggtcaaacatgtataaaaaagtcagcgtcaaacatttagggaatgagggagtatatcatcaatttatcaccaatctgaatttattttccacctatactataccttttatcaatcatcatccttcaacaaaaagggttgaaatctttttcaattctcaaattttttttccaaatttgtgaacgcgttgccacttgctactaattttggcaacacaaaaaatccatattacaagctttgctactcgaatattataataacagtagccacttgccccacacctctgccggcggttacacgcggtctcctctccttaaccccgtcttctcttctcctccacacgggagctcgccgccgcggcgagccaccgcgacctcccctccccctccccttccccttccccttcccggcgcgcgcatcgcatgttcccgcgacagcttcgtgcgccgagctgaggcgatgtcggtggcgctgtacgcgcgtgggggtggctgcggcgcgaaggcggccgcagcgcggcgctcggggcgcggcggtggtgggcggaggcgcgccgcggtcgtgctgctgctcgcgctggcgtacgtggcggggctgctcgtgttcgtgcttgcgggaggcggtggtgttggagttggagggcgcgtggaggtggggcgagaggtgggggtgatgacggtggcctcgctccggaggcggcgcgccgcggcggcggcggcgccgcagcccgggtcggtgtaccgcagccacctcgtgttcgagcggctctggccggacatccgcgacgacgccagctccgcctccgccgccgcctcgtcgctctcctccacttcttggcgtcgcagcatggtgagcgagcagagcagcccaactagttcttgcgattcttgattgtttcttgcctttgattttgggttctcgcgattcttgattgtttcttgtgagaaacatttctttcttgtcttttgatttttgtgttcttgcttctttgtgcgttgtaacacgatggaataatgaatcagaagataatttcgggaccatttcgtttattttgctccgattcatcacgggaaagatgcgcaatccgttcttgtttcgtgagatgtgcacttcttgatgctattcttcagaaaagagaagaaacaagttcagttcttgattcctttgtgccgttctttgtttctttccccttttctggttacagacgatggattttagtgagctcacatgccttgcgcattatgattttactgtacggacgcttcattctgctttgcttgctcatgattagatgtagtacttttgtacttttgggtgacagcattatgcttgatgagcatttagtccatgattttaattcgaccggtgaatatgtgctttcatagttagtgcaaaaccattcttaggatgctccaaaattgggtcactaaaccatcctacttttgttcttcgtaagaaccaacttttacatttcagaaagattcctggttctatccattatcatgtagtactaatatatggaaatatttgtttgcatttgtatcgtgcagttgatgacatcgcactatcagaatcctggggagctatggatgccttgtgtcaacaggaagctgattcgaccaggttccactttgttgaaaactacctttttctaggtcttgtgccccataatcataagcactgaaaagggagaattttactaacaatgtcgtgttacgcatcggttctttgcagagttgccaccttcaaatggttatctcatgatcgaagcgaatggtggtctgaatcaacagcgtctttcggtgagttctaggatcatcttttatgtttattaaaaaaaaagtactcatatatgatcatgcctctgagtagataactagatatgcgattatcagtatcttatttaaaagtctagtgccatatgcacctttttaagcaccactaaatctagttgggtagtcacattattgccacaaggtgtcactcaactgagatggcatcttcagcaactttgtgttgaagaagtgggattgtcactagacttgggtttgtcctggaaaaatgatttcattgagactcagaaccttctaaatgtttctggctttggatgctccaaacaagctgcttaatatctgttggctagaacctgtccaaacacgcctggggtagctatcttggcggtcctgtaggacatctatgatttatccagtgtgttatacatagttttcttttttcagcaggttatatactatttgatttattgttcctaacatatttcttttcatccaaaaagtttgacaacaatgatgtgttctctaccattaactcttagctgtgatacagatgatctgacacttctgaacttcttggaatctttcacatatgctaagtaattattaacacatattttccaatgcagatctgtgatgcagttgctgtggccagtttgcttaatgcaactcttgtgatcccagcatttcattttaatagtgtttggcgtgatcataggtaaatatctatttttttcatcgctttgtgtcttattatgaataatgcctgtctgtagctgttttcactttgaattgcaaccacatgtcaatccttgggaaattttcttgtgtgcacaaagttcataattgtttaaatataccaattttatttgacatcccaactcaagaagcgctcagtacttcttttcttttatattcctttcttccaacaagtttttgttttccagtgtaagattgaagcacatgttatttgacaagacaaatcacattcgaataacacttgatggaatgcaaatttgccatctgtctatagtggcatttgcaatttctcatatatgctattttactttccatttatgcagt

SEQ ID NO: 41957 - DNA, 2193 bp, Oryza sativa
tatgcaaaaggtgcttccgaaattgctggagttagggtatggtaaacactcaccacccatgatagagagaatttgattgaacattgtttcattttattttctattccattcagggctgtgcgaattgccccattctcaaatagactggcacaatcagttccatcaaatctccaggccttgagatgttttgttaactaccaagcgttgagatttgctgagccaataagagttctcgcagaggatatggttgaaaggatggtaaaacggagtactttgactggtgggaagtttgtatcagtacatcttcgcttcgaagaggttttgacattctctctcctgtaagttaccaattgcatgttttcattcatgcaactaaccttttgtgtaccactgtattgtttaggatatggtagctttttcatgctgtacatatgatggtggcttgaaggagaaaactgaaatggaaaatgctcgtgaaagaagctggagaggaaagtttcatcggcatggtcgagtgatcaatcctgaggcaaacagaagagatggaaaatgtcctcttactcctctagaggttaccttttcctttcccttcttcacttctcgtttattgcataatgttaaaaattgttgagtctaggtttggccttttagcagtttaggagaccatctcatgtgactgacacagttgcacatgtgcactgaagcttgcattgcacaccattatcttagactatttaatacgtgccgcatctcctttctattttttattcatactgaattatgtaagtgtgcttagttgttgaaacctcaggttattaccaccatgtgtaatttaattaccatcaagtgaaatgccttcttttaaagcactaaagataatgtgcaactgaatgcacttgtgcaggttggtatgatgctgcggggcatgggatttgacaataccacctccctctatgttgcttctggtaaaatatacaatgctgaaaaatacatgggaccgcttcgacagatgttcccttttttggcaccaaaggatactcttgctttgcctgaagagcttgctgagtttgaggtattgtttgccccccaggaactctgttttcttttcagaattttgattgtataggcactcatgaaactactcaccattttaacatttgggtttgttgtgtttaatactagaagcatttgtttaagtgaatgacatcaattggattatctccaattcaccaacctattgttctctgtattccacaggggcactcatctcgattagcggcattagattactcggtctgtcttccgagtgaggtctttgtgacaactcaaggtgggaacttccctcactttctgatggggcacaggcgctacctgtttggcgggaatgcaaggacaataaagccagacaaacggaagctggttttatctttcgatgatccgaatatcaggtcagttttgatcttccatttgcaccatcacaataataacccattaacctagcaggcaatatgttttgtgatcaatgaaagtagaaatgtcatggctgtcacaaatcttgcaaaatcagcttccattttgacattctgctagaaagactcttccacacaattaaaactgcttttagacaatatatctgttgaccgaagatggtcggtgtttcctttccaacaatgtatatttgagttgaccttagcctaacttcctcattgtcttgcaaactaaatacaacaccttcttagtcagactttcacacacacacgcacacacattattgaataatctcacttgcttaatagctttgcaatgtcataaaattggtttaggaccaaactgaaacacctcttttgtactactgcagatggaatcggttcaagcgccacatgcaggatatactacaccatagtgacatgaggggcactgcattgaggaaacccaatgattccatatacaccttcccaatgcctgaatgtatgtgccagcaagatgggatgatgtaggccttgtatgattcatgcacatacgtcgaggaggaggaaatatgcaattttgtacactctgtaatgatctgtaggtagccaccaccaccgtacagaagcaatctttggccgggaatttgttgatttctgtctgtagattgtagagagaggagaggtgaaaattggttctggttgtagatatgatgaaacacatgct

SEQ ID NO: 41958 - DNA, 10416 bp, Oryza sativa
ccctgccgacagttggtgttggtactgaacttattattgagcatttgatgcgatgcgaatggaggaacgctgtgagaaacggagatattcgaccaatgcatagtgtattaaatataaacgaaagaaacaaattacacatattatgtgtaaattgcaagacaaatcttttaagtctgatggtgccatgatttgataatgtggtgctacaataaacatttgcaaatgatagattaattaaacttaataaattcgtcttgcgttttacatgcagattctataatttattttgttattagactatatttaatattttaaatgtgtattcgtatatttgatgaggtacatccaaattttacaacctatctaaccacagccatatatgtgtgcgtcaacgcgtctaatcgaggaggatttggagctggagttgttggtgaggtggcgcctcttcatgccccctcgccggccaactactggactacgggagcaacgctttcagacttgtgcactaggcactgagacagtgactattaaatgaaaagaaaatacttcctccgtattttaatgtaacgccgttgattttttgataaacgttggaccttttatcttatttaaaaaaattatataattataatttattttattgtgacttgatttatcatcaaatgttatttaagcatgacataagtatttttatatttgcataaaatttttgaataagacaagtgatcaaacgttggttaaaaagataacggtgtcatacattaaaatatggagggagtaataatgtcagatttggttttgccacggtgagagattgtggacaaagttgtcactgttcgtcacttggacctgggctacaacacgacggggcctcgtgaaaaatgtttctcttgtgttttttgtgtgccctactactcttctactgctgccctgtgctgctgtgtgagctggttacaataagcaccatggattttgtttagagaaaaaagagtgactcatgtttacctatggcattttatatatttgagtgtttaccgtataaatcctaaaatttctctttaggttgttcagaacttcagattatgccattttaatccataccaatttttaataaagttgttaaagatgtgcatccatttaaattttttttaccaaattttagatacataagaaatcttgtcaaaacttgtcaatattgtcaagttgtcaaagtttgataaggtttattttggctataatctgaacaacccctatgctcaccaaggagatataatgaaattaataattgagcgaaatacatttttttcttactctatctgtccctctaaatataagcatgtgtaggattcaaattttatacgcatccttggaacactaatttcaatgcatgtgaatctagatatttttagccattacgatggagggagtggatgtttggagaagaaatcgaataaattggaacgaaattatttttccttaattttaatctttactaaataacctataaatacatatactccctccaatattcatattgataatcatgtaagtattttcaccaagaccgaggaatcattaacttccttatattttatttaatgtaagtatgtggtgggagaaaaaaaaatcaagaaacggtaccttgaaactcgaattaaatttaaaaatatcctgttcattcttttttctcaggaatattcgagatgcaaaatatttacagaaatatactgtcgatctcgcacaatcattacgcgtgggtgtgacgtcgcgggcggtatcgcacgaggaaaacacaagaccgcggtctcgtggaatggaagagcgggactgaatggtctcgcaaaatcaaacaacgacactatccaacggctccatttgattagtgattaattacttaattaataattaactaataataattaatgattaattatcctaattagtgattaatttcaggataattaatcgctaattaaatcggcattgaaccggtatcgatcattgcatgagcaagagcgctccgctgccgcgcggtctcgcgcgatactgcccgcgacgtcatttccacgtcacttttgcgcaacggttgtacgagaccgatggtatatttttgtaaaaaattttgcatcccgaatattcctgagaaaaaaaattgaatgaatagtatatttttaaatttaattccttgaaactctcctatgcaagaaacaagaggcttactatcccaaatgcctgcatgcatgcatgcaaactcaatttgcatacataaatgcaatgatgcagtacataccaatcgatggaactaatcttatatgatgatcaatttgaaatatctctttttagttattatgtaataattattataaaatagagggagtatttaagtactctatcgtattttaatgtatgacgccgttgatttttttatcacatttgaacatttgtcttatttaaaaaaaattatataattatcatttattttgttgtgactttatttatcatcaaatacggagggattttttttatctcatatactaccagccaaggttattgtgatataggctgtgtttagtttttttaaaacttccaaaaattccgtcacatcaaatatttggacatatacatggagcattaaatgtggacgaaaaaaaaccaattgcacagtttgcatgtaaattgcgagacgaatctaaacacgactctactacaggacgctgacgaaacttaggacgaagccggcatcatcgatcagtactgtaccctgaccatcgcatgcacgcaaacggatgatgatgttaaaatggagaagcataatcccacatggacgccacatgtgtccctcacattggtcgccggatagctgcagcatgacacgcaatgcattgtttgtccccccaaatcaaatcatcatcacctcccaaaaaaacaaatctctattaccattatcttaatatgcaactaatctcctgaaagcataaactaaaaagaaaagagtcatcgaacaacaagcagttccatgtgcaatcaattaatctgctacaatcactcatcatacaagcagttcagtttcatgtacaattaattaattacaaatcaacaagagcaagaaaccgcaaatcagcaacaaaatttgctcgaattggactcctaatttctaatttaattgctttttaaattaatttctcatgttcctgcaagctcagatctcttcctatcaccatttacaagctacagatttcccaaaaagaaccccaaaaaaagaaaaagagagagattttttttccctttctggctacgattctaccggtggtggatcggcggcgaactctccgacgagctccatctgatcctcgagatacttctgcagcagcatcccccgatcgccgccggaatcctccccctcccccttctccggccaccgtcctcctccccctccgccgcaccggcggcgaccacccgtcgccgccgacgacctcatcatcctcacccgccggaacctgaagacggccaccgcgcagcagagcagcggcagccagagcaccgccagcgacagcaccacggggaccaggcacagcgccacccacgccgccgccgccgccctccacgacggcagcaacggcgccgcgccgcccatcaccgcctccggcggcggcggcggcaagaaggggatcaagcttaatctgctcgtcggatttggatttattttcgcggcaaaagattttttgctccttccctttttatgagcgtttggttcggtttgcaccgaaagcaggagagtccgattcggaaaagtggttaggggattcttgtctgaattaagctgagggaggtgagatgagagaaaggatggggccctcgacgttttattgccgcgtcaccgtgggtcactttcgctttctcttgcttctgggagaggatcaggttaggctattctctactttcacttcaggcttccagccatgcctcacacagtcacactttgattgatttttttaaaagaaaaactgaattgctgatattttcatgatattttctgtgtctgtggcccacttaattactcaccgcgttccatgttcatattgtaatttgttttagttttttcataaattgtagaaaaacacaccaacgtctgtaacatccgattgatttcatcattaaatccatcatgaatatgtcttgatagcatatctatttgttactgtagaggttgatatattcattcttattagtggaggattttcagcacatgtaaaatgagaaaaaacttattagcacatgattagttaattgtttactattataaacttaaaaaatagatttatttgattttttaacaaattttatatttatttatttttattctaaaaagacataattgaaccatttgaaataactaaaaatgatgaaggtgaagtttgaagttgaagaaaagaacaaagcctagatataattagagaagtttgattcagagcaaaactaaaacgacataaatggaggaaataaagtaaataatttcaagaagaaggtggtagggaaatgagcattcttttacagttggtcaaatgatatggtatagaagtggttacatattttaatgtgcggaattaagagagaagatgggcttccgatcttcattactcctttcacttgtccttcaaagtcgtgaccactgaccacattatgtttctctgaaaaaaaactgaccacattatcaataattttccttttcaaaagaagtcctccaaagtagacccattcagatttcagagtcaactttagtccttttttgaaacatatttttacgttgatattaagacaaatttacataactaacacgataaattaatattttaagaaaaaaacttcctagaacaattaatttaaacaatatagcagaagatttttttttgagaaatcatatttttagaaacatggagcaaataacccgtgacaaaaatatgaaaaaaagacatgaaacgtacatgggctcagattgtggtgagtggatggtagcaatagattactctgattttgtgacattatttaagagtataaaagaactaattaaacattgaaagttaaaaaatatatttacaaagcaagacatttctgcataaaatatttttaataaaagttagaccgtttaacgatttaagaaaggtgggtagctaataagctaactgctcacaccggagttcgtcgccgcggccgccggtgacgacggcggcggctgcaagaaacggctcggttctttgcttgcttgttgctctggccttgaggtagtgaagcaatagcagtcgtaaaagcttgcttgcttgcttgtttacggcagtttacgttgcttttgcttctaccaaaagcgttcaattcgtcgccaggttcagactgacaggcgtgcccatgacgccatcatttctgttgccggccggccgaagcaaagagatggttttttaatggggaaaaaactttaccatcaccttggcatgttttatgcagtaccccatggttagctatatactactccctccatttcacaacgtaacattaaccacatacatataggccgtgtttgcatccccatgttcccaacacatcaccctcgttttccgcgtgcacatttttcaaactactaaacgatgcgttttttgcaaaaagtttatatgcgaaagttgctttaaaaaatcaaattaatctatttttgaaaaaaaattattagctaatacttaattaatcacacgctaatggaccgctccattttccgtgcgggagggattagttctcatcactggaatccgaacacagccatagatgttaatgaatctaaatacatacatatgtctagattcattaacatctaaataaatatgggcaatgctagaaagtcttacattatgaaacggaggaagtatatctgtttttaataaacaatatcattgacttttagacacatgtttgatcattcgttttatttaaaaattttatacaaatatgtaatatataaattgttcttaaaatatttttagtgataaaatatttcatagcaaaataaatgataattacataaatttttttaataagatgcatggtcaaacttgtacctaaaagttaacggtgttatctattaagaaaacggaggtaatatgtcattttcaattaaaaagctccggttactctgttttgagatatatttccttcaaaacaagacagtacatatgtgaccaaagcaacaaattatcataagcgttatatatatttcattactaaaaaaataagcgttttatatacctctacttttaatggttttatagtaaaatctgacgagcgacaaaagaaaagggcccattagtaagtaaaagaatcgggcttgtttatttactctctcgcggaaaatatattattgtaggtacgcttctcaagctcataaacgacacatgatttctcaattaactttcttcattagcatgtctgagaattttctttgaaaatcaacttactttatattatttaatccattcatttgtgccctcaaagaaattcaggggcgaagctagtatatgttagggggtgcccaggaacccggtcaagaaaattttttagctatacctcatctattttcaccatgtatgcacccctttaatacaaacttagacacccgtatcagtttaaactcgatctaaagtaaaataaattaagcaagtggcaccaccctctatttcactctagctccgcccctgcaaagaattatcataaatttagttttatccataatctatcctccaccaacactttaggacacactacttttcaaaatgtaaaaaccggttgcttgcgacatacatataatataagcaaagagaaattttatgcttctttagaaaatatcttgagttacctaaattttacactaaaatttatagtatctctgaagatattaaattttacactagaaaatatggtatctatcggtagtttcttaaggatgataaaattacccacaagcaaaggatcaaacaaagcacacctagctattagccaaacatccacatcactataattaaaataaaaataatttatataaacttgtacataagtgtacgtgtctatacatcaacgtgtatgtatatacctacaaatttctatgagatccatgcattaactgttactgtactagttggcattgatggagcgatgcatccatactcttgtgaagaggtacatgttggaggggccagcaagcacatggccatggagtaatgcattctattatttccttcttttttttaaatgtacgacaccattaatcttattatatgtgtttggccattcatattattaaataaatatatactaattatttattttattatgatttgatttatcatcaaatattatttaaacatgatttaaatatttttatatcggcaataaaaaaagataaatggttaaacattgataaaaagttaacaacgttatacatttaaaaagtgaaggtagtattttttttttcttttaaagagaaggggagaatataatagtggtacgttttaatgtagttatggacaatttcgtcaggtagggtacgtgcaaatatattgtcgtgcgtgcagcgtacgtagtgacgcagtttcatgtggcggttcgtcggtggatcacagcagtgtcgatcaggtacccatagcttcgtgtccactgcacgccaatgctaccaccagccttttttttttagagaagggtattttttatccggcctctatatccaattggatatatacgaccattgaaatagggaacttagccccgcaaacaacccaatctgaaattcgctccataggagatttgaactcaggaccttggggtactacttaggtcactgtaaccactaccagcctagaatacctagtagcatgtggcgttcttagagcaagtttaatagtatagcccactactagatccacttcatctatagctaatctaatagccaattcataccatagttgcttactatactattaatacctggccctatctgtcatacacacattatgttttggagtccgtgctgcagctggctacagatctgtagcccgatgttcttctctctctttctttatctctttaaaatatgtttatagcctgctattgtacctgctcttagctctaggccttaatcaattgacaaagctaaccatattaataagtagtaagttaatttagtaaaactgtaactaatgaaatcatcacaaatgcattgactaacctaatcaaattataaatcatcaaactgttgaagcaaaacttttcaaatgtatggttttgtgatatagagattcacatgtggtgatataactatgtagttttggggtagctagcttcatcatagctaaatatacaattttgcaatgtcatgagacctaaatccgtagttattggataaatttgactttagttttgtgatattgggccttcagttgtggttttgtcaactggcctggcccataattgttttatcataccataaaaagaagggagttattattattattattattattattttttgaaaacagggagtgtatatatgacactcgattgtactatctccatattttaatgtatgacgccgttgacttttttttcaacgtttgaccattcatcttattaaaaaaattatgtaattattatttattttattgtgacttgattcatcgtcaaatgttctttaagcataacataaatattttcatattttcacaaaaaaattgaataaaacgaatggtcaaacgttggtcaaaaagtcaatagcatcatacattaaaatacggagggagtaataaattacataggtttccatcaattttgtggaaattctatatatatatcgttgtggtgccagccaagaaaacctcaagttttattaatcctctggcaggctagagaagagctggcccattcaacctagacggcatacgtcttgggccaaatttcttagatcaattttcgcacaatcacgagcgcttacgtccatcatcctggcccaatctcctctacccaaaaagaaataggtgcactattcatccacagtacaaacgttgagtttcaatcacatccatcaactacaatactgggtagtaggcatccctcatcttctagaaccaatgcaaatgtagtcccaacacagtattgagtatggtttttgttgatttaccatccacgtggcagccaagtcactaaataaattaaaaatagacgtaaccccacatataagtgataatggaggacgagggagctcaggtcggcatcgatgatgctccgtcttcgttgcagggagagcagccatgttggaaaatgtgttagagtatatagatatgatcgtattgtatccagtttgttatggtagtataggattagattccatctctatctctttgagtttacttaagatccaatctatttaacctatatataccggcccccgaggctcaatacaacgtgtccaatattcgcagtattcttctctcatctactatccaacaaaagggaaccacgaagtgccactgtcaaggtcccctagcgccatttcctccgtgatctccaacttcttgagtggtgtcggcaaaattttgtggagctccacaagccggtgaccagggagcagcgacggaggagatgcaggtggcggccggcgtcttcacagccggtgagcctgtccatgggagaggaggtgcatgctgaccccacaaaaggaaaggagagagagagagaggagggagggagggagagaaggggcgtgcaaggtgccctggacgccgcgtgaacctcctccccctccattgctccctcattgatgcagccaccggtggagacagacgatgggagagataggggaaggggattagaggaggaagaaaggggatgccaatgagacgtgggtctcacaattttttttctaattgtaagcaccaaatgggcgccatttagaacaacgacaggatcaacatgacacgtaggcaccacatcagccaaaattattgtccaaaacatcgagggattacatttccattggttttataagttgagggtgctctatatccagttttatccagttttgcagttgagtgatgcggttgaaacttgacccctatttaagggaccttaagtgtacctttttcaaataaaaaaaatatggtattagcttttttcttctaggaaaaaatgcgttatattagttaattaaaaaatcaatatatatccatattcctatatttatttattaactagcataatgcacgtgcgttgcaacgaattgtaaataacattcattgacagtcccaatgaaataataagggtttttaatatatatttttttgcatttagataatttcttaaatatgtactttgtaacattaaaattactta

SEQ ID NO: 41959 - DNA, 3489 bp, Oryza sativa
cgcgaaatttttttttttgatgtcggaaggggttttcggacacgaatgaaaaaactaatttcataatttgcctggaaaccgcgagacaatttattaagccaaattattccatcattagcaaatgtaggttactgtagcatttatggctaatcatggactaattaggttcaaaagattcgtcttgtaattttcatgcaaactgtgcaattagttttttaatttatctatatttaatgctccatatatgtgtcaaagattcgatgtgactttttaggaaagagtttttgggaactagattgtagaggaaatttattaatccacgaagaatcacggcgtgacatgcaataccatactcaaatttcgacgtcgtctcaaatttctctgtactaatttcacatgcatttactcacgcttgcccaaaaatgaatggatgtcgatcgagtgcgtgaacgaaaatgcagctgatgagtgctacagggatccaacccgatagagctccaacaccaaactaatcaataattaaattaaacagcagcagcaaccgatcgatcgacaaattaaaacgttgcaaattgcgtgcgtgcgtacgtgagagagcccgcgtgctagcatcgaccatcattgcattcttgtgtaccatcacgaaaaagtagtggttaatcttagagaaaacgaaatggtggccggcactgctacgttgacacacatccgtatcgatctcctacgtatacggcaccacgcatatacgtatataatgataacaaagagaaaaaaacatggttttttttttgaatggttgaaaaaacatggctgttaatataaataatggaaagaaccaacaaattctaaaaagttattcataacttcaaaagagaagtcaatgtttatccctaaactttctctgtaccgttgatgtgggctaaagataagttctttttgggctaaatggttcaatggctgaacagctagctgaacttttttgtgataattagttgagagtaaaataaataatgaattaactattataaagttaaaattgtacccgagatagttttctaataaattttatactaaaaagctttgaaacaaacagtattaccgttttactcatgaacgtatgcatttatccatcaccacaccaaacataatagaaaggataaagaaaacaaactaactcttaattgttctaggcttgtcttgtgagtactcttattcaattctctcacctcctcttcttcaaccccgtggaggcatcgaggtaggaatgagttgcaacaaactaattaattgtttgtttattattgcaggggctattctttgatcatcaaacaatctaaatgtggatttaggactcggaccgcctagactggtccatgacctagaatcaaaagtcgagtatgtagtacatgtaaccatgtaaattcaagcttagttcatagtgcaatgggctggcctgagccttaggccaaggctgggtcccctgaaacagtccaaactcgatcaaagatacatgatcaataacaatcaacattaatataatactcaagcaaggatttcacctctaaattggcaacgtacatctcggaaacagatcctctggaaaactgctgatgcagtagcaaattagcaatggttgaggacccacatgttcgtgtctgctactgcaccagtagtactgcagacaatcctcactagttcacttcacactactaaattgatatagatgcttagagttccacttatattatcatatcttcctatatagttggtacccactaagaagcatttactcctataaagcaagatatgcaagaagccacatcatcaacaattttaagctattggattgcattagtatagagttatcagccgttggatcaagaagctagctactcatccatctaaattaatcattgattatttaattactcatccatttacctccctttagctcataatcatgcgtgacattgttatccattctgcacatccaaatcctcaaagatgataataatctcttttttttttctaaatacaactccaattattacataagatgtgagctttgttttgttataaacaattggataacatacaataattaggtatcattaatccaaactcatttttgaaacatgcttgagatgaagcaaagaagtgctacactacctaattgtgacgatatccaaattgtgcatgaaaattactttcatacatcataacaatattcaatgacgtttcaaaaaataaaacatgaattgtattgtaataacagaagctatatatgaagccatattttcatctattttgtatataccaagagttacatctaatcatttaaaacattgattttattcgatgataaaactagcaaatcccgcggcaagacatggggtgccaactagtttaatagtacttgtgtgtgccgtaaacactagtgaggcagcaataatttgccacatcactggctatgtcattgtgacgcgacgcgaatgacatgatatatagtccttgtcacaatatgatgttcttctacttaatacttatatactccctccgtcccgaaaaaacgaattaggacttgatgtgatatattctagtacaatgaatctgaacagaggtatgtccagatttgtagttgtagtactaggatatgtcacatctagtactaggttggttttttatggaatggagggagtaattgtgtatcactgtaaaactatcacaacaataagaataaagaatatacgtgacttaattaaagacatcctaaaagtaagttttcaaatgatttattttaaaattatatttggaagtttaaataaaactggggaaatgatgtgaccatcaagtatatgcatacaaccaagcatgagaaatataaaacattgccaaagaatacattggatgaatggaggatctacaagatattaaagtccaatgagttttggaatccaattcggtcttcggagacagcactgacttcaaacagacctagcgccttcatgccaactccgatttgggtgatcttggattttgtggaaagcttatctcgctacctttcaaacgcatccggtctcacgtccaaatttatctcaagtcaacgggaatcgccaaaacaagacaatgctgttgctgaaaccgaacttgggccttgggccttgtaatagactaggcccatctcggaagtgtctccctccacctccacgaattagcacttaaccctagctttattttcctctataagggcccctttgaatcgcaggattgagaaaacataggaataggaaaaacgtaggattttgataggaatgtaagtgtaaaacagaggattgcaaaacgcaggaaaaacacaggaatgaccgtttgattgaaccataggaaaaacacaggaattggatgagagagatatactcaaaggaaagttagcaagaggttgaagctcttgctaaatttcctccaaaatctctataggattgtccattacat

SEQ ID NO: 41960 - DNA, 1470 bp, Oryza sativa
gtttcaaagggcttcataggaaattttcctataggattgaaatcctctaaaattcctatatttttcctccaaatcaaaggggccctaaatagctttgttcattctcaaaaacaattgggttttgtttagttgaattttgccaagtgccattcaccttgtctatagttctatcgctcgattagtcggcgactattgattcagagcccccaatagctggtgtgttgatttgccgggtcgattagatctaccacttcaatcgcaactattcctttgtgcttaatcacctattcgcaatatttagattgcatcttatcttgtttttgtagtgttctctcgtttgcattgcaggaatcatcaaccgtgcgtcatggttggtacgacatcgtttgtggtgtagcgattgcacggtgtcctggacttgttctggttggtagccacgtcacaaacgtcgcactcgaccaaagcgagagttatcccctcaccagaagatcgggccacgagagagcgtcatcagaaaaaatggtttataccgatccagcaccatccatatatgcttgcagacttaccaaccaagctactcctacataataacatcgaaaaccaaaaaaaaaaaaagggtcgatcgtctacttgttgatagccgcagcttttagcttgtaaccgttactcagtcatactggtcgctggttgttgctccaccaaaaacgttacagcataaagctgcagatcggaggattttgcctcacgctagaggaggcacctgcaactgcactttgctatacccagctgatcaagtatatacatactgagcatagtagagtgtagtaggaagaaatcctcagcaaataatgcttcagcagtaatgcggcagatatgtggaccccacttgctcaaggggccacatgtcagtgactcctactgcaggagcaacgatggagaggagctggtcaatatgtagggtgtaaactatctaacgttattctaatgttatagtgttaagattgttgttcgatttgtcggttacttgatattggactagccgatacctttgaatgactccgatcggctcaagattcctgcaatgataatagatactgcatataaatagatcccccaattcatagtgtactcctattgctatcttttcttgagcttcactgctgtggtgagaacttttgttgttgtccgccaactcctcactggtctcagtgtctcacctgctgaaagttgaagatgatagcacgggttgttggattatgaattatatatatatgatgcattgtccccatattagcaatttggtgaggtgtataagtgttatttccccaaaaaaaatctctccaattattgagcttaaaaggtttaaataatgaacctacaatgttctaaccaattaccacaaaattagagtatccaatgccaaatacatgtttttaagtgttgccttataaattgcaatgttatgtagca

SEQ ID NO: 41961 - DNA, 8416 bp, Oryza sativa
attcctgcagcccagatttcgtcttgttttttcttgactttgttgctatattggcaagaattctctcacttttatctgtcaactccttaatggtctcgccttctggatgttgaagacgatagaaagggctgttggattatgaattataatgatcaaatgccccacattagttgaccatcttaaatctcagtcttccaaagagtaaaagcataatcgtagagtacagcaaatgcacgactaattgtattaagagatatacatatacacatacatcgatcgattgatacatgaaatcaattaataagtcagttggtagatgatcacagtcgtacattctgcacaaagaagaagaaaaaaacagatcattcagccaagaatttaaaggcactgatcgagaaagtgcgtgggaaaacaaggacgaacatgcgtgaaaaggagatgatcgatatgatgcaaagatggatggatactactccagtctagtagagagcaacctccatggacctaccacttggaggtccacatgcatggaggcaggagatgcagtagcaacgaacagcaatattgcaccaactgcacgcccttttgatctgccatgcactctcctaccagtggatcagtgcttaattcatctatccattcatttccaagaaaaaggaaaaaaaacaacctatttaatatcagtatgattcctaaattaattttccgtgtttaaggttccggagtcgaatagcacgatagacgtggggttcttcggagatacttcctgcattcggtgatatggtcatactaacatgtggaacctattacccatagactcacataatagacacccagagaattctgatcccacaatgtgacaatgatacatgggtgcatagattagattcactattgtgcaaagttgactacaaactaaggatacatttataattagattagttggctctacataagtgtagagtccaaatgttttgatatgtttattgaaatatatattatttaaaaattaactcacgtgctgataaaagtatattattatgcatgccacatagctcggaaattggcataattattatatctactcccttgtcccacaaaaaaccaacataggaggggattgacacatactaacacaacgaatctgaataactctgtccagattcgttatcttagaatgttagttcagattcgttgtactagaatatttgacatcccacctaggttgatttgtttttggtgcgaagggagtaagtcgtggaaaaattgcccaacttaactggtataagtcgtgcaagctaataatgcaactatttatagcttttctgcccacaacccacacatggtccatgacttatttgtaacacaagaatttatataaatctcacgtacgtgtgggctgatataattttcttgaagaagctttttcaaaatagtcctacgtatatgttatacgacatgacttcaatttcaactctttttgcatgcaatctttaaaggagcacatcgggttcaccaatgatggagacatgatgaaggaaggtgcaaactagcttttggaagttagagttttgcagttattttcaaagatggaatggaccttaagagcaggtacaatagtaggctattagccagctataaacatattttaatgagataaacaatgagagagaagagcagcgggctatagatttgtagccagctgcagcacggactccaagacgcaatgtgtgtatgacaggtgggaccatatattaatagtatagtaagctactattgtatgaattggctattagatcggctatagatgaattggagctagtagtgggctatactattgaacttgctctaaggaaaagacccctagtttgttttccttgcttttgagtgtttgtgtaagaagttgctttgaacttgtaagggttctgagtctaagtgcttgtttaatattggttgaggtaaaccttttgtaatggagtctatgtactattgtttcgttgttgactgtgtacacccactttggatatagaggtcgggttttaacctttttttttaaaaaaaacatatggttaactttgtagcgatttcagataatttcatcatctcgatgtgtgctcaaattctcatgatctggcagatatggtggtcatcttcattcttctatgacgaaggcgagcgatttggagccaggttgcaagacaaaccataccgtatttgggtctatatatgaagggtgatggcagatgctactaatattgttttggatactaccattggtgtctttgactacgactttatattagaagataagtttaactacatggttttattctttctagctatagaggagaccatgctctggggatgcttattattccttttgtcttcaaataattgtcattaaatattattcattcttaaactttgatcgtttgtttttctttcacgaaaatatataagaacgacttaaattacttcgtattaacaaagtgtgttgcatcataataataattctgtgtacatcacgagctaaccatttaaaatttattgatggtcaaatttcaaattatactgttaacatttgaaaccgaatgaagtacagttttgcttggtggtttgttgctggacatgtgctccttgttgtttggcttggtccgctagttcctaacatcatgacagtatttttaaagacaagtttacatgtattatttttatattttaaaactactataatttgacctcacgcccttgagttcattgaggatctatgctaccaccacaccatacaatttttacgatagttttattccagttacatataagttacatacgtcgtatacagtgtaattatactctagctatatacgagttacaatatacttacactatagttacatttgaaagttttataaccaaaaaacttgcgacggtttttttaggtagtcccttgtgacaatgtgatcagatggagtaccgcaaacataccacagccccccacaaatcacaactcttcaccgtcaccagtatatattgacgatttagtctctttcaaacatgaggattaggtaaggctgtacgagcacgtaaaacagaaaaaacattcacgtatgattaattgagttttaattattataaaattttaaaaatagatatatttgatattttagagtaacttctatgtaaaaaagaatttcgcacacaacgtaccttggccatttaaaaatgtgcaactatagaaaacggggccaacgtccgtctcgtcgctcaaacctacaagtaaaccgcaactatccatccatcccactgtcactctctctgtctccctcccccgacgacctaggcatgccacacccgctgccgccgccgccgccgacgacgacgacgatgccgctgccgctgccgccacctcccctcccgctcccctcgccgtcgtcgccatcatcatccaccaccatccctcgtcgccgccaccaccgccgcctcgcctcctcctcctcgacctcgtcttcctccaccgcctccatattctccacgtcgccgtcgccttcccgccgttgttcgtcgtcccgcgccgccgtgacgagcgacgtcaccacgaccgcctccgtcgtcgtcgtgcccttctcgtgggagctccacccgggcatccccaagaacggcctcgccgcctcgtcctcatccgccgccggcgagccggcgctcccgctcccgccgccgatccgcgcgtccccaccacctcgccggcggcgccagcaccaccgtcgccgccgctcggacggcgtcccggcgcgttccggcgccggcgaccccttcaccgcggccattgccgagtgcaccagggaggaggatagcgccgacgatttgcccggacgccgccgctccgacgccgccgccgccgccgcctcatccgagcatcggtggcggtggctcgccggcggcagcgggttcgtcggattcctcgacctctacggctgcaagagcgccatggccgtcgccgacgccgccatcttggctcgccgccggccagtcgtggcacgttccaagccaagccgagccacccggagagataagtaattatatttgatcaaaattttaattactactaagccgtgtgtatatatgataattaactaagattagattaggatggatttgatcatttctatatctctctcaaaaaagagggaggattatattgcttattctctgatgctattaagcaataatcttgtgtaattttgtttcattttgatcatcaccttatatgtattattaattagtgcatgctagtatgatcaatttgttgtggcatgtgctgcattatgtattcttctatgcctactatattgctgttggtgacagtggttaggctctgtttcttaattaaactagcacctaattatacttatcttaatcaaggtcactacatatatatatacacaaaggggagctggcaattaatatacaatgtagttgtagaaaacaacatagtgatgatgtccctacctagctaattaacacttaggtgctacatgcatgtcacctcataactcaacaaattgatgtgaaagtatacactatagatgttcaaaaaaaaaaagaatacaatatagcaccatgtatgtaagtgtgtatatgtatgcaccatttggcacacaatgttcctgtcaagtgctacacaatcatgaatactttgtaactaagctgttggtgccactggattaatttcatgatgatgctccctggccttgtatatagttagtagtcagttgtttttaagtcttaatggcaggttatgttcatggcatcttcctccttgaaagcactgtggatgtatataaaaaaaggtgacaagtggtcaaaagacagcttgattgaatcctgcagaaagtggtttcatgtgtttatgcatgtgagcatcatcttcttggcacatggtcgaccattatatttcttcatatatgcatgccactagatctatttatatatggaagagtgaactgtcacaaccagaagccgtagtactgtcctagctatcttgcagactgattaattagaagagtgttggtacgaatgaaatttaaaaaattcaggattttgtcgatatatcgtattgcttcttctattattgacgttaaaatacagtgaatatatcaactttgagccttcgaaaaattaggagtggatatagaccttagacaatgtgggccatgactcgtagtctaggatggaagctaggctcattgaggactttgattttttttttcatcatataaatttatgttgagtcaaaacatccatgaggaagctcaggtcttggcctctttctgaatccgcccctggataggatcctaaccatagtgaagccagctgaaaatatcaccgtagtcatctctattactttaacatggtaaactttgaattaaaataatgttttacattcgttcgggttggctgaccttaggtgatgcagtggtgcacccagtccagcgaatttatattttagatttgccactaatgtattccaattttaggagtatatatatatgcccatatgtatttcacatttaaggctaactcatggagtcgtaaggaaatatccttttgttttctaaaatagggcgattcgatgatctatcccagctctaacgactccaagattttttttttttggagacacgcataattaactaacttttgaaagaacgtgacatcgtagctgtagcaactcttacgcattagttggagaccaaattaagaggcgaagaggggatcattaatttctgaactgaactggaactacaaagctgatcaatatagggtcagttacaaaagtgctattttagataagctaaattttgctagaggaaatcgtgacttcacagttttagctataagacactacaataagtaacttttggcgaagtcactatgtaaaacgtgaaaaattagctcatagacactacatccatagaaatattcatttctacttgaataggactctactaggaaaacgattttcactaagcaggcgggcatgattttcaacacaacatgtccgcctgcaataagggagatggaaggcgagattgttgtctacctatgaaaatacatcttcccaagcgaacaacttaagattcccctacgaagatatatctttgcaggcggaggcttaagacgtccgtttggggaaatagtgcattatcccaggcggacatctccacaggtggcaccttaagacgtctgcgtaggaaaatatacttctttcttcctgagccctgtgcagttaacccgaagtttctctctccaaaaacaagaaaaatagggggaggttttgaactcaaaatcttcgacggatttttctacagtgcttagatctatgcattccctctcttgttacaatttttttatttttgtagtccttaattttgatggatctatacatgcaaaaaagttaaagcagcatgtgtaatttttttttgctttttatgcctttttatgcattgattatgatggatctatgtatacatcaaggtgccatattgtcctctcatcccttatggttaaatgtgatgtttttattagccaaaatatgtattatgcccacttttccaattccctagatctagataggagagattaaataaatatgtattttgcccattttccatcccctagaggtacatagtagaaaacatatgtattttgtttacgttacttttatagatcacaattctacagttattaatatttctctttcccatagcgagccaagttaagtattttataaataggtatttttatgcaatttaaatttgttaatataattataatgaaatattctcagagatatgggtaggcaatggatgtatcatacgccaagatatatgccatcatatacaaatgaagtatcaaaatttactgatattattaaggcgcgtgcagcagcaacaacacaacggagatacattgttcatatgataactgtaaaaatgaaaaagtaagagagaaataccactactacttacctatttgtaactatgccattgcaatgcctctaaaattgtatccatgccattttatatgcagcagacgtgttttttaattatttctctaccgtatttttagatgaatcaaaatacccaatcagcatgtaaaacccatccgtcagttttccatctcttttttccttttcctcccctccactctcatgcatggggggccatgaattatgtggcacaatggcgacccacgttgaaagggcgagcggcagggacgggcaatggttgtgcatgggcagcgagagggcgaggtgatggtggcgtgccatggctgtgtgagggcgaggtgtcgttgagaggatgaggcggccatggcatctcctttccccgtcgtcgacaagctttttcgacagatccggttccttctcgtccatggcgcctacgaggccgctgaggagcagctcggcgacgcctatgaagtcggcaaggagcagattgggctcattgacaggatgggaaaaatctgcttagggagattaggcttgccgatggcttcatgctcacgaggtcaccgtcactactaaaaaacccattttcacaggcggccaaaaagcattttcacaagcggatagttgctccgcctacatgtaatcgactgtgaaaatcaatcattttcgcaggcggggcctgcgaaatcaattttttaacaaaaaaaaaaacctcacaaaagtcgttccaccaaatagcagcagaatggattagaagatttttcttagattcactaacaacagccagcatcacaatgaaaaacagcagcagaatggtttagagaggatttttcttagattcatcaacaaatgcagctagcatcatgaattcacaatcaccaacagcagcataatggttcagggaggatttttctcagattcatcatcaacaacaactagcatcacaatctttcatcaacaacaacaactagcattctcagatctggttcgtatgcgtgctcaccagccggcgagcatgcttgcagcagcaacagcctcgcaccgctgctgtcacggaactcatccctgttgtcgtcgcggttgtcgtcattgtcgatgaggccctccgtcgtcacggtcgtcgttgaagtcaccaaggcccctcccttgttgtcgtcgtcgtcgtcgccgccattgcagagcccggcccctcgccgccgccgccccgcgcgtcgtcgtcgccgcccggcgccccgccggtcacgcacctcgccgtcgccgccctcccccggccggatctgggagggcagccgccgccgccgcgcgttgcgtcgtcgtcgccgctccgccggccatgcgcctcgccgccgccgccctcccccggcctccctccggccggatctgggaggggaggggagggtagccgcc

SEQ ID NO: 41962 - DNA, 2774 bp, Oryza sativa
gcctccggccggtagccggggagaggagagatgaggggaggggagaggaggagaggggaggggaggggaggggagtggccggccatgagaagtggagaggagaggtgaggggaggggtgaagtgtggagacttagaaaaattcctgctatcccaagtctatttatattcaagtctattttcgcaggcgcaccacttaagcggcgccgcttaagtggtctgctttcgcaggcggaccgtaaatttcaccccgatttatatttttgtaagcggtcatttggctctaagggtcatgttcgcctgcaaaaataagaccctcacgtcggaaaaaatgctttttctagtagtgcgattcgctcctcaaccggagcttggcaatgttggcgaggagcagcttgggcactcctcaaacggtggagatgcacgatgccaccgattcaccgtgcaagggatcgtcggcattgagagagatgcgaaaccacctgcctcgtccttgttagccctgctttcgagccccttctccatcctcatcgcaccattctcgttggctgggaagaagaagacgatagctaaaggagaagttaagtataggagcaaatttgaccatacaaaagtacagtacaaaagaaaatgagtccaaataggtatgcgcgtacggtatggcatggaaccaattcatagtgtatacgaatggtatggttacgaatagatgaatagcagtggcatttatgtaaaatggtaccttttgtaatggcatggatcaaactaacccatcttcatctatatatgggacacaggctgaaagttgtgaaaggtcttgaatgaaaatgaagttgatcttaattgtattgggccgtgatttttgtgctgttgggaaggatgcccaacaagaccttgaccggtcagcgtgctgctagattgggctctgacaggtacaaaattataggccttgttagcaaggcctagcccagccttctgctgggcctgggctacctacatatccaaaaatcgattaatatctagacccaacaggtgcaaattaaaaccaaatttttgtatgcattttcttttaagaaaacacaatatagacgtaaggcttaccacacatgcacactcacccatataagtgtgaacacacattccctagccctatgagcacctccgaaagactgtaccatcatatcttaagattgacaaagttatcacaaacgtctcactgttatcgggtaagttgtataccacttatagaacaaatagccgtaaatattaatacccgtgtcaagtttaggacttaactcgggtggaatattggttccactagtttgttatcttggaaaaactattttgatctcgcaagggtgaaggggaagtccctggtttatttgaaaaccacttaaatagttatgaaatgctctcaaaatatttgacaacactcacacaatatatttatcacagtctacaaaattttatatccaaactcaacaaatatattgagatatttaaaaagataaattcaacgtataaatagcatatactgtttattacacaccgaatttgtctctttttttgctctaagatgtaggtcgaatttaatctcgattattttggactcatacatgttaatatactctatacattgtcatttctttatattaaatttttataactatttgaattggatttaggagaaaagggtacagatggaaacatacctcgataaagtagaatccattcccgttctcttgttgtattcacgtacacttaaaaggtacagtaagtgatgacaactaaggtggtgtttgtatccagggacttaactttagtctctgtatttagacactaatttaaagtattaaatatagattacttacaaaactaattacataaatgaaagctaatttgcgagacaaattttttaagcctaattaatctataattagagaatgcttactgtagcatcacataggctaatcatggattaattaagctcaatagattcgtctcgcgaattagtccaagattatgtatgggttttattaatagtctacgtttaatatttataattattatccaaacatccgatgtgatagggacttaaaagttttaaccccgtctaattataccgactaatggtaaccagaagatagatcgatgtatatgagacgtgcttacaacaagaatgactcctgacgcaacaaaaaagaaaagaaaagaacgaaaaaaagaatggtcctgaatatgctgattaagtcaacaagccagtgggagaaccaccaagaccacacccccggtcgtacgcacgccccgctttttgacatatttttggaagattattcgtctggtttaaaataagacaaaacatatacttattgtttattttatcataaatgtactttagatatggattatatttttatattttgtaaaaagttgaataagacatgattaaatacattaaaacattaatggagtcaaaaaaaaaaaaaggaatggaggacttggacacaattagatcaagttttaccgcggaggtgactaccacctctaattttaactagctatgtcatctggtataaattaattaagagataacatgtacctctagcccacaaactccaaaatcttctttaatgggctcactctcacactattttattttttttccactttcttaaagattgtgtagagattactctttgcatgagagatggaattctatgtggcattcctctctcttcagtcttcacttcataactaattctatgggctgcaggaa

SEQ ID NO: 41963 - DNA, 938 bp, Oryza sativa
gcatagcgcccgcacgtgaaaacaaaaaaataccaaaaaaaatttcccaaaaaagacctaagcctcgccgccgcccgagctcaccgcagctgctcccgtcgtcgccgtcaccagccaccaatggatccgctgacggctgacggatctgctgccccacgacctccggccaccgacatcgaagaagaagagggagagagggaggagaggcgacggaatccgggaggtcggagactgagcccgccattgcccgagctcgccacagccgtgccgtcactcccaccgtcaccgtcgcctgaactcgctgccctcgttgctcaccatcattgcctgccgttgccgtagccactcttgagggcggaagatccggccctcccgagggtggcaccgctggatccgccacctgtcgtcgccgcagcctctctctaccgccacccgctcccgatcgtctcctcgtcggtggcggcggcccaccggcgctcactcctgctcaaagaggaagagagagagaggaggagaggagaggaagagagagagggagaggagttgaaaaaaatgaaatggtggtgccgcgtggcgctcactcctgctcggagaggaagagagagagaggagaggagaggagaggaagagagagggagaggagttgaaaattttgaaattgtgggagggaaaagagagtggacgggagaaaaaaaaagggtggctatctggcatgcgcgcgccagctggcaccccctgcttcgtgattctcttttttttcacgattttctccgattttggcgccactctcccatcggcgcgtttttcctttttcactttttttatttgttttttaaaaatcttcagtacacgtgttttcaaatcttttagttaagagataatccatgaaatgccattgacaagcgtctaagtcccagaaatgctatcgacaagtgtga

SEQ ID NO: 41964 - DNA, 4282 bp, Oryza sativa
gtaacggcgcggaatagacaaaaccctaacggcgatggcatttttgggacaaaatcgtttgtatgatggtatttcttggaactcatacttgtcaatggcatttctgggatttggacgtttcaatggcatttcatggattatctctttagttaaaaggtttgaaattttgacttgaaagttttcaaatctcgagttgaaagttttcaaatctaagtcgaaagtttttaaatttgggttgaaagtttttaaaatttgtcttacaaatttaaatttcgagttgaaaatttacaaagtttgagttgaaaattttcaaaatttgccttcaaagtttaaatcttgagccaaaagttttcaaatttaacttgaaagtccaaatttcaagttgaaaattttaaaattttgagtttagagtttcaaatttttagttgaaagttttaaattttatgtatcgcttttaatatttcgatagaaagttttaaattttatgtgaaagtttgtttcacatattgatttatttcaatctgttagtaaaacaaatctccaaaaaaaaaataaaaatcttcccttagttactgtcattatcctaaactaactcggttagctagctttctcaggaaaaaaaaatctatggagatgaggggtatttttacatacagaccacttaagagatccgcatgcgaaaatgccccttaagaggcccgcatgcgctcctctgaaggaaggagccgtatgtgaaaatggatggttgattttgcaaacgcgacacgttacggtctgtctgcaacctataaggatcctcatatagagaaattgtttttaagtaatatatcttattactagatcagatattcatttctatcttgctcagtttgttttatattataagtcgatttgacttttcctatagttaaacttgatcaggtttaactaagtttataaaaaaatttagcaaaacccaaaataccaatttatttttattaaatctaacattgaatattttgataatatatttattttgttattttatgttgataatgcaactattttttttctataaatttagttaaacaaaaacattggttagaaaaaaaagttaaaacgtcttctaatatgaaacggagggagttctatctaacgctataacggagcgagtaacaacaatacatgcgcgtacgggggtcggaacagaacacacacgaccgtgttgatcgatcggatcggacggcgtgtgacgtactacgtgtgatgcgacccgacccgaccggcagtggccaccaacccccactaacgacccaagcccatttcaccgtaggttggcaaacctggaagtcctcgacaatgggattgtttagatcccctcttagaatttttcatttttttcatatcaaatatataagaaaaaaactaattatacagattacgtgtaaattatgagacaaatcttttaagtctaattgctccatgatctcacaatgtgatgtcagagtaaatatttgctaatgacggattaattagacttaataaattcgtctcgcggtttataggcgaaatttgtaatttgttttgttttcagtctacgtttaatactttaaatgtgtgtttgtatatttgatatgacacgctaaaactttttaccccgggatctaaacacaacctcagtcattctattgacttggggtagaccctgccatagtcttctattttgttttcatacaggaacggcaccatcttctaaaggttgaagacatcgtgcaagaacggcaccatctttctagaggttgaagacgtgtgagctagacccaaggctccacctgtgggttgggccaaagagaggtgcccgagtggcgggaggtagcagattgggctggggctgaaaaagaagggatgagcttccagcccaaaactaagaaagtagtataacatatactccctccgtcctaaaaaaaaaagacaaactctggtttttcgtgtccaactttgactgtccgtcttatatgaaatttttttataattcgtattttcattgttgttagatgataaaacatgattaatattttatgcgtgacttgtctttttaattttttttcatatttttttcaaataagacggacggtgaaacgttggacaaagaaaccagggtttgtctttttttggacggagggagtattgattaaaaacatattacccgttgtaacacacgggtattttttttctagtcaatatctaaaataaaacaacgtaaaaatgattttgcattagatttctatggtctctcatgaaaatgggacaactatactaatttctcaacatcttcgtggattataaaatccaaatgtcgtcgctcgctaccacatcatgaacacaataatgtcgaaattatgcagtatgtgcttgataacaaggaaaaacctagtatcgaatatttaaagagaaaatataagcgtgttatatatgaaacaaacacatgaactcgggttggcaaacctcaaaggtcctcaacttttttcctttttttttgagaacacaaagtcctctcaactatatgtatgcttttcaattacgtactccacgagacatccgaagatgtgatgcgccgaaaatgcgctcacgagtacacatgtagaaaagcaactccttctagatgctatacacacagaaacactagggacctgatttaagcaagcgtctgacaactatagtttctcataaaatctctagaagcttctcactagaagcttctcaaacaattcagattttcattcagattttaaaaagttgtagttatagaattaaaaaataaactaaaatctacaagctatatttcctaatttatatagtactcctatctcgtcagctgctttttagaattttagggcccctttgaatcaaaggattttatgtaggaatttaatatgattcaaatcctataagaattttttctgtgtgatcatttgattcaaaggattgaagctttccaaatcctatgaaattcttatggaatggttaattgcatatggattttggaggaatcttagcaagagctacaacctcttgaaaaatttcttttgagtttatttctcttatctgattcctatgtttttcctgcggtccaatcaaacggcaatttctgtgttttgcaatcatctgttttacacttgcattcctatccgaatcctatatttttttttcttatttctctatttttctaatcctacgattcaaagaggcccttagctttcccaaacgagacctcctcgtcctcgtctgcttctcagaattatttccaccgcatttccaaggctcctcgtccatgtcctcgtcttctttcttccacaccaaacgaactcgtcaactcatggtggaagcaacaagtggaggcatcggaccaaacatttcatccaacgcaaccaccacaacacgccatgcatcccatcaaaccggaaacagatcctctgacgtgaacttccctcgctaacatggtcaccgacaagtgggcccacgagcgatggggcctacatgtcagtcatgaagtcagggagggatcccaatccctccaaacctacataaatacatacctgataccaccaaccttcctcgccgcgccattgccaaccaataatctaacagttaattagccatggccgccatgctcatctcgcgacgcagcatccagctcgtcctcgtcgtcgccgccgtggtcgccatcgccggagctgtccatgctgccgcgggggagacgacggcgacgacgacgcacatcaaggtgtactggcacgacgtggtgagcgggccgagcccgacggcggtgcaggtggcgagggcagcgacgaccaactcgtcggcgagcttcttcggcgccgtggtggtgatcgacgacccgctgacgtcgggccccgacctgaacgcctcgtcgccggtgggccgcgcccagggcacctacgtcagcgccggcaaggacacggtggcgctgctcatgaacatgaacttcgtcttccagtccggcaggtacaacggcagcaccgtcgccatcatgggccgcaacgaggtcttcgccgccgtccgcgagatggccgtcgtcggcggcaccggcgtcttccggtgggcccgcggctacgcccaggcccggacccacaccctcgacatgaagaccggcgacgccaccgttgagtacaacctctacatcaaccactgaactagtcatctttctcatgagtttttttttaccttttcagaaattatggatttagttaggagttaatttttacttagcaccaaataattg

SEQ ID NO: 41965 - DNA, 7125 bp, Oryza sativa
tatggataaaaaggctggttgatgttcaacaaagactagcaattcctcatatgttgcttgctactataagaactagggtagctttggaccgtctgattataactcaatgcttggatgagatcttttgagtaatcaactgtcaataatcagaagaaattttagttgcagactgacaggggcaagtcttttaagccgttgtgtgtacttgtgtacgttttgggtctcattggacacaaaccaaccccaaccacagcttcaatgcgaatagtatagtccacctacgattagtatattctacctgaatcttccttgctcatgcttcaagtaatccatcttgtcacattacttggcaattttgacaggattctacatgactcatatgcagggccacaggaaagtaatttaggccctgcttagttcgtgaaaagaaaatttttggcgtcacattaaatgtttgatcggatgtcgaaaggggttttcaaacacgaatgaaaaaactaactttataactcgcctgaaaaccacgagacgaatcttttgagactagataagccgtcgttagcacatgtaggttactgtagcacttatagctaatcatggactaagtaggctcaaaaggttcatcttgcgatttccatacaaactgtgcaattaatttttatctatatttaatgctccatgtatgtatctaaaaatttgatgtaacattttaggaaaaaaaattgggaactacaccaggccttagtaaactgcatgcagaaaaggatcaggtgctgttttcagtgagaagtttgcatcatccaaaagatgatactactaaaaaactaccgaagttgcagcctttcaacattcatgatcatgtaaaccatgttggtatctgatccctctttgctagtagtgttatgctttgttccagcttctctagccattattcctactaggacaagtagaaggtattcaatggtccagcttccacatataaatgcatccaatccaagagacttcctttctagaagctaaaattattggagacatggagtaaacgaaaacagaagtagaagaatatggcaagagtctcccccaagtcaatagaatgactgaatgagtgatgccaattaagagaaatcctgtaccacaacaagtgcactgagaaagtaattaactttgactttggtctacgtaccactaccaagtaagtctctcgaagatattgccgtgaaatcgcaatattcagctattaagaccttgtagcttgaccagctagtaatgtagtagatgttttagttcaaacggtcgagaaattaggtacgtgattccgttaaaatccaagcaatgaaccattcttcgctgcacaataagtacaggcacaatgccaccaatagttctaaacctactaactctctttaattccgtgagagcagcaataacaacaatttagaggtaatgaaatgaaagtgacatggcggtactgatgcagtcaaatctattcagaagtaatcgtgcacccaaaataaaagtgctaagcttcaaacggttcagtcaatgcagaaatggtgtgctccaatcaggcattcattcagattataggaatttaagggtgagataaacagacatgtccataattcctacaaggtaaaattataaagtaagactatgagaattatagtttagccataaggccatatatgtttgtgcagtgatgttatatactccctttgtctcacatcatgcaacctacctgccttagggatacctcagcggttagactccaaaagatctttcagctcatcagcaattgcacgatagcagaacatgtattgtttctgaaaaacagatgtatcattagaacatccaaatggtcatacacaaaaaaaaacaaactgcacatctgcattgtacagagactctatttagtatcagatgttacataatcaaggattgatataaatttatcaatttcccttcattctgaaaataaagaaagtttttactgctatctcattaggtgtacattccatgatgtgctcagattacgctggacttgttgccttgtctgtgtattttcaaaggaagcaagtgatatgagccaaaagaaacattagcctacctcagtttggaccattccaactcgttgggttctcaaagttttgacagtttcatcaagatgatatgagcttttatcaccaaggagaagtctctcaattgtactatggatagttatgtaagcaccggttcttccaatgcccgcactgcagagatacaaaaacaatgttaaagagaataaaaagacgtgcacagagtagcattttatcaagatgaagtgaacctgcagtgtacaactataggatgctccatcggagtattttgtaaccattttcgaatttgtcttacagcatcagtattagttggaactccatgatcaggccaatcaggatattctatatggcgtacagaatgaaccctgcttgactacattatgaaaatcagtaaccagttataacttcaatccaaaatatcttctaaattaccagaagtactggtagtggctaatgcagaatatgtcatgattattgtgaatgagtgacagcaaagcaggatggaagaaaaataacttgaaagtacttgcgttgtacaaatgcagggttaggttggctgcatacgtagctcagccgaaccttcaaatagattaacagtttacatgggttaaatcagtctgtgctgggttcgaacaagctgggggagttcacagattagctggatgggttccacaggttatgtcggtttagtggtttgagaaaacaacaaatgcataactagattaccttctacggttgagatgactaagataggtgaaacctactaaagttcatgaacacaaacattatttgtctacgtcattttatgtatgacatatttttcctgtaagaagaacaaaaaaacaaagcatatataattacctcgttgcattgcaccatcacatcacgcaaccataactgatggctatctcttttggcatttgtaatcttaacattgtactttccatacgcttcacgttgcttgcgtaatggaagatattcatcacactgccacatacaacatcattaataagcaattatcaggaaatatagatgattcaaagtgcatcacataggacaaagaaaagcaatggattggagagctctgttcaagaaggatgtccttctgcatatgtgcagaatgaaggacctattaaaacagatagttttttattggttacaacctttgtaatattttaagtgctctttttgtatttattcgtttgtaaatacttttcttttaatgaaaatcacactgcgaggcaaagccctggcagtaattaaattcaaaaaaaagaagaaaagtaatggattttcatgtaaaattcagtatgtactgcatgcatatggctcttattacattatcattacctattattttagtaaacattagatatgtatgtcccactgtaaagttgcgactatagagataaatcatacattttcagcttacaaagatgccattgcaaagtgggaaaatgatgtgcaagcagctgttggcaggtactgttgccctcatgctattcccatggcagtcatcacttgccatctctggcaacgccatccagcagggggaccagatcaggccagaaggcacaaaggagaacccactggccagatcaagcataggaacattcagtcgaatccagaggggcagggaaggaggagaacagccaaatcctgaggaagtgggtgcactggaggtagggaggaggccaatgctaactggatttgttgagggggaggtggtacaggggtgcattgcagatttgcagccatgactccggcaacggggtaaatcaattttttttacccgctattttaaaaaagcataatcaagacaaccagcactaatggcgcattaaaatagtgattggcatcagttctaagtgggatccttactagcaataaccattgttcccttctctccttccaaggtgttaaggagtaccctttcactcaaaagcttaatacttgcaagagaggagtttatgacagatttatacaggtatatttggatcctgaactaagatctactttttattttttaaaaatgtttacattatatcctcaggagcaatacctattgttttctcccaaaggaattgcatttaatgatgctgtttaggttatatgattgattcaacctctcaagatatagttttatgatatgaaatcaacatcaggcatttttattactcttttaagacaaattcagctattcatactgttattctgcctgtggttcacatgtgtatgcaagactatgcatgtaagtataccagctaagcaggatctcacttgaatgtcaattcaatagaacatgctgaggagattgtttatgtaagcaagcaccttaagactgtcgaattgtgtgagcataacaataacaggacattgatattcatagaccatttcccagaaatcatcaaatgtcttggctagtggaccttgagtggaaataaattttgcaactctgttgtcctcagtgacctgcaattttcataaaccacatgtacagatgctcaattgtcccaggcactattcagaaagtgaaaaagaattgcagtatatatatatatatatacctttataaagcttgcattgatataatcattgcttgaagtctgactggtggttgatcgttttagccttaccctggtagtatcaactaaagacaagaaagggttcaacttttattaagttcacaaagtttcaaggagaccctgctggttgggcaccggtataatcaccataattacatatgcaggtgaaaaaaatctcacatggtacgacatcaatatagcggtttttctccctatttgcagcattacgagcttcattagaacttctcatcagctcgtgtctcgtgtcctgaagaaatgaccatgatatatggaatgctatcaaaatatagttattaacaggtgataagatatcctctgaggagaaaaaatcattcaataaaagtgaattgcaatcttgtgcaagaaaatttctcttagaaggaatattttttaatcagtgtgagtattaatagagtctgcccaaaaaaaaaaaccgtgagttataattgtaagtaattgctttattcacagctaatctagtagcagttatatttgaacaatatagattttcatatagttgtgattgaaatcatggaataccgaatttaagctttcttatgtgcaagtcacaaagaacacccagtccatcatatcttgcaccagttgatacggccaattggccacaataccatcttaagaaaatcaccgagatgttccttataattttatccaacaaaatttccaatgacagcttatagaattgactaatattgattccaacaacgagacattagtcgaacactggaagttctccaaacaagatgtattcacagatattattgagtctgtatctagtagatcaatgggagaaaacttttaagtttcttaaatccagaaatggcatcaaaggaccagataactttttatacatgtcaagttcaagactgacaggagtagtgatctatagcaacaacaaatgccaatcctacttttgttttactcattgatgtattatagcatagtgaacttggctgaggccactattttagctcagtttttctccttttttttcgtaattctttgctcttttccttttttttttcgagcttaccacttcatgtactgaaacttgtatcacatcacatcacatcccaatgcttcagttgaaagcaacccaatcaaagtgcttcacttcaaagcaaagcataactaaatacaccaacaaataaattatgtgaagatagggcataacccaaagtaatttggactgcacatctgtcactttgattacaattcttcatttcactcagaaaagccacttaatgctagtctgtcacagcctgtgtgtgtcagtaataatgatcagtaattttcaaacctacatgcaaaattatactcacttaacatacataacacaaaaggggatacagaacctatgaacaagcagaccaaattgcattgtaagatgcaaacagaaaatataggatcgctaaaacaggtattcaattacggaattagcctgaacaatctagtagttagccaaactagggaggaaacagcaacacattatcaatcaaacattcacatcacgacgacgaggaaatcggacgaacacagtacatacatacctggagtctcctgaactcgtcggacatggcttccggccggccacacatcccctcgaagtactcgagcgcctccctgcatagaccgacctgctcgggcgtcagcgccggcggaggcggctcgtcgaggggcgcctgggacgacgacgacgacgactgcgccgcgcggcgagggacaccggcgaagcgggcggcggccatcgccctgccgcgggagctcgtgccgttccccgtggccgccgcggtgggagcgtactggccggaggcgggaggagaggggctcgccggaatcgccgccgccgccgctgcggtggtggcggaagcgatggagacgaggggtattaagacacggtgattatgtagagagagaatatatccttttttttttaaggagagagaatatatcctagcaaccagcaaatgtcacggaaaattatagacatttacttctaatagtattaaacatatatgcaaagtctcatatacaaattttttatattttagcctaaaaagtttaaaaaatatgacaattttaagagtaaaaatttgttagaattttgtctttttaggttaaaatgtaataaatttgaagataagatttttaaatgtaggtgtaatactgttggacgtatgtgtctaattttttataacttttactagttggtatacacagagtgtgtatgagaaacttgtgtacataattatgggtgtgttcggacaccccttttcccaaccccccttccttattttccatgcgcacacttttcaaactgctaaacagtgcaatttttgcaaaaagtttctatacgaaagttgcttaaaaaatcaaattaatctatttttgaaaaaaatatatat

SEQ ID NO: 41966 - DNA, 1319 bp, Oryza sativa
tatgaggcggccggtgatagcggatccggtagcgaggagccactggagatggggaagacggcggggccaggcggtggtgctgtgtgggggcgactgtgacagaggaggtggggggatcgtgagctttccatggcaacggtgatacgcacaggagggggagggagtgggaacgaggaagcaggagaagctagggttaagtgtgatgcacgaatcttaaaaatactaaatggatccttttcgcggcgccaacatcattggcgccgtggttcaacatgactgagccaaagacattggcatcgttcccctagtctcctggagaagctaagtcacttatatgatggggaatgacgccaatgataggacctatttgtaatttttttctaaaaagaacctatttgtgataaaaaaaacttatttgtaataaaaaatatttacaaataagtcctcgacaccaataatactagtattaaagagcggtttgtaaataatttttattataaataagtcatttttcaaaaaaaaatacgaataagtcctcgatgccaatgtcatcaaaacaggcctaagtagacgggatatatgatccctttgttacttgtatattattatgctactgaataaaatttacatgcgagttctcttttctaaggaatggaactattccatagaacgagaatagttagtccatttgtttgtaccatcgattatttattcaagaaaaaaaaagacccttaagaatagttgattattctaggactagaactaagagttgtttaattgatcttgatcaagaaaaaaaaatagtgatacacgcttcgatgaaaataaaaacatgagaattagcaattatcaggagaaaatagtgcacgaaaagaacaagagatcacgcatttaaagtactaacagaatatataacaaagatccaaagtaatattgttttttgttactatcttactaatactgctatatagtttcacaggataaatttaaaaaggtcgtaaaattatccgagtaattccagtaacatatatacacaccatcactgttgttccaggacggctgcctagctgcaagtttgagtgcatgttaatctgtcatcatctcaattcttaactaatccgtctccttcaaattcacagcccagctttctgctgaacattctgctttcacaactgatgctaatccaggctcaatgttactaccataatccatattgctgaaaatacagttcatgtcaacatgagtgtccatgtcatagagcaggtattgtgcttcatcctcctcatcttcctttgtgtcaaacaaaccactccacattt

SEQ ID NO: 41967 - DNA, 1524 bp, Oryza sativa
ataacttgtaagttgaatatctgaaattcataaatactactagtaaactgaaattctgaaagaagaaatgaaaagcatagaaacacaaggaaatgagagtgaccttgatgttaggcctcaaatggttgaaccatctttctctgcattgctttcctactcttccaggcagcatcccccctatcagagaccacttcttcagtccaaattgttccactaatttcaccagcttcctatcaaaatttggaagaactcaatttactcatcactggcagagtacagttgtacagagagcaaaacttgtgatttctagttactgtggacagtaccattacaaagcatagtagtacttgacagaatcacagagaattcatccaacttacagttttaactttcaaattacagtgcacaaaaacattatcaagtatgctactacttgacagaatcacaaagagttcatccaccttacgatttcaaattacagtggacaagagcattacaaagttaacttggtatagaaaaaaacaaaaaagaaattcatctttcttttacctgtcttcttccactgtccagtggcctttgacagcatcagccttcttgatacctttccttgacgccttgtttcttgaaatcaacctgccattcatctcatacgcaccaaatgctccaacttgaacatctcttacaagatgagaaacctcagtcttggggttcaacagaaagatcgacgaagcattgtcgatgaaatccttcctacttcctcttctgaagaactcatgatcaagatcatgaagagttgcaaaaggaagcacagatccaccttcaagttcagacccatgaacagtgatgccttcagcttcaaatggatgatcaagatcagcatgatgatggagctcatcttgcagcagaaaggaatcaaatggaatgccatgagagattgctggttggggattgaagcagctgaaatccatggtgagattttcagaatctgaataggagatatcgagtaatgtctcctgaatctctgagaggagatatagcatttggtaataaaatctaagcaacaacttagtagtgcccttaaactggggtggccagagataaatggcaggttaatgcaagttaatggatctcatttactgtcattaaccgagaaaacctcatgcatgaggagggaattaaggctccaatgctccctgcgagtctccaagactgcaaacatgcttgctatacagtcgtgcacgtacatagcgtagacacacgttttcagaaatgcaaccaaaacattcacatagaaattaacttttcagtttataggccatggccaaaatttaaaatttaaatcttatgtttatagttcattttgatttttgtattatagtttttttttcaacattgacttttaagtcgttatgacacatataaaagttttacatataaactatttcctggacgctaatgatgtatgtgaaataataggacagcatatggattgagatagctaccatgcccccgttcgttctccat

SEQ ID NO: 41968 - DNA, 5933 bp, Oryza sativa
tattacgtacgttaattaatttccaaatatgttttaatattttgagtaattctcttttagtcctgtctaatacacatacacgcacgcgtaaatggttcttaatattcaaaataaaggaagaaaacataagagcatctcccttattttgaagtccctagctacaagttggggctgcccctatttcccaaggaaaaaaaaaacctccaactccagtagtagccagtagcccctatttcttagcctctattcatgtttctcttgtattttaaaatacacaatctatgtttacactatgtttaacaccacaataattcaaatataaatatttctaacacgtataatttaaccatacttcaattcaaaatttcaaagtatacaattcaaattcaacatcaaaattttcaaacatgtaaatatggtgcggacacaatgccatatactcatttttcaaacatgtaaaaaattttggagcaagagatgcaataaaattaaaatatactagtagcaaatgccaaatgctcatatactgtacactgctgccgcttcttttatgcatcagttcagtaaaaagaccttgttttccagtttttagaatattgagttattgatccaacctgtcactaactgatgcaattatcgatgagtaatgcacatcagcaatagaaggttgatttctgcaaattaatgattaaattacaagattcataaccatgaaaaggggcagaaggaagtggagcagcgatgtgcaaagtacatgatctggacgagcgacagtgtgggacgttgatcgccggagttgatgcgtgcaaggttgacgacggcttacgcgaaaaagaagaatggtggcgacggcacagccaaggcacgagagagacgagagaggtgcgcgctcgggattttccaccgatccaaaaaaaaaaaaaaggagagataggggttgggtctagagtccccaggattgagggctagggggagaaatttgggagccttcctattttggggcctttaataggggctctgctagaactttatttttctcccttcacctcaaaaactatttgggggcttaatttaggtgctctgctgaagatgctcggtattcaaaataagggctgcctaaccaacattcgatctaaaattcattcaaatgtaaccatggcacaattattacagctcagtggtgatggagacgtgtctacctgcacatcgcgtattcaaccccataccctgcacaagatcgattttcattttccaatccaacccgaattaaattaagcgtgtctaatgggaaaaaatagaaatatttatcccttgattttctatccacaaccctaacaaaaccgtccagaagaatatatattcatgcacacacacacccgatggtatgaatatagatgaggagcatggttaatttcaaagttgtactgtacggcaattctattttattattcatttctgaatgcatgcataaatattttaaaagcgatgtaatttctcagagaatattcagatattatttatttcgactggaggaagatcaatcaagcacactacatgcatatataagggcagagttttccgtagtgcaagttcattatatgggctgatcggaactgctagttgatgcagccgctatggttgtgactgtttttcagctgctagctgtcgctacagccattttttttgctcttgcagcctcagcagcgagcactgccgattacatccatagttgtgtctgattcgagctctagttaagatcttcgactcaaacaattagtacaactagacaggagtattaccttatttatttttttctaacttttcaacaaaatccatgtataacgtatactcccatttgcatactgtgcatatatcttatcgtatttatagtgacaattaatgttcctctacacattattttttctatattacatcaagtctaatttattattttttacatataccagggacaaaaatagtaacaagattacacataaggatggcacggcaaatacacgatattcaaatggcacaaagccaaatatcattgcatgcaggccggggcagatcgatatataccgtccaatgactctacccaatgaccatctgaactaataatagattcataataaaatttaaatggttttcaacgaaataaaatacaacttttacacaaaacactcgatataataagatttattaaagctctaaaactttttggacttgccattgatcgcatgcattgagacttttcaaaaggaaggtgacacgtactacgcgtagctacatggctttacctacctagctacttactcatcgatgatcagtcatcaccagctaccactgcaagacgtcgtggtgtggtcagcacttaaattttagcagccaagtcgtcaggtccatgaagcatgcaacattttagttcggtcttctagaaggtagacaaacatgtggttgttgttctagtgaccttttgtgatccttttcgactttagtagtaactgatttttttccagtctctgtcccaaaaccttttgcaacaaaaatggttattaactgacttggagagatttggattcatctgattaattaatttgtgcaattgctgcttattctttctttgttgttttttcaaaagttatttggccctttggaatggtcatgcatggaaaatttcttgtggaagatgatccacatatatcaatatatcatatccatatctatcagtacatatcaagaaaattacatgtagaggagtgttaattctatgatctcatcctacaacaagttgtataaccatcattcactgaagggtaagtagcatatggtcagccaccattgaatcatctcataatttatgcaaaccacttgggggagacacaactgcttaataaaacagttcctctatcaaatatttgtccattatttgaccacttcgctttgaaaaatatagaaattaatatattcatgtaaaaccgtcaaggatatataacactacttgatacatgtggtgagcaaaccccgccgggttgctaccggtgctactaaacttgaaaaagttatcggacattctataaggaatcctacatctatatatatgataaaatttcatatccaaagcaaattttatttcatatccaaatttgatatgatgcatagaacaagttataaaaataaaaataaaacatctatatatatatgaacttaggatttcaacttgggctatgaatagactggcttttttttttcatcatgtatttcaggtttggaattgagatcttgtgccatggcgtaattcaagcttcttacatattttgtcgatattatgaaaaagcctttacgacttctgtgaaacgcatgaatattacatgaatatatcgtagaaattagttcagttccttcatgtaggatcttcatgtaggatcgtaaagggcctttcccaccccaaaagctagaaatttagttcagttcctttatgtaggatcgtaaatggtctttcccaccccaaaagctagccacttatatcttaggtcatttgccattccacaaccaatgtgggactattcaacacttcaaaattcgcacaaaatttgtttgtccaaaggaggacgccttagaagagtatatcttttttttttttggcttagggcacccgtagcacccaagatatatattcttctgctacttgagaccaccatgcaacaagctagcacaacttgttagtgctgatgatcatcgaaaagtgggcatcttcttcgtgtgttcctcaagcactgatgtcaacgtttgacaatgatatactagtatgtagtatgtatgtatcttggtcagtagaacatgcatctacgtatttgtgtacgtatgcgtgacacagcaatcagccaatggcaagctcttctctcccaatcgaatatgccatgcatgagatctgcatcacctactcattatacagattaaatcaatacacatttcgtgttgtgttaacttaattaattggacaggattaaatacatttcactatgttaatttgattcggtattgagaatattcaattcggaaaacgcgagctcgagtaaggtaataatatattgtaatgagtgtgtaggtagatgacaattaattacagctgagtagataatactgtactcagtatatatagtgccaaatggaggatgggcattggtagatataccacctaattagctgcttaccaaacctaatattatgcttaattatttagttagaggataattagcagccactctaagtgtgcggtcatgtagtgatttatatgtgcatgttgggttttctagaagacctacctaccagactaggattgaacagcatctctccatttggcaaatctatatgccaattatttgagtaccttcttacccaatgatagctcaagagatatttttctatactagatatgaagattagcatgtgtcagatcaacatatgtttttatctgtttaattatggtttatacatatgataattataattaagtttgtcctattggatgagaagcacctttcgtgcaggctaagctagctcaacctaatacctgggcagtaggaatctgaatgtacttaatttggaaacaaaacaatacaacttaggctgtgaattaaagaaaagggtaaacgcagttgacgagagctacgatcaggaattatccagtctagtaattgtcttttcttcatatagacatagatatataattaagcaagcatatgcatattagtttggaagtatcttgattgcccaatttttttacaaaagaaatatatatgtactgccaaattaaacaacacattaagttcaagattttaattagtcctctcttgtacaacacaatctcgataattctcgatcacatttgtggagaagaacaaaatatatttcagttgaaaaaaatgatttggactaattaaagacaggttaatttggagttgaagtccggtcagctggcatggccgcacgctggaaattaaggctaggaaacacaaaaatggaaacgtacgtaggaaaatagaacacaagaatacacgtgtaaaacaaagaaatgaaaaattgaggaaaattgtacatagagtggtcaaaggatttggtctagcagcagctgccactacgtactagaaaaaacattttcgtagacgtggggtttttttttcccaagcaggtatggtcctcggagccaaatggccgtctacgataatgtaaacctcggtggagcttgccgtccacttgcgaagatcaattttttccaagcggaccacttaagaggttcacctgcgaaaataactttattttcgcaggcgggcctctcaaggcgtccgcgtagaaaaatatgattttcgcaagcggaaccttatgtggtctgcctgcaaaaatcatacctgcagaaaaaatatctaagttccatccttatcttctccttcacccatccttaacctctccatcactcatttcccctccccctcctctctctctctgtctcattccttcccggtagacggcgggtcgtgcgacatcctccctctcccggcgatggcaacggctcagtgacgaggaggtcgcgacaatgatgacaacgccttctggatccgctgccggctcgccccgggcacacggatccaccgccgaccggtcgcgggcgcacggatccgccaccggctagactcggggaggggaggggaggtggcggcgacaaggaggtgaggggaggggaggggatgtggcggctcgactcctccctctcctggcgacgggaacgactcagcgacgaggaggtctcgacgacaacgacgacacctcctggatccaccgccggctcgccacgggcgcgtggatccactgccagccagtcttagggaggggagggaaggtggcggcgacgaggaggtaaggggaggggaggggagggg

SEQ ID NO: 41969 - DNA, 858 bp, Oryza sativa
aacaacgtcttggcgacgagggggggaggtggctgtggcgctccaacccatctccctcccttcctcctagatccatccgccggcggcgggtatgagtggtggcgacgatttttttttgtgcgcttaaattattttcgcaggcgggccgctaggctgcctgtaaaaatcatctattttcgtaggtctttgtttacatgtggccctttccccggtctgagaaaactatttttggccgcttaggaaaacgattttcctattagtgtgcttcagcatgagcttgtgcaaaggtctggtttcccgtgaaattggagaagtgcagaaaggaatcaaagtctgaatgctatttaccaaatcctttgttccaaacgtttgaacagttattgcaaaaaaaaaaaagttgaacagtgaaaattttccttactaagttgaatcccttgaaatttctttggaatttcgtcaaatccaaacatggcctaattattaaaaggcagccaaggaatgcgaaacgtttgtatcacattgatgaagtttttttttaataaaattagtgcaaaatgatttgattttcactaaactttttttgttaattttttgggacattttgtcatattcattgttatagctgtgttcacaagtttactttctcatttataaacttaattctgcattattgtagaaaggctagattgattttcatatttaagaaaggttaggggcaatacatattgattttcatatttaaccagacacatatgtatatgtactattaactactagctagctttcatgtgatgcaatatatatgtccccctattatcttataattaactatatacaggtcctttcgtgatcatgggg

SEQ ID NO: 41970 - DNA, 864 bp, Oryza sativa
  unsure (1)..(864): unsure at all n locations
tgcacccctcttatttcgtgagttaataaatctttttcccttgatcccataaatcaattctctattccgaaatttcatgaatcattttccttataaatcatttcctttggtcccgcacgtcagagacggtcaataatattcttgagaatattatttctataaatttcatgaatcaatctcccctggttccacaaatatcttccttcgccagaaattccaattaaacttccaaaattcgtatctctcgatccaatcgtccgattgaccccgttccacttccagtatttccataaaatcgagatctatttaatggcactattatttagtctaaatagggtctttttcttggtctcttgtttaggtttttgtttgtttgcgcatagttgcggttaccggattttcgtcgatcgtggatttctcgaagattcgtgaagctcagtgaagaccttgagcaaggcaagccacctttgaacatattgagcctatatttgaacttaattaatttgcttgcaaaatattatgcattgataggattgcacttaatctgtttgccccgtctgcaaggcagaccggtgggcctacccaacttgttgcactgatccttccattgttaattgttatatcatgttcccttgtaaccatctagttgcgcctcgatattcatgcactctgtgcgagtatcgacggtcgccttcaaacttaaaatctgagtaacttcttgggtaaaacttggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41971 - DNA, 1083 bp, Oryza sativa
ccaacaagttcctcttatttctctgcagctacctgagctcatcaccacaagaaaccggatggcaagctgccggcggcgagcgcccatcgcctcgcccgtccccccgcgccactgcccacggcgcgtccccgcgcaccgccgcccaccgcccgtccgcagccgcgtgcatgggagagagagagagcgcgcgaccgaggagagggagaccgggaaggaagagagatgaaatgtgggcccaagaagtctttttctgactagattgccgcgttggcgccacgtgtacaagctcaagtcaaaaccgctcaaaatagtatcgatgggggtaattcatccggtattaaaagtttagggtgcgttatgtctggtttcgggttcagaaggtaattcagccaaccgtgatagttcagggtaatccatactttttccttgtatttatgtataaacttagtcttgaagtaattttacttttatcataatctggtggtagtagatattgctgcattttgtgagtggtgacatctgcatttgactgcatgttgaacgaattgtgttgttgctgtgcagaatgtgatgtgaagcacgtaggtgcgtgaactgtcaaaggtgtaacttaattcgtcaaatttgattgctgattttgaattgacaatggtagttcgtgtttttctttaaggtgatggaataaatggtttacgtctctgacatataccgacaggcacatatccaataagttttgttgttggaagaaaaaaaaggcaacacagggtgatgccgatttggatcaaataaactacggagttgctagaaatatggcgccatatgctacagtcgattttttttcagccacttacacagtagttacacctcatttacaacccacttacatatgtaattagtatgtaattttcgaatttacatatgtaattttagtacttacatatgtaattttgagacttacattgtaaatacactaaaattacatatgtaatttagggacttacaatgtaaatacataccgactattctttgatgaaaaatatggcgccataaatatagctacacccatcaaacggttctcattgt

SEQ ID NO: 41972 - DNA, 10014 bp, Oryza sativa
tcctgcagcccaccatggcgggaggttaaagttcgcaatgagaactggccaagtgctgtgagaactactcatgtctctgaaaggattcatgccatctgtacacaaacatatcctcatgtttctggggtcggcagcaaagtctttgtgctttcgatcgatattcctccattgaatcgaatccgcagggtgtcttagcaaaccgtcattccttctctctgtggcatgccaacgtactaactttgcttcattggggttggcaaatattctcttgaaacgatcaatgattggtagataccacacaaccttcgccggaccaccccgctttaacttctttccctcgcctgcgctcttctttcgcttgtatcgagaagccttgcagacaggacaagcatctaagtccgcgtattgcttgtggtacaatatgcaatatgtcgtctcgggcaatgtgttctcctaagtaaggaagcatgtccttcagtattcccaaaagttctgtaaaactcgtctgaccatccactactagccttcaacttcattaggtctaatgttgctgataatttggtgtgctttggcttgcatcctgcgtatagaggagtctccgagtcactgaccaacctgctgaacttcatggaatctctctcattcatagctgggtcatcaacgtcacgtaacatgtcttgcagcatatcacggtccacatcaaccatttcaccgcccaatggagatgggacaaacatgtcatgctcttcttcatctccttcttcatgactgtctgcaccacttccgtctgcagctgcaccatcagtacccagatcttgctctccatgcatcacccaacatgtgtatctctccatgaatccccggcgtatcaagtgagcgtgtacttccttttcatcttcccacaaaatctctttcctgcaatcgctacatggacaacacatgtacttgtcgtttcttcttatcctatcctcctctgcggctttcataaaacttaatacgccatctctatactctttgtactgacacctcaagccagtcgtgtacatccaacttcgatccatcactgaacaatgaacaaaatattagttaacatctcataacataagtactactaaattaataggaaatgtttagtactcttttacttacttttatgattttcctgtttttgtttgcaaaaaaattacaaaaattcgcccccttaaacctcccaccaaaatagtgaagagtgggataaactacagacaacggactgctggagtatatatagtgtgcaaagtatatctcaatcgggccaaaaaaaaatgtcatctctaacgggcgcacactaatctctaacgggcataaatagaagcccgacacctataagagtcatcggtgacgggctataggaatatgcatcccgacgagtacatatacaatggcaaaaatttaggcccgattgagatgacttcgttctgacggcccacgttgtccaggcatgtgatgggccgtcacagatgagaggatctgtactagtgatataacaatatgtgtttctaataaatagttttttttcattgttttattcatgatcctacttgcttgagagagaaaggacagtggaaggtcgaactagagggacaatataggctcttgtcaataaattcaataaacccataattaattttgataatccatgcatgtcatatgatatatattccaaaggaaatctcgctttctttgggagagtcccttgaatccatgtgtcgacttacttccaaattagatttgtgacatagacctccaaacgaccacacaacgaaattaatttaataggaccaattcatgattaattctcatgtgcccaagcgtacctgctgccaatcattaagttgaaattcataaatttcttcctagctagtgctgtacatgcatatatgcacatgtagcgacagtaacatgcacgataatatgctatatttagttagcacaggagtgtactttatataaatttgtgctttgctaaaagttgatcaagatgactaattaatcaccagtgtgatgcacatattcgttctagacacatggttagggtagttcattacgtacagtttaaaaaatgtatctcccttattatcatgcaccacatcttaaggcctcgtaagtataaaccatattacaggtgattagtcatttcaaatgggtcggcattcttcatgaaccgttatagatcgatgatttgcatcatctacatgatgggtctatgttccaaaatcattatatagatcgctagtacaaaaatcatttttcaagacagccaaaaccggtttctacatgtagctagacggcccgcctgcacctaggtgtatgtgaaaattaatattgttccatgcgggcagcctaatcacatgaaaaacaggattttcgcatgcggtcacctataccgaccgcgtgaaaaaaaataattttggtggaaaaaaataaaaatcccaaaaaaacaccgaaaccctagcttgtcatcgtcgtcagaactgccactaacgtcgtcaccgccattgccaccgtcgtcatgcctgcttgctcccgcctcctaatcccaccgccgctattcctgaggatggaggctgtcaaatctgcatgccggtgttgctccagagggcaatgacggcggatccgctcgctggcgtcgctcccaccacgagctccctactgctgccgtcgtcaccgtcgcctacctgagtcatggctagtggtcacctggtaactggagccctgctccatgcctcgccgctcccttgctgcgtcctgctcatggggaaccgtcgagtttgctcgccgctccccatggctgtctcgcacccgggacagctggtgctcttgatgctgggctggatttggaggaagtgggagagaggggggggggaaatgagcggggagagaaagaggaggttgtggagaaatgagaggtgagagagagaaggtaggagataaggataaagacttgaaaaattttgaagatgctaagagaaaagagaggagggaggtcagacttttaagaagtccgtttgcgaagttgtacttccgtatgcggtcatttaagaggcctacctgggaaaataagactattttcctaagcaggtctcttaagtggccgcatgccttgaactgatcatgatggagcgatttttgcaggcgggagcagttatggtccacatgcaatctaaaggggatatcatccagaaaaaatcaattctgtagtagtggataaccataatttggttgtatcccagactctagggtacatggctcctcttgatagaagactcggtcgtcttctcagctcctatctttcacccccttatcctctccacctcaatcgagagagtggagaccacacaaaggtgcgatgacacgagggccaggtggttcatccgtccgatgatgcaaggctcgacataaggcccaacaagaagctcgggtcctccacgtagctcgcaatagtgtgagcctctcgacaacatgatgaggggacacaggatgctagagacaccagatccagttgccctaactctgggtaggtgaatctagtgcctcccctccaggcttttggcgacacatctttctcgctctacaaaggacgaccggtgcctccccctccacctcctaagcaccatcaccgccacccccctgtggagctcatgctccctctagatacgatcgcagtagcctcgaggggtgtcagatcttccccaagatcagggtcacctgatctaactacccatgacctcacgacgcctggatctagctaggtggctcaacggcttcccctctttgtgagtaatcctttgtgactgagacgggtatggtgataggcacaaggaggtggagtagcagcatgaagcagtgcgacgacgatgagaaccatctcccatccagatttatccacccaaccaaacacaccctaagttgttgttccctgtacctgagttggatgctcaatggctcagttttttttggaggtggaatgaaatagcgtggtagaaggcacttgaggggtcggtcgtggatgcactgtagccgtttcgcctctccgtggcaatggctacttggacgaggcgggtgacgattgacgacaaccatgacgagcactggtcccgtgcaagttatttaattattatatttgtttttactacattttggctgtgtttagatccaaagtttggatccaaacttcagtcattttccatcacatcaacctgtcatacacacacaacttttcagtcacatcatctttaatttcaaccaaaatccaaactttgcgctgaactaaacacaaccttcgatggttcaatagatatgaacagtcagagatgcgactagtcatcatcagtacgtgatcaattgactgcaacgggtgactgaaccgtcatgttcttgttggactgtaacttacacagatgaccatttctctagtggagtaattggtactagtatcttgcacttgagactgctctaatttcaagtacatattgtgtcgacattcatcttactaattaacatcccttgtggtctgcttccctgtatatcaccccatttttctcgaggtcaattctctgtcattccatgtatgcatatattgccgcagactcaggaggagccagtacacagggtacatgcatgcatgcatgatcattaaattgtaccttatgatatgtccatttcagatggacgtgcagtacttgactgtgttaggttcaacatgaacatttactgtgcatgcatgcagctattagtagcttaatttaattagtggcgggagctgatcaaatgtgtgatgtggaatgccgtcgatacattgccgttgtcggcaacatgccaattcatgcctgcctgcctgcaatgcatccagctaattagctaactggcagtgaagtgcatgaacttgctgactagctagcacaacttaggactatagcctaataaatttagaatggattttaagaacgatatattttagattggtttttagttatcatcttaattagcaacgatcatgaaaagagtttgcgatgaatgcgaccaagaaaatccggccctgtaaattaattataaaatcaaaatttagaatttaattaaaatcagcttcaaattattcttttttgtttgttctttagggtgatatcgatacaatttttaatgcatatatttgattgtttgtattcacatgaagcactaagaaacaacatggaaatatgtttcatgacgtacataataccatattttcactcataaaggttacatgccgacgacgtacgtcgttttgtatgaaaactatgaactaataactcaattgatggagtattccattatcgaaaaaaaaatcaattgatggacattaagaactgattcaatttgatagctttccatgcaccgaaacctaataaacacttaaatacattgtatgccgtcatcgtctcatatatagatggctcatttcgccttcgaattgagaagctagttgccaagaaattaattaacctgtgcgcagtggtgattttgctacgtgttacatggtgcggacactggtggagaaaccatctttcgtcggtcggccgatttccacaatagtcccggatgcaataaaaaccagggttaaagatgatctttagtcccggttcaaaagggtaacgggcatatttgatctttagtcctggttggtaacaccaaccgggactaaagatcatctttagtcccggttcgaatgctgttagggcatgttaggcccccccgggatctttagtcccggtccgggactaaagatcgtaactttagccctagttggtattaccaaccggggctaaagatcctggtgatctttagccccggttggtgctactaaccgggacaaaagtcccacccctatatatatgtcttcttcctcctccagctgcccgagcaagcttcaaaatttcttcaaaaaagaggggaggtcatgccaaaaattctattgaatttattttggtgattacatacaaatcggaggtgcctaaaaggtttgcaacttattcctccaatgttttttttgtcatactacatttgcacctatgtttttcacacttttttttgtctccaaaatttaattgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttaaaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcatgcagtattttttgagagtggccgaagcgaacaggcaaaggggttttatttgttgtccatgcaataagtgtaagaatcagaaggagtattctacatccaggattattcatttccacttgtttgagtcggggttcatgccaagctataattgttggacatcccacggagagcaaggtgttgaaatggaagaagatgaagtggaagacgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggatcacagaatttcgttgtatccaggctgcgagcaggggcacaaaaagttggataccattctggagttcttgcaatggaaggcaaaaattggggttagtgacaaggcatttggcgatttattgaaactcatcaagaaaattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccacggctaaggcctttgttcaggaacaaggggaatgctagaatgttgcgatggcacgctgaagagtgtcaacaggacgggatgctgagacaccccgccgatggtttgcagtggcgaaacatcgacagaaaatttaaagaatttggaaaggacgcacgaaacatacggtttggtttgagtacggatggcatgaatccttttggagagatgagcagcggccatagcacttggcctgttacgatgtgtatctacaacctcccccctggctatgcatgaagaggaagtacataatgatgccgattattattcaaggccccaagcaacctggtaacgacatcgatgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcttggaagccagcctatagagagcgaagatggtcacgcggcgatgtggaaaaagaactctatattttgggagttaccatattgggaattcttggacgtacgctcatgactgtcacgtgttgatgacacaactgctaacagctgtaataaggggtatccttccagacaatgtccgggcaacaataacaaagctatgtgcattcatgaacgcaatttcgtagaaggtcatcgatccggatagattagaagcccttcagaatgaagtggtgcaatgtctcgtcagttttgagttgatatttccaccttcatttttcaatataatgacgcatctgctttgtcaccttgtgaaagagatctgtattctcgggcctgtgtacctacacaacatgtttcctttcgagaggtacatgggcgttctgaagaagtatgttcgtaaccatgctcgtccagaggcaagcatcgccaagggttatgaaacagaggaggtcatcgaattttgcgtagaatttatcgaaaaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttgcatcgaggagcacttggctctagttcgcgccaggaacatcggtaagtccgatgcatggattacacggcatcagattgatactttccccacgtggctacgacaacatctcatgggtaacgagtcgatcaaccaacaacttgccttcctggcgaggggaccgtctgggtcaatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggatatatgggaacttgactatggtcctctcaaggttcctctgttccggtgccaatgggttaggttgactggtggaggcgtaatgattgatgacagtggtatgacaactgttgaccttaacaagattggatactcggacgaaccttttgtccttgccaatgatgtaacgcaagtctttttcgtgaaggacatgtctagcaaaggaaagaagggcagagggcctgacgagcctaagcgccaagtggttctcccaggcaaaagaaaaatcatcggagttgaggacaagactgacgaggattacgatcagttggatgggcaaccccctttcacggtgacgattgaccctagcatcctcctatcaaatgaagacaccccttactcatgcagcgatcacaaggagggaacaatagtgaggagaaagtacgtgcggtcaaccgtcaccgccaatgtaatgccgtaattattgtgtacacgatgtaaactattttggatgtattgattatccatataaatcaattgatgtatggcataatttactatcattcatatgctaattagagtttttcacaatttaatttactatctttcatatgctacttatatatgactattcgaatttttaaaaggtttaaatcatgcatgtggcatttacatatgttaattagactttttaacatttaatttaatataattcctacgctaagtatatatgaagattacaatttttattaattttaaatcatgcagtatgtacatacatatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatgcattaacttctattttagaaacacatatgtaagcgaaaataatatgcagtgctataatcttt

SEQ ID NO: 41973 - DNA, 26302 bp, Oryza sativa
  unsure (1)..(26302): unsure at all n locations
gacgccgcgccacgcctacgccacgccacgcagccgctggcacgccacgccacctacttcgccgccgcgcgcgcaacgccaccgccgccacgccatgccgccatcttcgccgccgcgcaatgccgccgccgcatgcaacaccgcgctgccaccgccgttgccaagccgccaccgccgccgccgccgccgtcaccaccacgccgccatgccaagcgccggcccgatgccgtcacaccgccgttaacgaacacatgaacgagaacgaacacgtcaacgtacgttgccgcgagaacgtgaacgagaacgagaacgatcgaacgaacgagagcgacaacgagaacgatcgaacgaattaacgtgaacgagaatgacaacgaacgtgaacgagaacgaacgtgaatgagaacgagcgaacgaacgtgaatgtgaaatgcaatatatatatgttactttgcatttatcctaatacatattttttgtatcttgcagaaaagacgtgttgtcggagtcgtccctcaagctggagtggaagagctagccctagaaggaattcgtgcaggcaagtgacgtaataatataaatgattgttatatttgtaatgcaattaagaatattagacttgtaattatacttagcatataagattgtgtagtgttctaatattatttgagttttaatataagattattttattgcaaattagacttagtatgtaatttttgactacggaattggtgcgactcctagcaattgactattgtagtcttaattagacttagcatatacgcatgaaacacttagcatacatgactattttagtcttagcatgtaatattatttgagttttaatataagattattttatttgtaattagacttagtatataattattgactacggaattggtgcgactcctagcaatttacaattttagtcttaattagacttagcatatacgacagttacacttagtatacatgactctttcagtcttagcatgtaatattatttgagttttaatataagattactttatttgtaattagaattagtatgtaattattgagtacggaattggtgcgactcctagcaattgactattgtagtcttaattagacttagcatatacgcacggaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttaaattgttaaaacataaatgtctcgtgacttaccagatgtttctagtatcaacagatggctgaccgcgatgaggaacagatattatacaatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctctgttggacagaagagggcacgcgggcaacgaggtgcagcgaagaagcttgagggtcggcacatcataacggaagtggaagaagatggacgtcctagtgccccggccgaagccacgaagaactatgtacgtcacagcggttgggttgtgcgggataacgtgcctgtcagtacggtgtactggcgaagaccannngcatgtggagatcatgagagctttgtcccagattggagaaagagatgctgtggaccacaatgctcgagacattcacccttcccgcgggtacagaggacaaagtgataaggtggactctgaagaaaatggcagaacagtttcagagcttcaagggagagctgtacaagaaatatatcctgaaggggcagacaccgaactttgacacattcccaaagctaaggggatcactgggacgagttcgttgcatataagacaggtgaacaagggtaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaacaggcaaccgccaattggccggaacgatcgaagttctggtactatgctcacggtggaacgctcaacccagctgatggctcactggtcttcggtgatcagatacgagaggctgcacgacgactaacagatgcagtggaagcctcctctcagggcacgttccgaccggacagagatagggacgagctgacactcgccctgcagactccagagcattcaggacgaacacgagggaaaggggtgattccttggaagattggtttcaaggaggacatccacacgtacaggagtcggatgaggagtaagagagataccgaggcgaagattgcagatctagagttccgggtatcgagctacgaactcagcatgcaagaggagggggcaaggaaggttgatgaacgcatggccgcacatcggtcccatgatccccagccgaccattcctcctgcaatggtgagcccgttaggaaaccgtagcagctgcgcctcaacggggcaggtaagatcacagagcatggacgccatgcaaacacaggacgaatcgacctgtctcgttgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggcgtcgggcatggccatcctaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctctggctccgccatctcctcctcaggatcctgcaccgtctcctcctcatgatctgccagcaccgactcctcctcaggatcctgcaccgactcctcctcgggcctctacacctactcctccgcaagctcctcttccggcaccttcaaagtcaagggcccccccagctccaccgcctgcccacacaagggaaaccaagaaggcgaaagttgacgccgccaagaacaaggacccggggtacgattgcacgcaagaggagcttgacgcttacgttgcatcagaagtcaagagacaattcaagcctcgaagtccagaaaagaagattcttatagaccccagtgtcaggaacttctttaggggtatgtctgcatctgtcaaggaggccatcaatctatcggactatgagcgaacgctgaagaaagcatcttctggaaagtccaaaccagtccctcagcttggagagcaaccaaaccaggagatcgagccgttggtgactggtaaagaaatgacgatagaacaatttattactgacaccggtctaactacggatcaattgctaggagtcgcaccaatcgaaaaggcggaagagaaatacatgtatgaactcggtaaaccgcttgtcaagcttgagctgctgcagtccctacccacacaaatgtacaagttccatcagctgtacatggagatgagcgccaccggtagagagatgatcggagcgaggatcagggacacggagttcttgcaaggagatgacattctctggatcaatttcaagggaatctatgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggtggagggtttttgatactggattcatcgacactcggagagtaaacgtcgcaatgctcgaccaatatccacaagaaacaaaggacaatctcgtccatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattacagattccactgggtgcttttactcttcgacctgtcggcctgcaccgtcaacgtatatgactcaatgaataaaaaagagtctacgtttgacaaggttttcgaacctatagacaggtaccgtcataagttcctctgttaattaagaaaatcttgttatgttaattgctactacaaatcatagctttaaactccatgtagggcttggtatcggttccgtcatttggtccacggcaaatggagagaaagacttaggcggaagttcaaatttcctgtgagtacacatgctctacatttatatttctccgattcaaatacatacaagtgtatattaattagatctctcgttgtttggcatttatttgtagtgcgcaaagcaaaagcagggaactaacttgtgcggctattacgtgtgtgagtattgccactgccttgcagaccaaatcaacaccacaagagagctcgatgtaagtacaaataaattcaaaattttattacgtaacgatttcttgtttaattactaatcaatttcatacattcatatagtttattcgcacgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatacacacatatgcatttgcataacatatatattatgtataaatacatatatattatgcatgtacatatgtactgaactatttatacatatatatatatatatataatatatatatatgtatgcatatatatgtattgaaacatatatatgcatggtttatatatatatatatatatataaaccatgcagcaatagggccatgcaaaaaaaaagggtcagctcgatctttagtagatggctcagccggccacgtggttgagccatctttagtcccggttagtgttaccaaccgggactaaagatcgatctttagtcccggttatttcacccgggactaaagatagcgatctatagtcccggattggtactcccggtttggaaaccgggactaaagggggttacaaaccgggactacaaagggtttttccaccagtgggactcaggattttaaggtagtgtatttaaattttgaagtagtaaatttttcaatagcctatttttcaggcttgattgaatatggcctctttttcgtttatatatatatatatatatatatatatatatatatatatatatatatatatatatatatatatatatagacacacacacaatacaattagaaaatgtatgagccgttcagcaacacagttcctgcaagaagcattttaaccaaattatgcatctaggcgcgcgattgagcaaaaagatctttcaatttgtgaaaagattggctttgcttaattaacataaccagataatagagatgccaactaactctgcttgggtgaaacagggatgagatcagatgcattaatttgcagaagctggaatcggaagtggtgaaacagagatatctggagcaggacaagaattgctatagctctccagctgatactcctgatatagttgttgcagacttgaaggaaaaacaaaaaagcatgtggacacgtattattattggaagttttactcactccaaaatttgttacttcctccatcctaaaatataaagatttctaaagttaatacgggtacttaaaaaataggtgaaattaaatgtgtatgaatgttgtgattggtggatatcagaaaatatgtgtggaatttgaatggtggaagattgtttaaaaagaatataggtggagaagttgttatttttgtataaattttgagtactagatattgttatattttgagacggagggagtatattacttggtagaagtagatagatttctttaatttgtttctccattgattatcattaatatgtgtgtaggaatttcaaataaattaaacatgtgcaatactcttttaatttggcagtcatgcaaaaggaacaagagggaataatgctgactatagatatgcattgatcatcgctgaatgttcagctatctctacgtcttgttgatcatgaccgtttttgtctggtcaagcatccatgtgagtatacgatcgagcatatatacatgtgccattctaagcccatgcatgggcatatgcattattcagtactatcgtaccagagatcacctaacaaatgagctatagtaatgtacataatatatacatgaacatatatagcagagacagctcttcttttgatacctctctcgacaatttctgtagtacgtcctccctctctttcaggttattacaagatgactttagtcaaactcaaactatttcaagtttaaccaagtctataaaaaaatagtaatatttttgacctaagataaatttagtataaaaatatatttaattattaatttaataaaactaatttggtaatgtaaatattactatatttgtctctaaacttagtcaaatttaaagcagtttgattttaaccaaagttaaaacatcttataacctgaaacggatgaaaacggatgaagtagttttcattatggctataaatatatatatgcgttaattaagaaaacaatttcggtagtacgtagtcttacatgaccacgactaaaccaccatagatatatgcttccattttgacagaattgaaccaactgtcctgattcctgtatatatatgttaaccgaaccatttactgtgaacttaatttcggtgaaattaattatcggcatgtactactactaaagctaactaggccaaaacaaaattatttccattaatttcaaatcagatgacctgtcttatgtacatatttatgaaattcggcgtccataattatcatctcaggtatgccataggagatttgaccaaatcaatgcaaaattattgatgatcttgggtcaggaacaagtgcaatgcatatacatggccccctactgaggctcttgccgttagacaaccggccatgttcttcaatgtatgtgtcttgtgtggtatgtattggtggaccacacccatagaagctaaaccttatctgctttgctgcgataagcatactacaccaacaaatcctcctcggcagcgataatccagtgaataagctaaaaagaacggggtaaattgcatttttagaaagctgattttctttaaaacacgtgatgcatgcacactcacccatatgaatgcagacacacacggcagcaataatccaatgaataagataaaaagaatggggtaagttgcattttagaaagctaatcttattttttacaaacacagtataaacgcaagcgcccacgacgcatgcacactcacccatatgaatgtagacacgtaaatcctattcctatgagcgcctccgaaagattataccagtatattttgagattgacgaagtcaccatggatgcctcgctgtcgaggtgtacatcgtctatgactgaaagaataattagccataaatacgagtacccgtgtaaaatctagtatttgaacccgggtgaactggttccacaataagaaatctaaccagtttagctacgcttatgtcgcttagaaaactaatatgatgagtgggcttaagaatatgtagcagccacatcactgaaaaccacccacttaaccacaaccagctctatgctacatatagactcccttttcacctataatataataaattatactcttcaaatttatctcataatataagagtttttgtaattccaatacaatacttaacctacgagttttctggtttattgtacccatcacttttttactagtttatccttcctacccattactttcttactggtttatccttccacctacaagttttctactactttatttcaccaccataacctttactatgccccgtccttttgctttttttaacttttaaaataaaatataatcccttatattatagcaaggagggagtagatgattttaatagattagagaacacattaattatatatccaacactagagttgcagaaagaaaaataaaccacgtgagaaccatttgtgaaccaaatatagacattttcttgtatttaccagggaagtatatgtaaatatattgccaatgttttattaaagcatgcgcttaattttgtcacctagttagtagtatattgatatatgctcaattttttttttagagaaacacagcagggagcccctgctgtttgtattgtaataaaaaaagacagaatatttaaaagaagcagaacaatataaatatatggggtgaagataaagggagtgagaggagaaggggttacagggtgttctctcaatttcaaaaaatttcaacatagccttcagttacaattcgaaagccaatatttgatttactgtagtacatgatatgagtttatgaattagctaatcatgaaagtatcggagtacagtacacccaagatagtccatacaaattttatttgctgttcacacacaaagaatatttgaaataaaatgattacaaggtagctagagtactcataagtttctgttgtccttattaatcctaatcaacagagccacatggcttgtcctagccatgtaatatgacagccatcagccatgtgcctcccatcatctggtcttttgtcacctattgcaatgtgatcttgtgctgaattcttcatgatttagtttggatctgtttatggggttgatagatggtctcagctagctagttagttatgtatagtcagttatatgtctgtcactggatgggaagacattctatatataagaccagctggctaattagtgtgtactctaccatgtgtgcgttgccacgtgtcctcggcattcagaagttgcatgtgctggatagatatggtgggatatgcagagtcaactgaagaatgctagccattgtcatggttaaagttcagtaaattaaataaatccacaattcttttggcgccctaaaagttttgtagaaagctttaaaagttttgtagatagattcaattgtacatctggcctcctttgaaacgctacaaatttctcaaacttatgagaaataaaaattggtactgatgaacatcctactcccgcactccaaagcagtctacagatcactacttcaaataaacgagttttctatacaatgacctctttagattgcatatggatcataactggtcgcgtctgcaaaaatcatcctctatttttgtgtgcggtttcttaagaggaccgcacagaataatcgatttccgcgtgcggacctcttaagttcaccacacgcacaaatgagcctatttttgcaggcgaacctcttaagtaggccacacgcaaaaatacccctctctctcttttccctctcactcgcttcaaaattttcacctcctctctcttcctttccttttattttcactcctctctctctttctctcctctcttcgtgtgctctcctctcctctcctccgatcgagcgcggggggggagggtgggaggtggccggctcggtgccactgcctctggagcaggcatggcggcgggctcgagagcatctcagcagacggcatgcgcgcggtggcaggcgcgcgacggtggccgcatgtggaaggtgatggtgaccggtcccaacctggatccggtggagacggaggcccccgcccggatttggcggcgcgggccgtcctccgccaggattagcgtggatccggcggcagggacggccggcgcggcggtggcggctgacgggcaggctcgcgcgcgggctggcgcggtggccggcgtgctgtggggaggtgtggcggtgccggccaatccggcgacagcgacgacgagggcgtcggtgtcggcttctaaggttagggtttcgtattttttggatttaatttttttcggttttttaattttgcgtgcagggtgcgccacccgcacgccaaaatagtgattttcgctgaccttttgctgcatgcgggttgccatgccgcacgcaaaaacctctttcggaccgcacggtaaatggtttttagtactgcacggcacgaactatttcatttaaaaattttaaacatttttcctttttttagaaaattagaaaaaaaaaactttcaaatttcagctcccgggtaaattaatttgtgcgtgccaacatagcatggtaattgtaacattgattggtagactgagtgatctagctcaataatacatataaatatatattttctaacaaatgcacgatgtaaaataactatcattattctcgacaaaggttattacttgactaggcaaaatgattttgatataaatttcttgctctgagaattcgccttcctgtaagggctattagctagcgatatggttttgcagtaccatgtgcaaataactcagtgcgggaaacaacaatacttctgatccctccattttactagattagttgtcgttctagctttatcataaatcaaacatttctatattacgccgtcaaattttaaaattttatgtagtttaacattccgtcaattagatattatgaaattatttctgaaattaaactacataaatttctaaaaattgaagatcggagatacaaagatctgacatagaacaaatctagaacattgagtaatttagaacagacggagtatcttaagaaaatgtgtcaacccttctgtacatgcggagtaagggatcctctgattcaaaggattggtatagggttttttaggattcacaatcctacggattttttttcatatgtatgcctttgattcgtaggaaatgaaagaaaacattccttagggttatatcccttacatgaaaataaggaagaggtctgtcgttcgcgccgttttcatgtgtttggcggtaaactgtgtgcccctttgcgcttcttgtgggaaaaaaaacagagggagatggaatgagaacaccaggggtcacatattagtatccaacaaaccaacagtgatagagatataaagtagtgtgagccgactgccggcggcgcaaggcagcaaaaccgccaattagcggtcagtcatgcgccctcccgcctacacggcacagccatgcggcacgcgcggagaggggggagggggggttgcgttgaaggcaacacgtgtcagttttctctagtttcttcgttgttttttctgattattttttagtttttctcgttttttctttttgtttgtttttctaatatgtatacataaatatacaaagtttatatacatgactttttttaaaaaaaattgtacgtataaattttgtatatacgtgtatatatcttgtatacatcaaatgagtatatgcataaaaaaatatatactttacatatatatactttacctatatatatatatacacacacacactttataagtttatacatacatatatacgtatagagatgagagagaggagaggctagagggggtcgaactgacgcgcatcctcacgcggctagttgcccatcagctgcccccgcaaggtggaggcgaggcttgccggctcaaagcttgggtaccttttatcttttcatgtgtttttattcccgcaggatgaaagaatcaaactacttcaggttctgttctttttctatcctacgaattaaagagacctaaagtattatccctccataccaaaagttcaaaaatcttacccccaaaagaagccaaaagtaataaagttgtattaacataacaaaacccgtcctcgatcgatcgattgaacggatggtggcagacgtacgacaaaattccggcaagacgagcagccgatccactgcgatcgatcgatcgatcgcccattggtcccggccggtcggttcatcaactactactgttgccgctcgctctgtgcatatgccctaccatgttctcttcctccacgtaacggcgccatgtctctgctagcttagcttgcgttgcctccatgtggattcaaatcattcagtacgcccaacgacaatccggaatcctcacgtcgcatctcatctctcatctttctttttctagctagcaagcagtagtaccatgtcccattgttttctttcttttttttttgaatgctatttcgttccctctcttgccggcagtagcttccaaatggaattcgaattaaagccaatccgttaacgatggcagatgcgtaatatcgttcgtgacccaagggcaaacaatctccgtctccctctataaatagccgcttgcaacacatcgccatggctcccccacacctcactagctcgaccaagccgatcccctctctcgatcactctcaactaattctctcaacctcagctgatcatcggagatggttcaccgggcggcggcggacggcgcgcggcggcggctgcggcggcagctgtcaatgccgggatcagggaggccgcagcagcagacgaaggaggcgtcggcagcgctggtgcggctgccgtgcaacaaggggaaggcgtcgcggttcaagcggagctgcttcagcgaggaggacgacgccgcgtccgtcgcgtgcgtcgtctgcgcgccgtccctccctctcattaattagttaattagtcatcactctctctctctctctctatgatctagttgattaattaatcagtcagtgaatcacacttggaggctactgtactcgctagtttgatcctcgcagctggtaatcttgtagtggcattaattaatgtgcgtgtgtgtttgtgtatgtgttgcggtaattaaatggtgatatatataattcgtcctgtccgtcgaatcctcgcccttttctatatttgacgttggtcagtcatgcaaggagtattattttgtcttcactagttaactttctccgtgacaaaaaattctcaaccaagaaagggataagacttctctggtaagatttgttatactatgagaggtcacattcttttttagattgattttttttttgactgagagggtatataaaaatgtacatgatggtgttaacttgaagcaagaggcaaatatggttttccattcaaaggaatatcatcccaagctaagtgcaagctagccagcgcagtacactggcgagtgggccatcctacgccggaattgagccggagtttggttgcctggaccgagataggcaagaaacaggattgccctggtttaggactttggcccaattagaggagaaaatgaataagacaatttttttttgtggaattcgcaatattcgaaatctctatctctactgttataaaaattaaagatatttttaccggtactttggtacgtcatccgtgtatgagtcggtttttaagttcgttcgcttttgaaaatacatgtccatatttgagtcagtttttaaattcgttcgtttttgaaaatacagaaggagtcgtataagaaatctctttaaaaaaactcgtatgcttatttgtaacgatcagactcctaaccacagctcatgatttaaaaaaaatacatcaaagcgaattgccacaatgaatttcaccttagttaaaccatttaacaataataaaattaaaatagccttcacccgttgcaacgcacgtgcattttttctagtagaaataaaatatttgtgaaatgtgtcaggtttaaacttccatgaaaaattatatttgttttgcagaaaatagaaggaactcttcataaataatgttagcatttcacaaacttaaatttatactatgatacagtggagccgacctaggattttgaggttgcccttcgacaactagatcgcaaaaccgattcaaaatccatagccgtattttttttacaactgaaagtctaatacttggcatgtgcaaattgccaaagtagatcatcaaacttgtgcggattggttaattagagaagagaggatggagcccggccggccggcataagaagatggatttatttgcttctttggttgaataggcttttttttcatacacaaacgaatcacatactccctccgtcttaaaaaaacgaatctataactagatgtgacatattctagttcagtgaatctggacagagatatgttcagattcgtagtactagaatgagtcatatccagtagtagattggttttttatgggacggagggagtatcgcatatactaattttttttataaaaaaccttaggtatacaatgatacctttggatctaattgggcaagcccctatgttacacaacattcatcgttcgttctagcttcaatttgtcggacggctggaacctacgaaatcacatttatctatatactcctatgcatctagttagtgtagtttatcatttcgcctatcttttgtcatgcaatattattagattaattatttatttatcatagcttctatcatttttcttaaccgtgttaataaagtggctgacctggcactactggaaaatcatttttttgtgactgccccacagatttcgtgatggcgatgtaaacacagtcaccaagaagacatatcatgacaggcattagaacaccatcacgaaattgggtgtttcgtgactaggaagagcagccagtcaccgagttatagagttggtgacggtgcagtaatataaagccctcaccatactgtgtgatggacttaaatgggccaagctgctctgcctctgtctgaaattgtgaaccactaaaaacagagtgctcttctcgttccccatggctcttgccctagtgagctccacgcctccacctcgacgccgcaactctgctcgtcgattcgtcgccggtagtgatgccggcgaaggagcccgtacattctcacctcaccgttggtcttgcctcccttgctctcctctctgacgggcgtgccgccgctgctctcctcacggtgggtttcgccgccgtccccgtgtcttgtccgtgggtcgcgtcaccattgctcttctcgccgtgaggtgcgcgatcgctactctacactccagcgacctgccttctcctctatgctctcaatccttccaccagaaatagttccctctgttttttccatagggtgacacataggtgttcgatgaaatgccaatgcagcgatttttggttgaatttatgtctgaggcttttaaaccagtaatttgtcacaatgcttttattagatggatgcaaaaattctcagatttcattagatagtggtattaggataatttatgataaacaattatggatagtttactgaccttggtttttgtacactagctttttggttccttacaacagtgagatattttacaagctgcatttttcatgtgtttgcatcctctgaattggattttaattcatagtaaaatattaaggcaagttgtttaatgttcatctcaattataaacatttgtgttccctttcctgtatatgtagataatgcacaaatattgttctactacttgcaggtgtactgaaattatacttcatttttctcgtatacttgtcagtgttgtgtacttttgaaaaaatcagctaacttttagttaaaattccatattgtttgttagagttctaaattcttctaattttacactttataggatcctacagcgagtttactgcagatcaatgacatcacctgaagtatctgttgaacatccacaaggtaaaactgaagaatcatttgttcttttcattttacttgtcaccatgcaagtgttttctgaattattttctgttcttttcttgttacctgctatcatgcaagtgttgttgtcactgtctaactctatgcagatgtttaggaggagttggatagcttatagatgcagttaccattgtgcctacacagctactagatgtaatgcattgtgggaattagattaattctgaacttctgcagtccattcttaagttctatatagtttactgcctgtgcaacgcataatgtggttttaatgatttgttgctagtaaatagtggaacaggacatctttaatatgccttggaagtaatatcttttcgcttttccaaaaatactatggttaattacttgttgtgtcatatctttaatatgttttcctttcatttctaaagatggcttttaaatctaatgtagactgttctaatcagtctgaagaatgggacacagaggaagactgctgtttttgatgcatcagaactagaattttggtgagtcatttttatatttatcatactcatttatatgctaccattaattggtcataattgatttgatactagtcatcttatgccaaaatgaccagctttgtatttaagaaactagaacatactgaaggtacctaatggcttgcaagatttaaggaaattgtctctgtttcttaaagatgtcctgaaacttaacacatacaaatgtgctcccttgttatctgaagctacatggcatgcttgcgttctttgatctagaaattatttttcctagatatctgaagctacatggtatacatgtattcattttatcttagatgctgaaactctgcacagaaatgtgcttatccagttatctgacagctgcctggcgtgtgttctttttatcttggattcattattgaacctaaacatggcaaaaatattggagcatttgctaaaggtccaagaaaactattgtaattttgcatggctctaatgacttcattccagtacagtgttttaatcggtatgcatgataagagcaatttaccgatgattcatctacttgattacctcatgtgattaatctgattcaagctttttataggcttttttacggtgttgactagtgatttcatttgaatttggagctattcagtaataatattagctaataactaaattgtagcttgctgtaatcttcaagtgacattcattgaattttaaggcaacaatttcaagtccagtgatacagttcaactcaatttgatgattcactttgatgtactaatttgttttgaagaaactttcctaatatattatatcatatcttgtagataattgtagaattgttcttttatggaaagctcagaagacttccttttttcacgtggagcttgctttatgagtggccaccgaaggctgcttccctctattctatggcattatattgggcttgtcacttcaagaattgttggactgatacaagacttgtgtagaaatttgtagtgcataattaaatattgtttttctatgaattatgtaaggactcacgatgttcaatgctaatatatgcttttgtgagtttgaatttggacttgggtaaaataagtgattttgttgtattatatctgaactcactttgtagcatatgagattgatttacatgaattttcatattaattacgtgcacatcgcgtgtctcgtgacagccacccagtcacgaaaggtatttcctaatggcaaaagtctgtcaagaaattgatgttctgtgacagctaccaccttcacgaaaaagtattcccaacggttaatcaaaactgttagaaaaatggtcaaaacatgcaaattgggggaattgctttttcgtgactgcttgacagtcacttaacagcttgtgactgcttcccctcaccaaatattagatttcgtgactaatcaagcgtgactgacattttgtgacagtatgtggtaaccaaagatctttgtgacaggcttttgacttttcgtgagagtgaggggcagtcacgaaaaatccattctcttgtagtgtggtcataggattaatccatatgcatgtagtaattgagtgagaaaaaacaagaaaaacctgaaaattggtaaaagataaataaattattagacttctgcatcatgaatccataatactaactttaaaggtgcaagtgggttcaggggtcgatcaacgtgcacccttaaataacttaattagaaaataaaaaaaacctaaaaaagtagaaatttttcttatgcaatcagcagcatcaggaggcaggagcagtggtggtagtacctccaattcgatcaagttgttgtgttcttgtggttggattattcggtttttaaggggagttgtttctttttttctggtctgatgaagctgcgcggtcgctggtaatgataagctcaggtagctgcggaagaagaagaggggtcgctagattggccggaggttggttccgcggcggcgcagtcggccagactgggttggtgctcggtggggctagctctagatggccataaggcccgaagctcaacggccggcccacggtatggtattttggcccggtccaagcacgacacggcatgatcgggctggcacggcacgatgggccagcaggctaggcccgacacacaaagaatagggagcaaacatagacatattatatgccatggttcagagaataaggacgtgaaatagacttattttatatatatatatatatatatatatatatatgtcagcccaaagaggagagagaaaaaatagactattttagctatagatatgtcacaacccaacgaggagggaagaaaaatagacttatttaaaaaagacacgatgggccacccgtgctttcgggccggcacggcacggttcgactgctggtgggctgtgcctaggccaaaggtgcagcccatgggctggcacggcccggcacgaagtgccgactgggccgtgctggcccgatggccggtgggccgtgcctaggccgggctgtgccgggcgggccttacggccatctatagggctagcatgtgttcgttaggtgagacgttgtcaccggagcaacaaggaggcgccatagagggcctcgccactgacctggccgcagcgatgcgcccattctcgatgatcccacatcagtattgatcggtttcggttgtcgacgttggtgccgctgtcggacgcctagtcggctatccactagcatggcagcaccacgaagcgttccatgcattcggcggtgcctgtgcagcgttcaacggtggcagtggaggatggccaggggctctccctctcgatctcgccgtcactgcagtagctggagatggcgaagcaggcggaggggctacgagtccgatacggcgtgctctacatcaactagcaggagcaatagcaattagcaggaaaaaggcagcggcagcggtgtcggtgcagaagctccgaatggcattgcacggccaggagatcgctaggcggctgcgcgcggggaggagtcaccggccgcagcacgcacggggaggagctctttgatcgcgggctcctgctgcctggcatgcacgatagatggaaaagagtagggatggcagtttaacccgtttgtccgtttacccgtggataaaaatcctaatagagttgggtttgttctccatttagtacccatgggttttttattgggtcaaaacctatacctaacgggcatacgagcacgggcataggtagtcgctactcatgcctgcttcgctcgtttacccgcaaaaaccaactgacatgtggtcccttagtcaaattagtataaatgccaccatctagtattgatgaacttgtaatgcttgtattgttgaacttggtacaactgtaccctttctttaaattgtgataatgtctctctgcttgtggagatttgtggttgaaatgttgaactgtagtttgtgacgggtaaacgggcatgcccgtgggcacatggcgcctgtgggcaacgggcatgggtagtgttccttgctcgtcatatagtaacgggtatacccgcgggcatgaattacctcgcgggcatggatatgggtagtcactacccgtgcccgtcgtacccgactgccatccctagaaaagagagaggtgagtaaaaagagaaaaaaaaagattatgactaacaagtggggttgttatttttgttattttttcttactgatatgtgggtcccacgagcaccagttaggataaaactgctattcaaacaaccgagggactcgatttgctctgattttcaaatatagaagatgcgttagatctggtattgtggttgagggaagcaattcaagcagggacaagaggtgagggaggtctaacatacttatcctcacacaataacatggacatgggcctggcttcatcggatggcccacagagacgtggatccagttggtgttggtggtctgcatgcttgtcttgcctatgctggtgttggaggttgcacgcaagctgcttgcaagttgcgaaccatcatccaacaacttatatagtttaacatcatactaaatttctttagattcacatgaaaaatactttcgcaatatgtaattcacatcttatcaaactatacaaattcaagaaaatgatgttaatgtttaaccggcaaacccacatcgcaagtaatttatttgaaatggagggagcattagctcgtcttaatccaatattgtatctccaataattaaataccttaatgtagaagacgcatatgcatccatattaattatgaaccgcaccgctgtctatcttgttttgagtttgctccatctatccgttccaaaatataacaaaatataataatttttagcacattattcatagtattcaatcacatctcatatactttaatttcttcctattttaccccatctattccatatttgctgagagaaagacttttttttcttaatctcaatatttgctaaataatcttgtcatccttgtatttcaaaacagatttgagtattttggtaggagaaccctacaaattgtctatcattgacctaggaataattgttctatgtaccttgggggctagtttggttatgatctttggtgaaaaatctgcattgcatacatttagctcatcggtcatctccgccatatatatataccgatgtttcaacacgaggctacttaactttatcacaaaatattgtatttcatataaaattatattaacatcagggcatgtggtgccgtactatgctattcctattattttttttattgaaatatactattcctacagcatgtacaacggtaattagtgtgctagtccatagcatgtcagttgatgtggaggaaagaggatgggaggagtgagcaagaagtactcctggacaagtgatcttttgccggatcatgtaaaaatcacattagtctggtttcaaataggaaccagcactaaagatcagctttagtcctggttcaaaagcccaatggcactttatgatctttagtcacggttgtcccaatacaataactgtcaggctatgtcaggtccctaacgatctttagtccttgttgatatcaccaaccgggactaaatatctctctcccatgtccttatcctttctctcccacgcctccctcgatctcccacatgtcctacacgtccttatcctctcttgcctctatctctctctctctcacctcgcctctctctaactctctctctctctcgctctctcgagaagtggcagcggcggccgagcggcagaagcggcggtctcgccctcccctatgctagatccggcgggaggggaggcagcgggatgggaggctgtgcggcggtggagcgacaacggctcaacgacgtcagcacggccgtgcggtagacggaggaagaagttcagtctttttttaatttttcgagattttgtgatgtattttttttgagaatttgtgatgtgaatatgtaaacttgtgatgtatttgatctgtggtgtgaatctgtgatgttatctgtgaatctatgatatgaggatgtagggagcaactcgatttggggaaatcaatatgcaagcagtaaaaacaatgaacaaaagaaaaaaccgggactaaagaccacttgctgagcagtgaagggtcgcgtcggctgaagaaaacatatgctagaaaaaattgagatggaggaggaacaaataaagttaaaataatgaaaagttagaataattgctactagttaaatattgttttaaacattatttaacagttgtactagatttggatgggctcgcataaccaccttccaacggctgtccaactaatcccatttttccccctgtgttatgtcctcaaaagcaaaacttatagaggggggcaaaattattaatagcaatacatatttcacctatcctctactccacatgaatataataccccctcccccccccctctcaactactgtaccattgcatatccctcttcatctcttctagcattcctctttctcccaacttctactagaccctcttcatctattataggatgaaattgaacatgatctgcaatatcggtatatgtttgattcctgtatgattagaaatgagcagtatcaggagaacataaactcagcttagcatgacttctcgatggatcatctgagctccgagaaggcccaaatgagcacaaggtcagagcgacgtctgtttaactcgcaccctggtcctcaaattcttttggtagctccatggtacggcagtttatctgggaggacagtgggaagctaaaagctcataggccggttgaacgttgcagacagtacggtcttttcatgaggtagaaatggaaataattaattatttaccactattacaagtggtgataaaagatttgtcacgggacctacaagtcatagacatcaagtgataaatttaattaccacatctttaatgtggtaaaaagttaaatgtccctacaacaacaaatgggtcttagaaaaaaaatcacagcctggtcttgtactcctgtccaacagtgcaggctatagactggaaattaacatcagattgggggtgccttatccactgactttggctgtgtgcctcctagcagagaccagagatataaaccattttcattatctaagaagtgattagtaactatgcgtccttattatatattgaggtgtggttgcccgaacggtcgcgccaaattctatacttcctccgttttataatgtaagtcattctagcaatgttcatattataaatgtttagatttattaacatctatataaacgtgaacaatactaaaatgacttacattatgaaacggagggagtactactcagttcgatctgcatgttgcaatgtggccaaatgccgtatgtaacattcagttgaattaggcatctctccaaagtagttaagaacattcagaacgtaaagataattatgttatgaatgtaatccagattcgaatctgtaacatgaatgatatagttgttattgggttgtgagaaatgctataagagtagctagatttagacacacacatgcatgccagacatcgattatccacagcagttgacatttttggtagtcattataatttcattaagaaaatgtaatatgttctgataaatcaaattaagaggattgatcaaggaaagaaaaaaacaggagatggacagcatggtaacatcaatcacgtggtgacgccgtggtgaagccagatagtggtttctgataacggagcaatcaaacaaaacaattgctaaatcgaagttacccattttcatgtgattttgtcacagcattgaataaccgaactgaacaccacactaattaattacgtgcctatactactccctccatctatttttgatagtcatatttcatcttagtacacagaacaaggataagcaattctacttatcatccatttaaacatactactagtcatttctcgtaaacaagcgattcattaatatttacatttctcaatacctatgtagccaatcttgtgtggaatagtgaagagtcatttattaattccgagaaagtcattaaaatgataggttgttggattgaaatatgactatcaaaaaataaatttttcagatttggaaatataactatcaagactagatggagaaagtatatggctagtgggatcaagagcctgattaattattgtatttaatgaaaagttatatatatttcattgctattcaatgttacgtgtggttaggtggctgtctgatatattccctccgttttttaagcacattgattttttaagcacatgtttgacactattgatttttttaagcacatgtttgaccattcgtattattaaaaaacttttgtgaaatatataaaactatatgtatacataaaaatatatttaacagtaaatcaaatgataaaaaataattaataattatttgaataagacgaacggtcaaacatgttaaaaaaattaatagctacaaatatttacaaatagagggagtatttgatactccttttattactctcatgcttgtcatgatcagatctgaactttgctatatatcaaacccttccattgtcctcagttaccttcagtttggctaaatataccctttggctgcaaaatggcagaggaacaattttgggagatgattttttttttaaatgcagtcttcatgaacatccccattggatgggaaaacataaacaatatcctcgctttggaatgagtggcatcagtaattcagaattacaataggctagtgtaaccttctgggattgaacatggggagaaggtcgcccagcatgtagttcgctaaactctataactgcattctacctattcagagagtgttctattgcccattgaagctagaactataaaacattgacccctatacaggaagaaccctggtaactgcactgtagtgaatagcaaaattcagagagagcaaaaacagagttaattttcaatggaaaggcggagagaacttttggggcaattctctgtattatttctctagaattcataatgggtactccacaaagcaaaacctagctatttaacactgccaagtctttatctcgtgccaactgacgatccccaattctcgacaaaacacacaccacacctcacagactcacacacgcacatgccgccctcgcacaatcactagggcggcacccaccgtgcctatcacatcgcctaacaaaaaccgaaacggatattattctccaaccgtgcaagctacaccagtggcagctttgggatcaacccgggattagctagtgtaggcaacaacccctagatagagcaaaatataccaacgataatccttaggatcggaggggggggggtgcagcgaaaatggggcaccccccgacgcgtgggcgcgcgcccgtagggccccaccacgtctcccctgccatactgtcacgtgtccccaccatgcaggacgttgcaacaaatcacccacttattttgaaaaccctcaattaagggaattcgttttattttttgttccactaaaaatgtttcatctagtgcaatcacaatgtttcactatatatagatctaatattgcagtgaactgaaacattctttcgctatttgctgaaatattgtttttatataaagtgaaacaacacccgatttaaacgatcgaaacattttcgatctacttagtgaaacaattccgatatacttggtggaacaacgtgcaacatttaaaaataattcaataataagctaaaatttttttcgtcgaaatatatccatatgttgtcttgttttgaagatttaattaaaatgaatttaatggtgtaatcggatcatgatttggataaataatttaagagaaaaaataatttaaagtggttttgcacacatgcatcttgctgacatcaccgctcgatttttctactcctccatcagacgcccgatgtctaggctcctccatataccatagcaagcacataaaatcagttgtgcctctacaactgtatctttaattatataattgttttcaaaaagattggtgaaaaatgtactgagtcattccatccatgtaacaaatgaatatataaaatcgtccgggctg

SEQ ID NO: 41974 - DNA, 1860 bp, Oryza sativa
cctaggcataggttccatgttattgtaaatgattctagctacattatgatattttatattatataatagaaatataaaatatgttttgatagttaattagaatttgactatgggtcgttttagtttccaggatcttttgttatattaaattgcaggtatatatatttttgggtaaaaaacactaatgagaactagatgataaattcctacaattaataacactgaaatcttgtgatatccagtttcttttctttcataattatgataagaagaaagatgaacacactaccagaaactagattacttaaattatgacggccaaaaaccgtcaggataaaaaaaacacgtcaggaaagttgtacatgacgtgtcaatgtcagaaaaataaattccgccaggactagcttgtcagagaaaaattccgtcaggatagaaaaaacccaatatagttttttttaacctttaactggaaaggaccaaggaggcatatacatctcaataattaatgggaatggaatgggagaaaaccatttttttatttccctatgctgttcttttgtcattgcttgcagactggatgtgcattgcatcggaaaattaaagaagaacattctcatttattttaaagcctctaaaaccgtgtaagatcaagtttaataagaatggtactccctccatccaagaaaaactcaagttaggaggggttataggttagttttttttggacggatggagtagttgctatctgtaattttgttcattttgctagtcattaattaagagtctagatatgcgacaccctacactatccctaatacacttattccaatactaagaatttattttacttgttttctctccttttctcttggagctcgatcatgtgcaagctgcctcttctatgaggggcatcatatatacccggtctctctcctctctttcgtcttgacactattatgtacttgctctaatcatcaagccctttttcatcattttctacatatggcgccactgaatttctgcatatagtgcctttctaaataacaggtgaacttataggcctcacactgttttttgtaaaaaaaattgctacgtgacacttaaaatatatgatctttgctgctagacatctgaaaaaactaatacggctcgtggacacattagaaactgataatttgttaagggacactgttgtgattattttattattttcagaacaaattgagagagaaatagcattgaaaagacgagtttttgcccctctcctcctctctgtatctcccgaagttgatcagcagttcagcaccagcccatcgcgtctgtgcatgagaaatttttcatgtgcggctgtgaaccggtggttctcaaaccataggaacttgaataatttttccataaaatttctttgttaaccatttaatttgctgttcttcctctaaacacagaacccccacatgttcttcttaccatgcatggatgagttgatgtttaaaggaaaatgcctaaaatggagatagcaagtatatattgagtgacaaataatcaagtgatagactgatgagcagttaaagccacatttattaagtggaaaaataataactgggtcgtcgtgcacagcgccgcacatacgtgtcggtctcgccctgcgcgcccgtgctcgtgctcatggccctggacaccattgggacacggttcacgttgcgttcgcggagacgcaccggtcgctcgacccggtggcgctgcactgcaggaccctgtggcggcgctgaacgtggtcgcggccgacgcgcgtcaggctgatcgtggcaaggttgacctaggagctagaggctgcacttggcaacaacatcgaggaagccg

SEQ ID NO: 41975 - DNA, 9481 bp, Oryza sativa
attcctgcagcccgctagggacgagtgcttggaggctctcgtcctgacgggatggggcgaggcgtgcgtcagaccgcctgtcgccacctaacccacgatttgaccggtctgtgactgatcacagaccggataaacgagcgcgctgcactgcgttacatgcggcgtgacgcactcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgaccccccccccccccgagggggttaggccacgtgggtgatcgtatctgcctcaagtctctaagtcatgatactctcggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgcaaatcacgcacatcggcaatggttactcggctgtcaataatgagcggtctcttcaagactgccacattactcgagtaacacgcgaatcgggacgagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagtgtgggcgcgagaaacgagggggcagatagagggcgcgagaaacgaggagccgggcatagcgttggcaagggtataaagtcaccgaggaagagatttgcttccttcttttcgccattattccccttgtcttcgccgcttgcgccctgactccttgtttcctgtgccctaccttcgccacacgcgctcgctctcaaacatctcttcttccggcgtcatggtagcgtgctgccgccttcccgcatcgtgagcgagagacaagccgggctgccgcgccgcttcatgccggaatctgccaccggccgggagatagtctcgctgggcgagggatgcccggcgccacgctacccggggcggtccgtcttcttcctcccttttgctatggcagggctggttccgctattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtccttcgcaagaagtgggatgactggaagagcgactggttctacacccccctcgccgacgaagcgcgcctccgacttccgagccagcccccagcgcaggcctccaactggcggacgccggtagatctgggagatggctacgacgccgttctcgaccgcctggcgggcctgcgatcccaggggctcacaggggccatggtgttcggcgactatcttcgtcgccggatcgcgccactccagcggcgcgcccagggcgcctgggagtacaccgggtccgaggactgtatgaggacccaccagggggtcagatgggactgggctcctgaggacttcaagaaagtggtccaacgggtgctgaatctcagctccgtggaggcatccctcattcctcaaggagtcctccccctctgctgcgatgcagaccgcgcctccatcctgaccatcatgcaggcggtcggggcgtcggaggagcgggctcctcgaggccacgatggcgcgggcgggagccgcaggggggaacaatctaccctgggagggggtcgtgcttctgggccctgcgtcgggggcccggggatcggccgccctgccgacgcccgggggaagaggaagtaggaaggaacccctcccccatctcctccccgagggggcggggcggcgcgtgccagcagcaggcgcccggagggggccacgccgacgtcgcagcccgagggggagcggaagaagaaacggccccgcaagatggggggggacagaaccatcccggggaaacctcatttcccctccaaggtggtcgtttaaccgaccccctcgcaggttcgtcccacgcccatcgtggccgtattcattccttcaatgcgagttttcactcatccatcttgtttgtcttctggtctttcttctgtttcagcgagatcccgtcgcgtccctcccgctattccaagtccagccagtctgaggccgaggacccggcgaccacagaggcccggaggcgggaatctgaccggcgagaagccgcggatcgccttcgggaagccgaggaggctgctcgggaggccgcccgggctcgccagaccgaggaagccgttcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcggcgacgacttccgaggcagctcgcgacgaggccgcgggcgcatcgcttgggcccaatccctcgggcgacactcaggacaagcccggtccgggggacatccctgagtctggcacgtccatcggcgggccgagccgcgcggcatcctcaccgaggcggctcttccccacaccttccgttgctccactgagcgcagaaccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtagaggccatggtggaggtgggccgcaaggcacaccgccggcacgtctcagagctcgaagcccgtcggaaggtgctgggggagatcgccaaggaggtggaggaggagcggagggctgccctcattgccaccaccgtgatgaacgaggcgcaggacaccctccgccttcaatacgggagctgggaggcggagctagggaaaaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgctgttgctattcgggaggtcacactggcggtgcacgaagccgcctgtgcggaagaatagtccgcgctcaccgagcgggagcgagctctcgaggaggccgacgccgcggcgcaatggctggcggacagcctgtccctccgcgaggctgcgcaagaggaacaagcgcgtcgcaatctggaaagtgcctgcgccgagagggccgcactgaaccagcgggccgctgaactcgaggcgcaggcaagggagctggatgcaagggcgcgtagcggcggggcggccacgagcgacagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgcgccggccggcaggtgggcctctgggcgggcggactgtgaagtacgccgccaaccaggggggcctcgcccagcgcctctcggagatagccgggactctccaacggctcgccgaggagcttgagaggacgattaagtcatcctcgagggacctcgcccgaggagcggtggagctcatactggcgagttaccaagccagggatcccgacttctccccatggacggcgctggacgagttccctcccgggaccgaggatggcgcgcgcgcgcaggtccgggacgccgccgaccatatcgtccacagcttcgagggttcgacccctcggctcgcgttcgccttcaactccgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacaaggatgtctgtgccacggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgctgattcccccccggagttcactacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccgaccgaccctgcacacccgaggggggtgcggggttggcccgagcccgaaacctgacacccgattcccctttaggggtagaagcgacgaaggtgttcgatgttccacgggttaggcagctctgtgccgtcacccgtggccagccgaacagagcccggccgggggacgccgatcactcgatacggaccctcccacattggtgacagcttgctcaatccagcacgcgtttggacgcggcgtaggacgaggtcgtcgacgcagagtgatcgggcccggacgtggcgctgatggtagcgccgcaggctctgctggtagcgtgcggctcggagggccgcgcgtcgccttcgctcttccaagtaatcgaggtcatctctgcgaagctgatcttgatcagcctcgcagtacatggtggcccgaggggacttcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccacattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagaaaatggccatgaaagtggtatgatctgcagggcctgggccggctgatggatttgcttggcgtggaattgacacgctctgtatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgcacttcaggaggattccgttagccgcgtgccgatagagggtcccttctaccagcacgtagcgtttggagatgcgctggacgcgttcactcctttcgcggtcctcgggtagagtcttatctgtgaggtatgcttggatctcagcgatccaagcaatcaatctaagggagctgggagtgctcccctcgggtcccgaggcctggactccgacgggcctcggtggcctgtcaggcgcgtccgtctcccctaaggggtcgggtcgcgccgatggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtaacccccgcaccggcgccctgaagagacagggagccgtcgaactgcatcacccaatgggcggtgtgaggcagctgcggggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattttgcaagatttggccgagggggtaagacgtaaccaccgtgacccgatgcgccaggaaataatggcgcagttcctcgaagccatcagaatagcgtaaagcatcttctgggcctgagggtatcgggtcttggcgtcccggagggcctcactaacaaagtagacgggccgctgcacttttcggtggggccgatcctcttcgctaggggccacatccctggggcgctctttgtccaagcggcctcgcggggtgcactcgtcttctgtgccgacgacctcggggtcggaggacgacaggggtggccttcccacagtggcctcggggccgtcctgggggtcgggggttcctggcgtcgtcggacaagcgggcaaagggccaactccggtcgtcaggggccttaggccaccgttcggctcgggggcctcttctccctgctctctcccgggtcgaatcggcacagggttagcctcggggtcagagggcgataggtgcggccttcccgcagtggccctcgggccatcctgggggtcgggggcacctggcaccgtctgacaagcgggcacagggcctgctccggtcgtcgggggccttgggccaccgttcggcttgggggcctctcctccctgctctctcccgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagagcacgttcagcttcctccgtccaagtaaacggcccggagcgtttgaggagcttaaacaagggtagcgccttctctcccagtctcgatatgaaccgacttagggcggccatgcaaccggtgacgcattgcacatccctaagtttgctgggggggcgcatccgctctatagctcgtatcttctcggggttggcctcgatgcctcgggcagagaccaaaaacccgagaagcttgcccgcaggtacaccaaacacacacttatcggggttcagttttatgcgggcggagcggagactctcaaaagtttccgctagatccgagagtaaggtctcttggttgcgcgtctttagaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaactagagtatgcatctagaaaacacaaaaggtcgcaccccgctgtggagtcgacaatctgatctatgcgaggcagggggtaagtgtccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccaggacctcgtcgcatgtgactatccgctgcctcggggcggcgggggcggatgtgctaagcctctcgtcgccaccctccggcttggacgcggcggcgaggtggtccgcacgctgctccatacaagcaagcgcgactttgaggtcgccatggacagagatggggccaccggggcccggcatcttcatctggaggtaggcgtagtggaccgccgccatgaacttcaccaacacgggcctccctaagaccgcgttgtagggcagattgaggtccgccacatcaaagttcacccgctccgtgcggaagttggcggatccaccgaaggtgaccgggaggtcgatatgacctagcggccaagtgtgccccggcgtcacaccgataatcggctgggacggccggagcatcatccccggggccttgatggcgtcaaaggctgcgggggaaaggatgttgagggctgctcctccatcaatgaggacacgccccagctttacgttgcaaacagtgggggaaaccaccattgcgatctgtccttcccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatatcgccgtcatcgatgtcctcggcgggggccttctgcttgtcctcacttcg

SEQ ID NO: 41976 - DNA, 12895 bp, Oryza sativa
aggtccatgcctcctccttacgagccactcggtccgcgagctgaaaaagctccgcggtagtctggggctctttggaggcgatcttttcaagcatgcggttgtgccgcacaccccccctgaacgcgtagatcaccgcgtgtgcagggatgcatggaatggtgttgcggacttgacagaactgctgaatgtatgagcgaagtgactcatcatcccttcgctggactgcatgcaggtccgcttcttcacctgggcgcggatatgtgccttgaaagttcatggtgaactgttggcacaaatcctcccaggagtggaccaacgcgggtggcaagttcattagccaaccccgcgcctgtcccttcagggccatgggaaagaaattcgccatgaccctgtcatcacccccggcggcttcgatcccggtcgtgtagacctggagaaactcggcggggttgacgctcccatcatatttttcggcgatggtgggccggaaccttgggggccaacggacattccgaaggctcgccacaaaggctctacagccgacaccaccaaccgggggcacggagggctgatccccgcgtccgtgttgaggtgacactccggacgaggaggcgccctctgttgcgtggggagcacgccgaccattacgtcggcgctcgatatcgatgcgggcatctggccccccacgctgatcttcctgggtcggaggcgctgacgaaggagtgacggccgaatggcgagcaacagccgccgctcgccgcgccctccgccttgacgacacggagccggtggtagcagcgccggaggtcttggtggcggaggaccgcccaccagcacctaggcgctgccgtgccgtcatgaccaagttggccacgtcgtccagccaacgttgggctggagactccgggtcagggacaacgggcgggtgacgtaggagcgcgcccgcagctcggagcgcgccctggggcgtgctgccgtcgccatagacgaggaggcgacgctccccatctcggcgcccttctccatcacccgtggatgtcgaagtcgcggatccttcgaccctctcgagcgcctcctcctgcctaggactttggcgtggagggggcggtggagtacgagctcgacggcgtgggtttggctccccgtcgtcaccgctaacactcggagagaggttgtgcgcttttgcttgttcagccattgggctgaacagaaaaagcttggcgcacacgaaagagtgtgagagcttagaagaacacacgcagagtcccctacctggcgcgccagatgacggagcttggggctcctcaccgggagaccgcgcaggccccccctttgccggttcggccgggggccctgggtgaggttctaaactccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgggccagcccccgatcgttctgggatcgttttttcccctcccctcttctaagtgggcaaggtcctccttttatatctcaaggggataccacatgcaccatctctccctctctttcttttgtggggacttatcctatcttttcataaacagacggagacttgtatggttgccgtccgaatgaccttctgatgggacggcccacacctacctccacttccgccagaagcaggcgcaacgtgggaacatggctgtctgcagacgacatgaccagtgtcagaccggtcacaaatcggtcattcttgtccaccacgcgttagtttatcaatctgcatgttcgcccctcttcatacaatgtcttgcttgtaatggttaggatgaagcctggcatatatctgaccggaaccaatgtgccatctctaggagctaacacgccggctccggctagggacgagtgcttggaggctctcgtcctgacgggatggggcgaggcgtgcgtcagaccgcctgtcgccacctaacccacgatttgactggtctgtgactgatcacagaccggataaacgagcgcgctgcactgcgttacatgcggcgtgacgcgctcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgacccccccccccccgagagggttaggccacgtgggtgatcgtgtctgcctcaagtctctaagtcatgatactcccggtcccatgtcaccgacaactgtagcaccacattattaacttatggcgtaattaggttcaaaatattcgtctcataatttacatacaaactgtgcaattggtttttttcgtccatatttaatgctccatatatgtgttaaaacatttggtgtgacaaaaaagttgaaagtttgaaaacagacccaagttacgaacccaaagggtaagcttgtcttttataaatgcttttttctccatttaaccgaataataataaaataatgatgatggtgtcccctaataaattaccaggtttttagagtgtccacgaaccttgtcacgtttttcggatgcccaggagcaaagaccttaatctttgagtgttccgtagcaaattttgttttttttacacaaacattatgaaattggttgttgcggtggtggcagatttaccacacaacctcgccatttgatatgttgagttatgaaccaaattcagttgcaattaataaatgctagcttctgctggagtttaagctttgctcaaacttaattggtatagtggtttagcccaagaggcaatataaaaatattaattgcgggagacattgaagtaacaattgatgaaaagtacataatatgcaccattccaaatttgcatgtacagacttgcatatatactttctctgttattaattagtgtgcagtgcagattgaaatcaggaatggaaaaaacaggggatgaacctaaaatttgttgctatgaaattcaggatcatatataacgttcgctgattgccattactcgagcaaaaaggggaagctataaggcagggatgcccaaatttggcataatcatcactataaatctacaatggaatgcccaaagttggcattgtcacccgaggaagtggtgaattctgatagtgggttctgataagaaagcaatcgaagaataccagtttttaaaagttgcacattttcatgtgatctgattacagaattatttgaagacccgaagcacaggcatcatgctgattactactacatccctgttccattttgaacaaggttgacgtgaaataattataacttttgactatcagaataatcatcttggagacaataaacacacgatttgtatataagtcttagaaagtactttaagaaaaaaaatatttacttattttttatatattataatataaactcagagttaaaatatgttttagagatcgtgtacatttttgttcaattattgaaaatgtcaactgaaccggagggagtatgtacctagctatgtatatacctattgggatgaagagccttaattatgttttatgttttaaagaaaatgttgttgacgtataagccccattcatcactccatggacactgcaatagtgtggctgagccattactctcacctctggtttaagatatatacatatgaactcctctcaatcattgctcagttccctttcaatttgcctataatagcatgtgtctaatcccatactgagatggtatattctagaacggagggggttcataggttagttggatatagtcgataggacaatggccctaattatattattgaacgaaaggtttgtagatacattaatgttaatacaaactccatttgttacttcatactccatctttccaaaaaaaaactaacctaggaggggatatgacctaggaagagatgtgatccctcatagtacaacgaatctgaataagtaggggtcacattaccttttacgttgggttttttgggacggagggagtagatatctgcaatgcatttcctttcttcttcttttttgtggggcctgagtgatttcctctcgactatgtatatatgagtccattccgtcgtccttggttcccttcagtttggctgcaatatattatacataccgttcgctgaaaaaagtatataaagttgagagcaccgaaagaaaacatgagagatgtttatctttcattttgaccatcacaatctttatgaacatgcccatctcgtaacatcaaaagatgttgttttggaatgggagacatcagcaataaaaaatcatggtattgtctgacggatccttttgtgctccccctgtcaccgaaaaaatcaacatagtgattgacgttgatacattataatactataaatcagaagctgcatctgtcctgaatcgtagtagtagaatgtgtcaatattcaagactaagttagtttttatgagacggaggaagtacaagaggccagtgtaacctgattatagtggtaaagaagcaagattacagtcgacctagtggataggctgtgatgtgcagtgccccgtggtatatcctttccgcaagcgataactgtcatggcattcaacggtcgttctggtaatcgttcatcatgaagaacaagaagaacatgtcaaaagctgcgatggaaatgggcattatggccgcatgaagtataatttgttaaacaataattagggatataattgtttgctatagaaaccatgcacgttgttgtatagatataatgtgatacatctgctccaaaatctgcattagcctagttctatagattgagcgagctaacatatgcatggtatcccatttacactttcatcatatcttgtgtaaaatggttaacccaaggtgatatgattggagcgcaaaggcttataagcatgccacttaattaggacctacgctctataaaagaagcaaatggtgttcgattcaaacattgttccaagccaactacatactacatgcttagtacagtggcggctaggccgacgtaagctggccggaccaaggtggggaagacacagaagccggcttagcccgtttcagggtttaggccaaaaagctctgtgagattaaataattggtttcagtattcaagaaattcaggagaatgttatggcataaaaagaagcaaaaagatcttaatagaacttaaaacatatgaaatctgacaagtttgaaattgaaacaagttatttgtgaaatgtgatggtgggtttaaagtttgaggtcaaaacaattttgttatgcttgaaatggaagaaaaatggaagagactccttttaaatcttgatgtgactatcttagatgaataaagtttcctttatcttaaaaaatgtgaggttttaagaaacttaatttagacgttatataacatctcttgctggttgtaatagctctaatttgtctcacaacacttagtaaatcctatatataaaatagttgtatggttgtaccaattgtacaaatcatatgaaattttccaaaaaggaacagttatataatgattgataaagtatgaattgtacagatcagatgagattaaaccatatttcattgctacaaatcaattccagtttgcacctctacttttgtgacatgcagcttttccactgcaacacgtggagttttcgcctggtgttttaccactgtgtcttaatgataacaacactactacttactccctaccctcaaatataagtatttttttaccaggtcaaaaaaaatataagtatttttacgacacaaaattttaagtatttatgatttcaatgcatgggaattaaaacatttttagccaattaggtgcgtaggagggaatccaagtaatattagaaattgaaaatttgacaaataactggtgacagctaaaagatcattattagaaaacatattttttacaaagagttaaaataaatttttctaggcggctcttcaccccgcctacacttcaagacatgtgaaaatacactattttcacaggcaccttctgtccagccgttggcaggggccgctgccgctgtcctcccccatctagccggatctaggagggagggagggtgggaggggaggggaggggaggggagtgctgcctctactgccgcctgcggtggccgccaccaccatcgcttccctcctctggccggatctagtaggaatggagatagggaggggtggggagcgccgcctctgtcgctcccctcctccggccagatctaggagcaagtgggaagggaggtgaggggagcgcctcctccgcactgtcgcttattgtgactcccactgctgcccctcccctcctccggtcagatctaggagagagggaggagagggctgtgctgactactatggccgcccgctgagaggggtggagggagagaggccggtcatagcgggtggaaatggaatctagccgggtaggtggtgatttttatgtggtatgaccttttttgcagatggacatcttaaggtctcctgcgaaaatcgattctcacaaacgtggtcttaagaggtacacctgcaaaaattatctcttatttttgctagcggaccacttaagatcatgcctgcaaaaattgcagataggactagatttatggtatctttatctatttttacaaacaaaatagatatgagggtagtgtccaccaatttggacaatgggactgctttaaaaagcctccatatgtcactgatgctcataatataataaaccctcatactctaatacaacctagctccctcctcatatcttttagctttcttctctttctctcaacttttgatccaaactgtatataatttctatgttatcttcatctactataggatggaattaaattttatatgtaacggtgatagatgatcaaccatgggacaatatatatgcatggtgattgcattggaaatgagcggcgtcagaagaacacaatctcgtcagtgaatgagagcttgaagcatcttgttgagcaagaagatgggtgcctgtgagtgtatgatggtgctgtttaactcacagtatcgtcttgcacttattttcgctggcttaatggttctagctgtttctccctccatcgtaaaataagccaacctcatactaggtatgacacatcgatcctaacactataaatctggacgatgtatcacattctagtatacgatgttggtttattttgggatggagatgttagaaataatcttgttgtattaggtgatcatgtttattttgttgcatgtcatcatatataggagtagactataagttgtcagctgcatgcgttagtcgttatggcatagcgagctaatctcatgtgaagcacaaaatttggaagaatgcttaaagtagattggcagccaagtagtgcgtacgtgcatgttgggactagtctcaggattatgtggtgaattagtcttgcatgcattaaactattggagaaaccatctttggttggtcgtccaaaatccacaatagtcctggttcgaataggaaccggaactaaatattatttttagtcctggctaacaacattgttatctttaatccctgttgatgttaccaaccaagaataaatatcatttttagtctcggttcaagttatcaggtcgagtcagggccccaaatatctttagtctcggttgtttattatatcagccgggaccaaaattcaccccgagaacgcaggcctcattttgatctcggtcagtcgtcgatcttatcccctcccccttcctcattaaattaacagcctcagcccccatctcagtctcgcgttgatcttatccatctcagcctcagcctccatcgatctcagtcatatcccctctcccccttcctccccttcccctctcctccccctcccgctccccgcctcctcctctccaggcgaccgagcccaggcggcgactactggagcggcgggccgtgcggagggcggagggcggagggcggcgggtggcggcgtggccgcgctggcgggcggatgggagggcggcgggagctgccggccagcggcgccctcccctctgccgaaggggaggcgggaggcggcagcggcaactcgattttgttgttcttttttttttaagaatttgtgatatattggatttcagaatttttagaagttgtgattcgttggtctgagaacttttagatgttgtaattcattggatatgtgatgtatttcttttagaatttgagatgtattttttttaagaatttgtgatgtgaatctatgtttgtgttgatactttgattttgatttggggatatgattggggatatagggagcatcttgatttgtgccgttccaactcgatttgtgcagttacaactcgatttggaaagaaacaatgaaaaaaaaaagaaagaaatggtgaccaaccgggattggcgttgccatctttagacccggtttgtatcaccaaccgggactatagatggatgtttagtcctaggtatttcacccaggactaaagatacctatctttagtcccggattcgtacttctggttataaaactaggagtatagggggctacaaaccgagaggaaaaacgctttctctggtagtgttagttagttgcagatgcatgtgcatgcatgcatattatttggttggtgcaagcaacgacgtctgggaggactcatgttcgaatccaattaaaaacgtgaataaaattttggataaaagtggcacgcttttcaaactgctaaacagtgtgtttcgtgtaaaaactttatatatgaaagttgttctaaaatttcagattaatctattttcaagtttataataattaaaactcaattaatcacatgttattaccactcgctttgtgtgaacacttaatctttatttcaacatcatcttccgtagtggagatgcggcctgagtcaagcagttgcgatacttgtggagttttgcggccaagtaaaccggacgtgggcgtatgtgcgattagtagtatgcatggattgtaaatagctgctccttgtaatcgtttgttttgtgaagaaatagcaagagaaaaggcactagttgtatatgtgcggtgccacaaatatgctcggtactgtgttctcttcttccctgtgttcttcacgtgcaattgtgattcgtgtccactgtgttcgcgtgagttgctttgatttccaacaggagggaatatactgataggctgggatggaactgggatcatatcatacaaactaataggctggttgtacacgctatctccacttccctttgatagtaacttgtgaaacaaaatcaaacggccttgtcatgtccaacagtgcagactgaaaagcaacatatcgcatcaaattgtggaagggcctgtagccttgtggttaccagagcctcaaacctcagaagcatctgaggttctgggttcgactccccttagaaacgaattttctaggatatatcagcgttttactcatagtgattagggtccgtcctttgattattgaggtgtgtactcgttgatccgaacggccgaatgtcgaatgtaacgtcaagtagaattgcgcatgtctataaagtaattaagatattcagaaactaaaataaatatatatcatctatccatccaaatcaatagcaccattcaccaaatcaacaccttgttctattctgcaagtattaggttcagacacacgaatgtcaggcagcgattaatcgcaccagattggttaccttttacattctgttaaaaactgtaagatattcagagaaatcaaaataaaaggattcaaggaaagaaccaaaaataagagggggtggacaggatgatacatataactacacatgacaagttgctatgagattccaggtctagcattgtaaacaccagctggttggaacacgaaaacacaggaaagataaggaagggatgcatgtaagaatcgccagtgtaatacaatgcgactgtgcctaaattctgcactatcacctgatgacgctgttgtgaattaaaatagttggttctgataacaaagcaagcaaacaaaaacagttgataaagttgcccattttcatgtgatctcattacagcattgaacacccaaaccaaacaccacgtagattagttcgtacctatatatagctagagggatcaatggccttaattattttattgaatgaaaggtttgttgaaatattagctccattgatgtgttcatcgatcctgaagccttgctattttctgtttattcacatgattattttctgttgttttgaagaacaggaaggaggtcttcgtgtctttgattgagaaggaatgatggaatggacaacaaaaaaaaagagttgacattgtttacccttgctaaagaaaagttcatttagtaaatttgatgtatgaacacttgaaatcacgttagctagtaaaccatcatatactaggttgcaaaacgtactaatgattacgaattctcagagatttatctcttgaactcggtgactgaatagttttatattttcaagtatatattgacattcatcaatcgtctggaaactgctaaacgttgcccattttttctttatgtacgttttctgaacatggggttttattttagttctaaagggaacttggggtttatttcctgatcacattgttacttttatgtagaaactttatgtaactcgccttacctaacaaagatcatatataaaagatctttatcctcctaattattcactccatttacccgtctggagggtggagcagaccctagcagtgtgctctatttattcccattcttctcctagccaatattaacaatgtcttcttttaaccattcatgtacaattaacatcattctttttaatggatcaagtgttttcatcggaatgagttgcatcgggatgaagctctctgcacagcagacatattctgcagaccaagattatggacctaaatcctaaggagtggtttaaataacagtgagctgaaacagtagtgaagatcgatgcagaagttgagaagcatgtgacaaagaagatgccaaagcttaattagttggggtattgtgatgatctatcttatgcggttcctagtagaaatggactgcataaggattatctgtttcctgtttcttgagcacaaggggatcaatcgaccctccataattcttctcgtgtgtgaaaaactaaaggattgcagtcctcccataaatctgagttcatttcttgaggttcccaacgtcaactccttaatttcctagctaggcatacgcttcctggactactaagcgattcattttttataaaaaagaaatatatgaaagttattgtaaaaatttatattaatctactttttaagtttttttactaatacttgattaatcatgtgctaataaataatattgttttcaatgcatggaagaatattttcaatctctcctcccaaacatagcaagtactactctagtccgaaaaattaaggggcggagtcaagacccagccaccacgggcgagtgccagagctccgcccactgcattattacgtaccctgtttgattaacaaggaaattagtaaagttgtggagattatggataccccatatctatatgacggttgtaatttagtcggatatacggtaccaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgtgtgcctcttggggggcgattctttttccaatttatacaatcaataacacactaggcggaatcatccccagacaggagtagggtattacttcttgaataagaaggcctgaacctgtataaaattccttgtctccaaacccatccactttcctagcttgatagccacccccttttattattgccgaaatcttgcttcgacagttggcgcgccaggtaggggtagcgtcaagttctcgccgactaagtgcgatgggtttcgtttctggcatcgacgacttcgccttccctcccgggcaggtgttccggtttggcagcctcaacttcatcaccaacgacttcggcaagatctctctccttgactcggattcaaaccagtcggggagagaccaggtccccgtgccgttcggtattccgaactcggccgaggcctactccaagatcatctctcccgactcggcttcaaaccactcggacgagatccaatctactcttccgcgaccagatcaagacgacgggtcctatccctcaatcctgacgaaacttcctgatgatttggccgctgtcttcacagtcaagacatctcccactcgaagatctaagcgagctccggcttcggccccgatccgatctagatccaggaaggttggcgttatactccaacctctcgggacagtctcgacggaagagttggatggctacctcagctcctccggcgtcagttctcgaccaaccgagatcctcgactacgatgatttcggctaccactacgaccacggcgacctcgacaacttcgacgacagctatgaggataactacacgcccctcttcttcggcgtattcaaggctaacaatgaaatggaggaacagcaccaagcccgagaagcggaccaagatcgcgcacgacaagaagctgaacgtcatcgactagaggaagagcgacagcgataggagcgagaacg

SEQ ID NO: 41977 - DNA, 11961 bp, Oryza sativa
  unsure (1)..(11961): unsure at all n locations
ttcgatctcaagactatcaccagccaagcctcagcattgccggcgtcaaatctagtcgcaggagcaggggacatgatgaacggtccgttcgctcgcctcccgagcgatatagggagcgccaagtcgaacgaccacagtccccacatcgaagatgccccatcgatcttcgcgacaccatcaaccagcgccgcgcacaagaggccatcattcaccggatcgctacgacgacgacgtggacggagttgctgccttcacaagcgatctgtgtcgagtggattggccagccagctttaagccgactggaatcgagaaatatgacggcaccaccaaccctgagtcttggcttaccgtctatagtctcgcaatctgcgcagcaggaggagacagcaaagccatggcgaactatctacctgtggccctagcggattctgcccggtcatggcttcatgggctaccccgcggcacgatcggatcatgggcagagctacgcgaccacttcatcgccaacttccaaggtacttttgaacggcccggtacacacttcgatctctacaacatcgttcagaagtctggagaatctcttcgagattacattcgacgcttctctgagcaacgtaacaagatctccgacatcaccgacgatgttatcatcgccgcctttactaaaggcattcgccacgaggacctagtcggcaagttcggacgcaaacctcccaagacggtcaaacatatgtttgaaaaagccaatgagtatgccaaagccgaagatgctatcacagcgtccaagcagtcgggcaccacttggaagccaaagaaggacacgccgactgcaggagggagcggaagtaacaaccacaaggatcgcaagcgtaagcccgaagaacttgtggccacaacctctccatcttcccgacaacgtccccgcgtcaacaccttcgacaagataatgaactcccaatgtccgcatcaccccaactccaaccacgtggccaaggattgcttcgtctacaaacaatttgcggagcaatacgtgaagaacgcacgtaagccctcagacggagatcaaggcacatcaaagaagaaagatgatgaagacgatgccccgactggttttcaagatcatcgcaaagaacttaatcacatcttcggcggacccctggcttatgaatataagagaaagcagaagctaacagaacgggagatcaatgcagttcagcctaacacgccccaatacctccggtggtcagagatagcaattaaattcgaccgctcagatcatcccgaccgagtggtccacccggggcggtatcctctggtactagacccagtggttcgcaacgtcaagctccgacgaactctcatcgatggtggcagcgcactcaacatccttttcgctaagaccctggacgatatgcagattcctcgcacagaattaaagccgagtaatgcacccttccacggtgttatcccaggattgtcagctacaccacttggccatatcactcttccagttaccttcggcactcgggagaattttcgcacagaaaatgtttgtttcgaagttgctgatttcgagacagcatatcatgctatactcggacgactggctctagccaaattcgtggccgtcccacactacacctacatgatgatcaagatgcctggtcctcgaggggtcatatcactacggaacgacatcaagcaagccgtcacatgtgacaaagaaagttgcgagatggcccaaactcacgagactactctcgcccgcgaagagatccgactggctgcgaccacggcaagcgagggagaagtgcctgcaaccaagctgacgaagaccgaagaaagtgatgccaagacgaaaaagattcccttagatccctccgatcctgataagactgctgtaataggcgctgagttagattgtaaataggaaagcgcgctcatcacctttcttcagaataataaagatatttttgcgtggaaaccatccgatatgcctggtatccccagagaggtgattgagcactctttacatgttaaggaagacgccaaacccatcaagcaacgactccaccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgattataccgacctctacaaatcttgtcccaaagacccttttgggttacctcgcattgaccaggtggttgactcaacggccggctacgagttactcagcttcttggactgttactcgggatatcatcaaatccgactaaaagaatccgactgcttgaagacctcgtttattacgccctttggggcctactgctacatcaccatgccctttggattgaagaatgcaggagcgacctatcaacgcatgattcaaagatgtttttcaactcagatcggtcgtaatgttgaagcttatgttgatgatatagtcgtcaagaccaagcagaaggatgatctgattgcggatttagaagaaacctttacaagcatacgtgctttcaagatgaaactaaacccggaaaagtgcatcttcggagtaccatcagggaagttgctcggatttatggtatctcaaagaggcatacaggccaacccagagaaaatcaacgccatcctcaacatgaaaccgccaagctcccaaaaagacgtccaaaagctgactggttgcatggcggcgctcagccggttcgtctcacgactcggcgaatgggggatgcccttcttcaagctgctgaagaagactaacaatttccagtggggacccgaagcacaaaaagcctttgaagacttcaagaaacttcttaccactccaccagttttggcctcaccacatccaccagagccgctactgttatatgtgtcggcgacctcccaggttgtgagtacggtcctggttgtcgagcgtgaagaggaaggccatattcaaaaagtccaacgaccaatttattttgtcagcgaggttttagccgactccaagacaaggtatcctcaggttcaaaagttattatatggtgtcttaattaccatcaggaaattatctcactactttcaaagtcactcggtcacggtggtcacatcgtttccactcggggatatacttcataatcgcgaagcaaacagacggattgcgaagtgggccttagaattgatgtctttggacatatcgttcaaaccacgaacttcgatcaagtcacaagctttagctgatttccttgccgagtggaccgagtgccaagaagacatgccagaggaaaagatggaatattggactatgcattttgatgggtcgaagaggcttacaggcactggagctggggttgttttaatctccccgactggagaaagattgagctacgtattgtggatacatttttctgcgtcccataatgtggcggaatacgaggcgctactccatggactaaggattgcaatatctctaagtattcgccgactaatcgtccgtggatactctcagttggttgtcaatcaagtcatgaaagagtggtcatgtctagatgataatatgaccgcttatcgacaagaggtacgcaagttggaaaataaattcgatggactcgagctcacccatgtcctccgacataacaatgaggcagccgacagactggccaattttggttcaaaacgggaagcagctccttcagatgtgtttgtcgaacacctttacgaaccgaccgtgcccagaaaagagacagtcgaagccatggatattcaaggcgtaagcatgatcgaagccgactggagagaaccgtttataaaatttttgagcaaacaagaactacctcaagacgaaaatgaagccgagcggatttccaggcgcagtagactttacattattcatgagactgagctgtacaagaaaagtccgtcaggaatactgcagcgctgtgtgtctttggaagaagggagacagttgttgaaggatatacattctggtatttgtggtaaccatgccgctgcacggaccattatcggcaaagcttaccggcaaggttttttctagcctacagcggtgtccgacgctgacaagattgtgcgaacatgcgaaggttgtcaattttttgccagacaaattcatttgccagcccaagagttgcaaaccatcccgttgttctggccatttgcggtctgggggcttgacatggtcggcccgtttaaaagggtagtcggtggttacacgcatctctttgtggctatcgacaaattctccaagtggattgaggctaaaccggtcatcacgatcacaacagataaagttagagattttttcatcaacattgtgcatcggtttggggtacctaatcggatcatcactgacaatggcactcaattcactggcggagcatttaaagacttttgtgaagacttcggcattaaaattttttacgcctccgtggcgcaccctatgaataacggacaagtcgagcgcgctaacggcatgatattgcaagggatcaaagcacgagtttttgaccgactacgtccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggccgagtagatgacatcaaccgactagaagaagcccgagaagcagctttaattcagtcgactcgatatttgcaagggttacgccgttatcataatcggaatgttcgatcgcgagcctttttagtcggtgacctggttctgaggaaaattcaaacaacacaggatcggcataaattatctcccttatgggaaggacagttcataattgctgaagtcactcggccaggttcttatcgactcaagcgcgaagacggtactctcatcaacaattcttggaatattgaacaccttcgtcgattttatgcttaggcatttcgcttgtatctttcctatttgactgctaacttcaagtttctccttgaagttttcagtcagggggctattatgatagtaatggagtgtgatttttatcaattcaatttgcttacttgatttatcattgccctgtttggtctttcgacttagccaatgaggactgaaggtttttaatagcttttgcgggttttaggctcaataaggcttgacaaaggcttttaagaaatcagaagctaagtatggaacaccaagcatagcataaattcatcagtattgtacaaattgagcctccaccgtcattgatcatcaaaatcattgttatatcaatcagtatcagttttttcatcatcagacttattagacccagtcggccgaaggtcgacatattggaatctctcaactacatcagcagcaatcttgtcagccgctttctgcgcatcattgatgaggtcaagagcagcttctttgctcgtcccgtctgcaaagccatcaatggcatcaatgtcaactcttggataaagggatttggtcatcgccaatgccagacttgctcccatacttccagcttctttgatgttcttgaagtaagtatctggagcgactctcagcttgtcgaagatttcggcagcatcaagtgtactcgaaccggcgttattgaagaacatggcctggataagtggagtagcggcattagcgactttatccctggctccttcaagcttgttgatcttgtcaactaagacatcaaattgtgcttgagacttgatcttgcggtctgcgtcaacagattcacattaatgaatcagcatgtagaagataatggcttttgaagtattgattattggtaccttcaacctcctttaaagccgaatccctctgtcttgccagctctgccttgtcattttccagagtttggatatgcttctctagttgagatatcttggcagcttgcactacattaacttcggttaatcaaggttacaaagataacagcacaaattagttgggcagagtttgcgcgaaccttttgatgagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcggttttcgcctcgttcctaagatgaatcctctgcggagcagtttaatcagcgctcgagctagacagtaaacaagatggctgaggtcaggcatcaaagaaacttacatttacaatgcgagtcgcttggttgagtccctttttcagcaggcatacctcttcgtcttctttttgccggtttattacaattccttgaggttgcaagttgtcatcccaccacttgaccagaataggagggcacgaatcttcggttgcttatatacggggaatttcttcttcatcatcgatcattggtcctaatgcatccaatgacaaaggttagacaatcgatcagagttatttgggtcaacatggtttcggacaaagtgtttacctgtaatgatttcaggacgaggacgagtggattcggatacttttaaaggggatccagatctccggtcattgctggcgtcttgtccgcgagggttgtttgcttgggtttcgacttctggaatctcttggcttggccctgcgtccgactggtttccagtcgggggatcttgattaactccggcttcggcttcggccaactggattccagtcgggggttggtcactggattctacattatcggttgccggttgattgtcactcggatgatcctcagcagttggctcagtttctttggaagaacttgtgtccacgttagttgggtcagagtctttcccagacggatctatatcagatggcttcctgcaaatttgattatcagtattattgccgcaatgggtgcgcatcaatgcaagagaggtcgttatatgagttgcacctagaagacttcctgatctttggcacagggcgactggatgttttcttccttggagtagcctgttttggtagtttcttggttgtctctcggtctccaggcctcctggcggtatcatcggcttcgtcgtcacttagaaccagcttcttctttcgagaatctgactggccgattggatcagaagcacttggttgagtttcagaccgaattcttggtcctccgctcccttgcccagtttgatggcggggcgatcggcgttgagcgattgggggatccgacttcatcaaagcaaattcctgggtgtaatatccttcattgttaactgattcaacaagaaagcaagatcatattttgagaaaggttgaagtgtatgaatacgtaccagtggaggaggattgaatgcattgaacggtatgactggcagcaagtgagagtagctaacaacgatggcgtttgagaagatcttatacatcctttccttcatgaccttgaagtcaagagaatctggatcttcacggtttggatcatgcttgccgtcaaattcgaaggctgtgcgagatctttctttgattagagctaaccgacacttgataaagtgccgggtgatctgttttccttgaaggccctgatctttcagcttaatcatcctctcgatcagttctactgcttgtgcagcttcgtctcccattggcagtgaattccaagtatcccgataaactggaggaagacaggagtactcgggaagaacaggctcggggttttgaacataaaaccaatttgcgtgccagcctttatttgaggtcttgaagggcatggagaagtatttttggcttagtgttcccctgagttggaaaccagcacccccaacgacgcatggtttactcttgtttggttggggcttgaggaagaagatgcggcggaacaaggcgaaatgaggcctaatgcccagaaaagcttcgcaggcatgaataaagttggcaatatgcactatggagtttggattcagatgatgcaagctaatcccgtagaagttcagaattccccggaaaaatcttaaggttggaagagaaaatccgccgtagaagaaatgagcaaataccacgatttcgtgtgtatcgggtgttggaaatgcctcaccaaatgccggttgccacccgatgatctcttttgctggaagaacgccgtgcgccaccatctccttcagattgtcttccgtcacatcggagggcgcccactgactcttgaagctttctctttcttccgccatgaatgtgaactggatggtctgatttagttcgagatacggctggaaagggatggggaatttgagcggtggatacggggagaaatttcgtgaagattttgaggagggattggagcggattgatgaaccctagtttggccggcgcagttttgcactgtagcaggaaatggggaaaatggcgagagtctcggcggggaagacgaagagacgagtttcacttcggtattattagggtatcgggagtactaatgggcctgggcctgtacagtacttcagcccaatactataatcagcgtggcctgttgtgatccctagggacttaggcactttttgctttggcgatttgtgttcacaatggtgtggcccaatgctgttaaaatcctttttaacacgattcaataattcttgggaattattatgatgcacataaaaaggtgcccgacagaaaggtgttataccgtttttgtaagctttgttaggctgcaaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagattcttactcggattcctatcaaacatgtttatttttggacctttgagtgtttatcactcggcccttcttgtattttttgtccttgatatattcaagttgagaagcagtcggctgggtatcttactaagtaccattcgtgcttcgctataaaaccactcggttcttgactatatgtttagtttttcaactaatcacatactcgggggctacacctaattaggtgcatctactcgatgcaccatgttttattttcgcccttcacagtttttaatttttagcactcggcaagctggagcaagttgaattgaagcactcggactactgtttttttgtttcgagaaggctattttgtcaactgcgaaggtctcgggggctactgtggagattatggataccccatatctacatgacggttgtaatttagtcggatatacggtactaaatatagatggaatatctctatgaagattcgggttaggttctaaacttgtatgtcaaggaaatacccgggatcttagtcggttacgattgtattttatctataatcccatattctattaggatatggactgtattttgtaaagcggactcctttccctatataagagggtccgtgtgcctcttggggggcgattccttttccattttatacaatcaataacacactcggcggaatcatccccggataggagtagggtattacttcttgaataagaaggcctgaacctgtataaaatttcttatctccaaacccatccactttcctagcttgatagccacccccttttattattgtcgaaatcttgcttcgacaaaagtaattaaggccatcgcagaaatatattagtctagcccatgctacattaattgatcacgttggttttacccaacagcacggtatagataaatcataaatggtctatataattatatagattatatgtatgcttgttatctcgttatatttgttcagctaaaagatttctagaaccgccaatcgtaatattatagcatcactggcagaattgaaataattcacccccaaaattttgtttttggcttcttaatctgaaaataggaagtgaaaaaaataatctcttcaagaaaaaactttaatttaatttgaaaaactaaaagtgagctattctgttaaactaccaaaaaaggctcgcttcccctcgtatcagacaatttcagggtagggaactccaaaaatcatgcaaaagaataaagtatctggtgaagtagttttttttaaactaaaatccctcaaattggttttagaaataaaataggagtactgttggtgatattcttagataatatcccatcctaaaactccgaagctacatttatggacagatatactagctattaatattctcgtagccacctagagatgctaacctcctgaaacaatcctacgacatgatctggtattagcgacatatcactgcatcagtgctacatacagttccagcaaggaaatcccagaaccatttcttcacgatgcacttgcagaatccaacgaatcagcattcttacatctcgcagtacctcccaatcccatgcaaagatagttaccaacaattagggccaacaaatgaactgactaaaggaaagagttctgaacttaattgtgattgatcttctcgtctgctagctggtaatgatatgtctgccaatcacccgaatcagaaatcgatgcatctgattcaattggctaggctcagatatatctccaaaacttattcaggactcgagttgaatgcacagctaagcagtagcttaacacttgcagcatgcagtgatgggaaaataagaaaaataaaatgagacttgtaataataagggataggtgatcgggcaagaagagcagaaggtgtgtatctgtgggtagtgaatgttcagagcagagaagacagcaggtcaatgtcccacccccccccccccccgccccaaccaaaaaaaaggttttttttttcagaactttatatcaaggacaaactgcatgaagtattgaggatacggatccgtatcatatacaccatccggtcataaatacttaatatttagaacaaaatttgacttgaaattttacagctagcactcaagagttactaagaggtacccgtagctcctagtaccaaacacaacgagaggtaaaatgtggtacctccagaccgtaaaatctctcacttacaaactttgactatcaattttgtattagaatatctaataagtttttataccatgataatactttttcaaggcaaaactaagcatatatactatttttttcctttttaaaatgagcattagaaaaactaatgatagttaaagtttcaaaagttctgactctatatatcatgaccattgtataagaccaaaatgacaaatctgagctaattatttattcattcatttattttttgcaaaacgtaagcacaaaagaaagctaattaaacactgcgttggtcactacctgatcaatctcatatcaacatacatttctgagaggattttactgtgcttgagaggtacccaggtacctcctaaatgaattaatatgcacctttgatttcgaaaggataatctagaaacaacaaataatattaataatggtagcttagtaattccttaaacctcaattccccatctgttggctagcagcatcctatactaatatgatcactaacccaatccatctgtgtctaacccggaaaaatatatggtgcaaagtacatatgtagtggaaacctgaaaactaccgttggatcgaaaaatagacgtctgatatttgtctatgtcatcacgagtaaaaattttgctatgagtaaaattttaaccgtgacattgacgaatctcggacatctatttttgatccaacggtaattttnnnnnnnnnnnnnnnnnnnnnnnnnnnnnnnnnnnnnnnnnnnnnnnnnnnnnnnnnnnnnnnnnnnnnnn

SEQ ID NO: 41978 - DNA, 9903 bp, Oryza sativa
  unsure (1)..(9903): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatttctgctggtttgtttgcggcaatgaggctgacgacgcgttaatcattttgggtgacgttaccagctgacgtatgtgatcttcatcttgtgttccaagtttcaaaagcttcgctcgatcttgagcttttgatatatcgtggctctcaattagctcttgctgactggcagctctaaatcaacgagcacaagcttgttggctatagctcttatcctcttggcctcttggcgagcaaaatatatctaatcttagccgtttagtgataaaatcctttcaaaagtagtagatgtaaatcctcaatcaagaaaaagtaacgaaaattaacccaaaatcaaggcaaatcgatcgatttgtaggcaacgcaaaaacagatactccgctctaagtagtaggagaatcttctagtatagggcgtggagctagcatggaacaattcgaagaaattaatcaagaaaccggaaactaaccaattatgtaattaacaacaaaatccatcacaagaagagcaaaaaaaaaagctgcagaagcagcaaaagtaattcatataattggttgaggaattattagagaatactactcacatattgttgagtacccagctgcgcacggcgtgcctcgcctgatatgatccagcaaacgatccgccgccgccgccatcggaagcgagaacgacgacagagcaagaggtcgagctagcgtgcaaatggccgcagtgttgctggcacgcggcaatagtcgaggcggcggagtcaacctactaggtaggtagtgtggtctcaactctctctagggcagacgatagctgtggttgcagagctggtggtcgtggtgggcgagatagatgactaatttgcagctagccgcgcgtgtgggccgccgcgcgaccaccccgcgttttccatttcggcccaggtgacgccggaccgtgcgcctccactttccgtcttgggttttcttatttcagcccagctcgcgcgatcagttcagcccatctgtctaaattttgtatacatatggatataaactttgaatttataagtatacaaactttgcatatgtctttacattttttatacatcaaaagtatgcgtatacataaaatacactcacacacacatatacacgtatgatatgtgcatctgcttcctccgcacgccaccaccttaatttgctccctgtacagtgtcaccaccgctactcccttcgcacaagcaccgccccttctacctccgcgccgtcgctccctttatctctcgacatgtcagttgctttatctctcgacatgtcagttgctgcttctccctcaacgtgcctccatccttgctccctccgtatgtgtcgtcgctttcgctgctccctctgcgtgccgccacccctgctacctccgcacacactgcctccgcgccgctctctccgctcaccgccaccccttctcgctccgtgcgccaacggcaccgctccctcctcctgacctattcattgctacttctcccttcgcacacatcgttgtcgctcctactctctccacgtgtgccgccgcccccttctccctccacatgcaggtgacgtcgctccctcgttccccgcccgtccgctacaccagcctcccaatatgaaaggggatgagaagaaagttggagataggattgttgtgtactcatgggcattttggtacttttggctaataaatacatgctttttttttgtttttttatatacaaaaccttaacgtgtaatggaaacacggtcaaatgataacttcaattttaaaaaataggatcaaatgcaaacatgaaaatgtgaggttagattggtagaataaggtcaaataagcaattatcctaatttattattcttcttagagaaaggtacctgaactaatttaatggttcacttagcccactaaagttttttttttgccttatcttacccctaaactgttaaaaatgtttcactttgctccttaataacatgtacattttcttacccgtcatacaagttgcattttaagctaaaatgtaccagcggtattttaagctaaaatttgttaggagccatagatggcaccattaacgaagttcaaaagtattttcaaattttttttcatcgatgtttgcttgaacttaattttgatgtttgaatcactttcaacctaagtaaacagtgagaattctttttttacaaaaaatgttgaaacctaaattgtgaacgcatctatgttctaccaaatttccagagcaaaattgacttagatagagagagtaaaaaatactgctaggggggttcgaggtgtaaaatgagaaaaaaaagtttaggtggttaagtgctatgatgaaatggttacttttttttcttactctttattacgagccacctatcttgtcgtcatctagtccaccactgttctcacaaattaaggattattaaagcctattagaaacatatattgtttgtatggactttgggattaattagttagtaaacaaatgttaaaaaataatgtaaggttatactctctccgtcccaaaatataataagtggctattaaggagagaggtaaaagaataatgcatggttgcctctccttgggatgaatggagtatagccgtataggcctggacaaattggggctataacaaagggataatatggttaatttagtggtaaaagtcacattttataatactgggttgctttatttgggataaggtttaaactattttatgatgcaaggagcagtatttttccaatgccctagctaagctagggcctattctttttagatgacgcagcatattctgataatataagataacttacttataacaatgaattaaatattacattatagagttaacaaatagcttcaaaaagttaccaagcaaggctaatgaataattatttttctggagcattgtactttgaagcatggcaccaataatgatgtattgataatcagccccagttaattagctcattccaacagggcagtcattcagagccacaggcaaatcttcccaaaatataagaccatgaaacgtcaggacaacaacaatgaaggaatagaagtaaaaggaaaaaaaaaaggatcgatatttgaaccttggagccctagactttaattagtaatccatataagagctaagtgtataggttgacaaggaattaaaatacttaaaaagaaacatacaaaatatgtgaaaaaacaaatttccaaaaactatgtcgaattcaagctgggagtgctaaaattgacaaaaatggttcctaaacttcctatcgtccgttcgacaagaagcccaaatcccaaacgctttaactaggcgggtctcaccgaatctttatctactcaccaaacaccatcaacacatatatttctccaccacacactccaatcttatcccatctctcccttatctctctccactacaacactacctcatcacgagcagcgacagggctcttgtcctcgacggctatctccttagcttactcaagggcagcttggtcagcctcggcttcctcaacgacaacgtggcataacatcagcggtcacttgttcccaacagctacgcgatgagcttgaacttggcttccacaatgatccatgctttcatcaagtgtggcgccgcataattgcagcatactagtgtcgagttcggcgacagtcagtcactggagaggagaaataagtactttagactgtttttttttatgtttcagccaatatgtttttgatgttcctttgtattggatcaaaatcttgcagtgaggttttttgtattgtttcatattctgtccttgaagagtgagattcgtggatgtttcaaacgctacactaaaatgttttaccatatgattcaattatgtttcaccaaaatacacaatgattatagcactttgcctttgcttaagcattggagtatttatgtactccctaccattgcatgtggctgcaaggtcagtaatcacagtaacctactctactagaaaatgcatttttcccgacgtggaggtcttattttcacagtcggacatgactcttggagccaaatgaccgtctaaaaaaaatataaatcggcatgacgttcgctgtccgcctgcgaaaatctattttcgcacgcgcctctattttcacaggcacaccttatgtggtctgcctgcagaaatagtacctaccaaaaaaatctagtcatcctcatccgtatcctctcctccaccatccttatcctctcctctccaccactcgtttcccttccccttctctctctctctctctcccccacacttagaagaatcgcccggctccctcctctcccacgtccacgcgccgccgcctccctcctcgacgacgacgacgaccgcgacgccgccgacggctccatccactctagatccgcgtgctgccggctccctcctctcccacgtccgcgccgctggctccctccaggacgacatttgcgcgccgccgcatccctcctcaccgccggtggcctccctcctcgacgacgatgacgacgactgcgacgacgccgacggctccctcctctcccacgtccgcgccgccggcgccctccatgacgacgtccgcgcgctgccgcatccctcctcgccgccggcggcctccctcctcgacgacgacgacgaccgcgacgccgccgacagctccctccgctctagatccgcgcgccgccgacagctccctccgctctagatccgcgcgccgccagctctctcctctcccacgtccgcgtcgccggctccctccacgacgacgtccgcacgccgccgcatccctccgccgctggccacgacgagcgacgacgacggctccagatccgcgcgccgccggcttccctcctcgccgcctccgccggccacttcctctcctcccctccgtccgctgccgtcggcgcccgtggtgaggccggcggcggcgccccatggttttttttattttcctgagatgattttcacagccgggctgtggcccgcctgcgaaaatggtctattttcacagtcgagatggtagcggcggtcctctcctccgcctgcgaaaatggttttggaccgcctggaaaaatcttttttctagtagtgctaatctactgctgcatggacggtggagcccgggcaactgcccgtggtggccaggtcctggctccgccaacataacacaagctttttttttttcttttttcgcgatcgatcacacatgaaaattgaaaaggcagaattatgcatttttcatattagttttgttaacgtaaatctatgcaatttgatccctgttgccagctatttctgaaaggattccatggttataatcatgaaaatgatcctgcactggtccatactttttttctttggtctcaatcctgcacaatagtttctttacagagttttcctcctgacaaaagaaaatgatatataaaactggcacaatttattgacatttgcatcataattggttagtgccctaatggcaagtgttctactcaagggactgtcctgagtattaacttaagaaactctgaagttgccatcgattgcaactgttcatagtgaccacattcttaagttaatacatcatgagtttgttatatttctttccacttctctatatgtataaaaaaaatagtgttctctgaccatgcttttttgcgattatctgacaatatataaacaatgtaatgttttctgaagacatttgtatctctgtatccctctcccccatcctttttgttctgtggggtggatggatgggcctatcaaaaggttgttccattatcatttgaatgcacctataataagaactaacaattggcaaacaacagttttccttcagaactagggactgttgtttcaatccaaaaatagtcatagttttactgccatgtctcttatagcttttgctgctgtgcgactagcccatcatgatgatctgacttacaatgcttgtgtctcttgctcttgatctccttctatcagtcactctaggtgcagctaatttctgttcgtctcctgacatttctagggatgcaagatatcgaagatcgatggaaattgctgccgcctacaaggtgcaagaaatcatcacatccggcatttaagtgtgtgaaagactggttctgatttttttttttgctttgttgtgtttcttctctgtgccatagctagaagctagactgaaaacaactatggtatttttaggcttttttatcttagtgaattcatgtaaaaatatttagttatggttctatccagtttttgatggttgttcttgaagggtactagttactatttttagcaggagtgccataggagctaatttagctaaacttgttgcatcggttaataacaccatcgaatatttcatttgccaaccttttgtagacctgaattttgaaaaccaattagaaagtagacacgggctataatgagcgcctcttggcgcgctaattttttaagtatatcagtgcattcacatagtactcgatttttttaaataaatgttttgattcgtgcatgaatcactgttttgcagccataccacaagctgacttaaaaattgcaaattgctgaaaggtacaatcgtataagaaacaaaatgattttcacatcacttcgcaaactacattttttccctacaaccaccggaactcaatatagttcctacgcagcttcatcattcataacagaacaactagcaagttcaattcaatttaaagagatcgaatggtgattcacactctaaagcaaacttagactaaaaattaatagtatctttaaagattaaccttaagggtaaaaaaatctgcaatccctgcaaacaataatgcttgcttcaatatggtatacttagtcatatacatggacattctccaataaaacattttgttttttttgacgcaaataataaaacattttgtaatctacagctcataactcaaaccatattgaccatctcatgaaaagtcacattacacatcacaaattaattccagccacaacttttagttcatgtgctcacctattggatttgcatgaaaggggcagggctgagtagcaaattgacgcacagtaacagcagatgcagatccagtagagtgaagggagcaggattttagtgggaatcaactttcgtaactgtggcatttggggagttcatataattctaaactaacatggtaggttgtctgtagctcatatacaaataatctgcacccaaaccagtgccaaaatatacgaacaaatgcagaaattcgcttaggcaatactgcaaacaccttaagtgcgcaaaaaactgaagtaaatttaaacgatgtaaatggagaggaatgaacctgcagatgtcacagtgttcagtgcagatgtcgatggtggcaccgcgatgggcagaaggcgggcgggccgcagggcgctcgacggcggcgagtctctcccacgagctaggtcaccgggcggcgctacggcgcatcgatgggcaatgccgcagcgggcgacggtcggccgtcgacaaaatgcctccaaatgctgtacatcctgtagtgtctgaggatggtaggtgggtttggccaccaaccaggcaaaaccacacaattcccccatccttggccttgcgcttgcgcattagggtgagccaaaaagaaattaaaaaaaaaaacaactgaggtttctttccctcaacacataaatacccgacaatgccctagccgctcgacgttcataccgcagcatagagcacacgcttggtgtcgcggcggcggattgatggcagggaagacggatatcatccgcgatatcatcggcggctgggtggtggacgagacgtgcgtatatatttttgtctactactacattccctgattacagaattttctgtgttggagttagttttcttcttcttcttcttcttcttcttcttcttcttccaggtttggttttgctcttgtgattgatgggatttccgaggtacatcggtttccggtttccgagtaatcgctctactattttaggtcgactacgatcttggggataattacattgcttccttttttcttgatgatagagggtctatgtgaatgctgctatactatgaatatgattaacgtggacaacggctgatggatttgattcgatgcgagcggccgttgacatgtgggccccactccaacaatgactaaggttgctcattttggcccaggtcatcgtgaggcccattaagcccatctgcccacgttgtgatgcccagatgccctagttgcaaccgccgccgccgccatctctgcggcggtgtccggattcttcttcttcttcttcttccctcgtcatccgggaacgcggcgaggaggcggcctggctacaggacgtcttcttcttccctctcgtcttccccctcttctccaaccttctcttcacgggccaaaaaaaatctttggtaattggtacggtccgccatgcgggcggtgccttgtcgagctcggaagacggcatgagtgctgtaatattggttggattcagttatgaaattaagtagtactgaataatgagattcgggttggatcaaatttattcgaacgggatcggttttgttcttttgtttttggaaagaaccgaatagtttctttttaactatttcctcattttaaagaacggtattatgcgattcaaatcaaatctacgcaagtcaaaatttcaacaaccagttgcgtcaacatgctttttgtctggttaaaagaactgaaagtacgtactatgctttttctctgctttgatgtgtgatcttagtccttttgttcctttcttgttattctctgaatttctcctgtccgtattctaaattggaaaattgcattgatcatgagcagtttgcgttgtgtgtcacaaaatcatgaggattcaattaattacttgttcatgagggtggtgtatatgccattgtgatttagctttctgaggattcaattaatctctcatttaggggataagaggatagattctgaaaatatataagatggcacctggatgtcattgtgatttagcttttaattaatctctcatttaggggataagtggatagattctggaaatatataagatgacaccttgatgtcattgtgaagctttaacattttttttaaggtatttagcttttacttcgatctgaatttctaaacccaccatttttttcgtttgtgttcaaccagagatgcggcattggctggacttcgtgtggcagagcgtgcctattggaaggaatttgtggacagagtattgaaagataccagcagcattgatataactgcgtcaaatatagctgttcccacaaggctacctgtcgagctgcaagtcctgatcaaggttatgatccaccagattcttaacactcagcctggagcaatccctccactagcatttcattggtgttgcaatcagcttcttcagcatttggtgaattcagtaagaacccaaggacagccaactgttgaaccaaatgtacatggacatcaacgttgcaggggtgcaggttggtcatcggggattcccgaacgattggccgatcgaaatgtttcagaagatggaggtattggaggagttgattcgaggaggaacattagagagatgaatggtaaaattaaagagacaaatgcaagtcgtgagtcaccccgaat

SEQ ID NO: 41979 - DNA, 1928 bp, Oryza sativa
gatcagtatcaccggtcacaaacatggtgggacagtgatcaaattcagctacaatgcagtgtctcttgcacaagacatggagctaccatttgcagcatacggaacgtctcctctcaagccggcgaagctatttgtcccagctgattatcctcgaagctccccggtgtacgaagatggtgatgaacagcaccagggaatgtacagcgtgatttcaggcatggttgacaaggtgttccagcgtgccctgcgtaaactcccggtgccaatgtcgatcagggacatggcccggcagtggggcatctccgtgcgaacggtcaccaacggtggaggaacgttcagctccgggtatggccagtgggagagttgcaccgatgagtttgcaagtccatagtccatggatagacccatgaagttttgcaggaacaagtgatatgaagaataatgctgatctgctgttttgctgtagggcagatgcagaatccagtgtgagtgttgtgagagaatatttatatttttgttatgcattaagaggctgtgtggatcatctgtttttgattaaaccggttttgcttaaaaaatatttcttactacggttgtgaattgtgatatttatctgtttggactgtgtaattggaatgagcgaatttgctagtaaaacatgttttctgaaaactggttcgtatcttttaagatccaaacaaccacttagagtttttattggcaaatactttggtcgttaatcttgcacgtgcaggcttatgcaattattgtgcaacagttcatttcatacttcatactccgggcaagtagtatgaactgaaatgttgcaacgggcttatgcaagtagtatatatatgttcgtctgaaaatttttcacaggaattgaactgttttagttcgatgcaacaagatggaagtctgcaatgcatccgggtctgacattttatttgccacattctgcttgacacatggagttcctcatacagatgttcttcggctgcgtctgacaaagtttagcaaactgaaaagtgaacttatgcctatttagaagcgcacatatctcaaacaaattttgtgggcctcatcgtttgccctatatagaatcaactactactgccaaagtttaatttttaaaacttaattttgaagctttttcattgaaatttttagaattaccttttaagtcgttaaaaacatagagtatataaaagtttttacctataatttttagtccctccggacaacattattttttgtgaacaggctgtacggcgtattctcagtatatagtttttaagcagaagtttcagtctgatttctccatgaacctgcaagaaagaaaaatgcggaagtactgtccttaaccatggaatcctttcagaaataactggcaacagggatcaacttgcatagatttacgttaacaaaactaatatgaaaaatgcataattcttctatttccaagaggtaaagtgtttcattttaattttcatgtgtgatcgatcgaaaaaaaaaaagaagcttgtgttatgttggtggagccaggacctggccaccatggcagttgcccgggctccaccgtccatgcagcagtagattaggatttaattactgtgattactgaccttgcagccacatggagtacataaatacaatgcttaagcaaaggcaaagtgctataatcattgtgtattttggtgaaacataattgaatcatatggtaaaacattttggtgtagcgtttgaaacgtcaagtttcaattgttgaaacatccacgcagggacagatccagaacaaaaaatggggggagggggctcaattacacggtttctttaacctccagttatataggaacctttagtttattattcatggtgaaaaaactaaaggggtactccgggggtatccatagatcttgtgggtgtag

SEQ ID NO: 41980 - DNA, 17936 bp, Oryza sativa
ctgcacccacgttgcatccgcccctgcatccacgaatctcactcttcaaagacatagaatatgaaaaaaaaaactcactgcaagattctgatccaataccaaggaacatcgaaaacatattggctgaagcataaaaaaaaagtctgaactacttatttctcctctccagtaacagaccgacgccagaatcgatactagtttggtacaaccatgcggcgccacacttgatgaaagcaaggatcatcgtggatgccaagttcaagctcgtcgtgttgccgttgtaaacaagtggccgctgatgttgtgacacgttgtcattgaggaagccgaggctgaccgagctgcccttgagtaagctaaggagattatcatcgaggacaagagccccgtcgctgctcgtgatgaggtagtgttgtagtggagagagataagggagagagagagaggatacgattggagtgtggtgtggagaaatagatgggttgatggtgtttggtgagtagataaagatgaaggagaaggattcggtgggacccacctagttgaagcatttgggatttgggcttctcgttaaacggacgataggaaccatttttgtcaattttagcactatcaacttgaattcgacatagtttttggaaatttgttttttcacatattttttatgtttctttttaagtattttaattccttctcaacctatacacttagctcttatatggattactaataaagtctagggctccaaggttcaaatatcgatcctttttttccttttacttctattccttcattgttgttgtcctgacgtttcatggtcttatattttgggaagatttgcctgtggctctgaatgactgccctgttggaatgagctaaccggggcaaattatcaatacatcattattggtcccatgcttcaaagtacaatactccggaaaaataattattcattagccttgcttggtaactttttgaagctgtttgttaactctataatgtaatatttaattcattgttataagtaaattatcttatattatcagaatatgctgcgtcatctaaaaataataggccctagcttagctagggcattggaaaaacactgctccttgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcaggaggctggcgtagtggacgggcggggaacgagggagcgacgtcacctgcatgtggagggagaagagggcggcggcacacgtggagggagtaggggcgacgacgatgtgtgtgaagggagaagcagcaatgaactggtcaggagaaggagggagcgacgtcaccggcgcgcggagatagaaggggcggcgctcgtgcgaagggagcagcggtggtgacactgcgcacagagggagcaaattaaggtggtggcgtgcggaggaagcagatgcacatatcatacgtgtatatgtgtgtgtgagtgtattttatatatacgcatacttttgatgtataaaaaatgtaaacacgtatgcaaagtttgtatatttagagattcaaaaagtttatataagtatgtatataaaatttagacagatgggctgaactgatctcgcgggctgggctgaaaaaagaaaacccaagacggaaagtggacgcgcgcggtctggcgtcacctgggccgaaatggaaaacgcggggtggtggtcgcgcggctagctgcaaattagctatctcgcccaccacgaccagctctgcaatgtaaccacagctatcgtctgccctagagagagttgagaccacgctgcctagtaggttgactccgccgcctcgaccagcaacgctgccgccatttgcacacgctagctcgacctcttgctctgttgtcgtcgttctcgcttccgatggcggctgcaggcggcggatcgttgctggatcagtcgaggcacgccatgcgcagctgggtactcaagaatatgtgagtagtatttctctaataatccctcatccaattatgtgaattacttttgctgcttctgcagctttttttcccgctgttcttgtgatgaattttgttgttgcataattattggtttctttccagtttcttgattaattccttcgaattgttccatgctagctccacgccctatactagaagattctcctactacttagagcggagtatctgtttttgcgttgcctacaaatcgatcgatttgccttgattttgggttaattttcgttactttttcttgattgaggatttacatctactacttttgaaaggatttttatcactaaacggctaagattagatatattttgctcgccaggagggtagttaagagctatagccaacaagcttgtgctcgttgatttagagctgccagcaagagctaattgatcaaaagctcaagatcgagcgaggcttttgaaacttggaacgcaagatgtagatcacatacctcagctggtaacgtcacccaaaatgattaacgcgtcagcctcattgctgcaaacaaattaaaccagcagaaattaatcaagcttgtgctcgtggacggccggatcgcagtgaagcaggaacgcttcgatcggacggtgcatgttgcggcatagctagcaagctcgcgcgatcggtgggatgagaagaacgcgtagtaggttaccaaacactacggctttctagttttatacatataataatgattctctctcggctgcatcgtcttagtactagctattttcttctttcctctccttcctatgcataataaaaaaaaaactgttatgcctatgaatattactggcatgtgatcagtaggtgggggcttttcataaaagtttagcaaggacagagatttattataattaatgctatactactatgtgtgttaacataatcgtaaaatttgtgatgctatgtgtactgtagaacgcgcgctaaaagaatatgaaagctgaattagatatgtggtttgacttggaaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctaggaaaaagctcggagtatctagtatttgctaaaatatttctaactttaatcctttcaaaataataaaaattcaatggtgtatttgatggcgagcctgggcggctgcccgtgcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatcttgtttctcaagctacaattaatggtggatcctagcgggcgcgctctctctctctgggtcatgaatcttctgatagaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgctaatagaacgctctgttttccgtgtgtgggttatgggttcccaacacccaccactgaacacaacctaaatgttccctactacataaaagcacgtacagaccggcactataggtgccgtggaagtgctaaaactggcacctatagatctttttcacctctgcaagctgaaaacacaaaaaaaaccgataccaatatatagttgctagataattaaagaaccgacacttataatatattataggtgcgtataaaaactgagcagagctaagctgttggtccttatcctcttgaggcagataaggggaggaggactcggtctctccccggtctcctctctctcccggtctctctctcgctctcctctctctgtctctctctctatctatcgatctctctctttgtcgcttaaagtcaacaaatagttgcatcaaaagctttaattttgtctgctttgatgtatgatctcagtcctttacttccttctggattgcttcagtacttcctttgaaattggaaaattgcattgagcgtgtgtggtgatacattctgtgtgtaacaaaatcacgtgtttatgaggaatcatttaattacttgttcatcaggcaggtatagacatagtaggaacaggttctggaaacatatacatgacactaggtaggatctcattgtggcatcaattttttttgtcgacatttatctgaatttctgaaccctattctttttgttcaatcagagagaaattggcaggacattatggtgcagagttcaactctttgcgggcatttgaggacagggtattcaatgagaccagcagcattgatgattatatttctaaaatatcaacgaagatggctattttggagcgaccgcagtcttcttcaggtatgcagcatcaagggcagatgggaaatcaaacgaggctgcctactacagttatgcaagaacagccacagccacagcagcagccgcatttgatgtcaaataatcatcaccaaacacatggaggatggcagagcaatgttgcaagggtacagatgatcactggtgttggagaagtgaattggagggaggaaatgtttcagaagatcagcgttttaaagaactctttcttttccgagcttacggattttgaccgtttacttcacaattgcaaaaaacagaagaacagttgcagtcactacctaaaaagcaagctgaccaatacaagcggataacaaagctcaaggatgcggttaggagtgctctggatttattgcagctccagaagagcagcatcgatgaaggcatgaaggtgaaattctgcaagtacgaaagctccatacatagcctactcagattctacagggaaacaaaagctaaaattaatgagatgaatgcaaatcgtcataacaatcagcaagagcaacctgcaggcctgccgaggcaaagaattactgacagaactccatcgtcagctcgtcggcaaaaccgcaatgacaacgtgataggccaatcagaggataaattgcgatgcagggttgaatcagttgtagccaagaagaagcccatcgaccgcctaatcaacgctctgcggcacagtgtagaggatgaccgtacggacgtcaagaggcagaaaacacggcatgttaacagtgccctggcgaacgagatcgacgccatgaacgccaagctgatcgataccgtggttagaatcgccggtgagaaagatggtgggacagagattgaattcagctacactgcagtgtctcttgcactagacatgaagcagctatttgcagcatatgggacgtctcctgtcaagccggtgaaactattcgtccctgctgattaccctcgaagttctccggtggtctcgaacaacaacgatgatggagatgaacagcggcgaggaatgttcggcgagatctcgggcatggtcagtgcggcttttcactgcgcgctgcgtgagctcccgccgtccatgtcagtcaagcagatggcctcggagtggaattcctgcgtgcagatgatcatgaagaaatttgcgatacggcacggtggaggaacgttcagctccaggcatggccagtggatggattgcaccgttgaatgatttagtaccgtgaggtaccgatacctcgagatactttttgttgtaccgaagcaaatctcttaattattacatgaggatgaagtgatacggagaaccgtatttgatctgttgttattgctgctggagggtacatgcataatccgctctgtgtatcatttgttttgattaagctggtattgcttttgatatttctctgtctggattttgtaattggaacaagcaaaatcgcttgtaggacatgtatttctgaaaatggtaactatctatctttgaagagcccaacaaagcatttagagttttattggcaaacaataggttgagctcgcaggcttatgcaatggtggccaaacagttcaattcctaccatatatttccttctgaaacttttaccggaactgaactgttttagctgaaagcaacaacatgggacgtctgcaatgcagacaatcaactaatcaactaattaagcgaattttgcatgtgttcaaaataccggaaagattttgtgaggagtatgaacagatggtgagaaatttttggtagggacatgataaaggagaacggaaggtacactcgattggttgggaaaagttaatgagtcccaaactattccgaggacttggttttcgggacattagatgctttaaccaagccttactagcaacgcaggcatggagactgttcgataatccagataatttatgtgcttgggtgctaaaggtgaagtactatccaaatggatcactaattgacacggccttcccttcaagttcatcgccgacttggaagggcatcgagtatggactagagttgttgaagaaagacttgatatggatagttggagatgggcaccaaattaaaatctagaggagtcaatgggttgcacatagggaaaacccagtgattctgtagaagaaggcctggaatcgtctcacgtatgtacatgagctcatgttgccggaaaccaaaacgtggaatcagcctttaatcagacatgtgtcacgcccagaaattcactagtaatttccgaactaatttgtgcattaaatcctcgtccaggaatcagccaaggtacacaaactgacaatttaatatacagattcatcaaattaactaaaacgataaatacttacttaagaggcacttagttctcaccatgaagaaaactgcagcggaaaataaaatctagcgaagctccggctccactcccacaggcagctcaactggggtatgagccaaacgtcttctccttctgaatcctttttcttcaactgaggtttgatggttattgcaaggtgagcatatgacatactcagcaagccacacaacaaatatgcaagtgcacaaggataccaaagaatggtataatatagggcttatttgcaaaagcagcatttagcaaacttttgagaattgtaaaacagtagagcaattaatcatcaatattaatcaacactgtacaacacacccatgctgcacaggcccaaccatcctgaacaaccatacccggctgtacagatctatctccaaaccaggaatgtaccattccaaaccaggagctaatcaaattattatcagttatagcatcttttattatggtgagaagtgtgagactaatcacgaaagacattgttagacccgcccataactgcgggcacggctattcgaatagttttactctggccagaggtgtaccactgtacccacaagacacagccccacgacatgtcaccatgcgcctcaataccaccacggtacctcggaaaggagctgtgacagtacccctcgcacaacacaatccaccacagtgcaccgttcctggatcataatcacccccttataaacaaggtatggactccccagcgacccccgtgggcttatctccgccacttctcagtctagtgctccgcaatgaaccatgctatataaaaggtaaagccgttgcccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgacctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgacacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactcaacggcggcagcggcgaccgaaggcgacgaccacagcgacggcgcggggctgctggagcggcggccggaggtggagagagaaggcgagcgcggggagagcgattccggcgagattcggcgcaagggaacgggtggccggggtagctctcacccttgcgaagccgagggaggcgacggcgcaggtcggggtcgaccgaggaggcggcgcgacgcggctggagggtcaccggcgtcggcggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaatgaagaggagattgagaggattccattcccacaactaatttggaaataggagcaacggagaggacgaatttgatggggaggcggcgctgtacacgggcacggcagggaggatatcggccggctggaggttaggggcgacactgtagcagagggggacaaaacagacttatttccgggcttcatttcctcggcccgattgaaggaggaaggcaaatagaacttcgtcagagagaggaagagaagatgcaggctcgggttgggccggcggaagagagaggaaggaagggaatgggccggattcggcccgagacaaagaagtggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattcctttttttacaacaatttataatatagcgattttcagggtgtgacatagtccaggaaaatgatgcatccgaaattctgaagatcaaaatacctggaagggagatgtcggactttccagcatggcatcttgagaagacaggaattttcactgtcaggagcgcctataggttagcatggaatcaatcagggaaggctcgtgtggaatcttcatctagcacggcgacaaatggtgaaaggaagctttggaagaatatatggcaaacaaatgctcaaccaaaagtgagaatttttgcatggaagctagccaggacagattgcccacttggggaaataagggcctgtttaattcgcgaaaagaaaatttttgggtgtcacatcagacgtttgaccggatatcggaaggggttttcggacacgaataaaaaaactaatttcataactcgcgtggaaatcacaagacgaatcttttgagcctaattaattcgtcattagcacatgtgggttgctatagcacttatggcaaatcatgggctaattagactcaaaagattcgtctcgcgatttcccccctaactgtgcaattagttttttaaaaaatctatatttaatgcttcatgcatgtatccaaagattcgatgtgatgtttttgggaaaaactttttgggaaccaggattcttgtggttccggggaatccagctacaggagaaccaggaacggggagctctcccctgccctaagagaaagagaaagatagaacagagtggcatatgcccgatctgcgggatggctgaagagaacgggtttcatgtacggtggagtgcactctagctagaggtttacgggaggcaatgagaacacattggctattgccggttgaaacgagttttgcatatacagggccggactggctgttagtgctgctggatagttcgcagtgttcagaaaaggcacatgttatgtatttactctggagagtttggcacctgcgaaacaacatgatccatggcaaaggaagtgcatcaattgctgatttggtcagtttcttggttagctatgaaggccaactgttgccaatccgacaacaagaagatgaccacaaaggaaagggccctatatacatggaaccgaaccagatatctctctctacaagtatcagcaaactgactgacaaatggtgtccaccgccggagcgcttcgctaaactgaatgttgacgcaggttatagggaagaaaccggggatgctagtgtcgggtttatatttagagattgcaggggtttggtgctattggcggcccaaagaaccctgcatcaatgtggctcagctgtctaggcattggcgctagcatatatcttgagggactcagagcggcgactgacttgattcacatgcccattgtgttggagatggacaatgcataaattgttagggatttaataagaaaggaacagctgaaatcggcctgggcgacgacaattgaagatattaaaggagtgatgcaaagtgcaagtgcacaagataaagagagaagcaaatagggtagcacatgttttagcacaaatggctgtcttgagggactcagagcggcgactgacttgattcacatgcccattgtgttggagatggacaatgcagaaattgttagagatttaataagagaggaacagctgaaatcggcctgggcgacgacgattgaagagattaaaggagtgatgcaaagtgcaagacttgattcatatgcccattgtgttggagatggacaatgcagaaattgttagagatttagtaagacaggaacagctgaaatcggcctgggcgacgatgattgaagagattaaatgagtgatgcaaagtgcaagtacacaagataaagagagaagcaaatagggtagcacatgttttagcacaaatgacaatgagttgtaggtcctacgcggagtggaggttgtgtgctcccgcaagaattctagacttattaaatcaggagtgtaatcccttatttaagcattaataaagctctctttaccctcatttttttttgcatgtgctagaatcgatcgcagaatgaatacgaaaatgcgtgtgccatattccgttctactccagttgggttgaggccatggcttgcgtacatggtggatttgtgggcttctcgttctgggccagaggaaacgagggacccaacataagaatataacaggctgtgggctcgtgggctcaattttaatacttcccagctagcattcgacaccgtttttggatttttagttttccaaatttatttctgtttgttttaatactttgtcaagcaatcaagttataataataaaatataatgatttttttttaaaaaaacagtcaagataggtttgtacttacacttagctcttatatggtttattaactaattgagtgaaatatagtttgggccatttttatggttgaagattcactttggacctccttttaaggtaacattttcactttgcaccattttaaggccctgtttagagtctaacttttttttccaaacttctaacttttccgtcacatcgaactttcctaaacacacaaacttccaacttttccgtcacatcatttcaatttcttcaaactttcaattttggcgtggaactaaacacatcctaactctattttcttttagccacatacaacttcgtctctggtaaagaagtagattgaacacaagtgtgagagattgccagcatgtggatgtaagtgcgcttgaggctgttgatgtgcttgagaaaagagttgttgtggttcaaactgtaataaaggtagatttatctagtccgaagtaaaaatattagataaagatagttcaacgtaaaacattggcaataaaagttagtccgatccaaaccacagttttaggcatttgatttcaagcttcaaattgtgctcgaatttttttatagttttttatggattttttttgagaaagagagcgtaagctccccatttcattaacaaaatgcaaattaccacatgttcagtacagagttcagaaaactaaaaagaaagaaaaacttgaaatatataatatataacatttcattaactaaagttcagagttttttatggaatatataatatattatgagtccctaatatggatttgacaccaacctctttaaatttagttttaattttcttcattcattgtcacgacgttccaaggtcttatttaatctggaagaagtggaaaatttggctcgtcgatcgtagctcaaaataaccatggttagcattcgaatacgactacaaaataaacatgacatacttttcaaaaaaaataaattgtgaagcccatacactagaacaggatcgcttatctgtgacgggctgaaagcatcatcactatcgggtaaggcccccgtcaatgggcaaaggtcactgatgtgaggaaaaatctcaatcgggcaaaagcccgtcacggatggatgttatctcaatcgggccgaaaacaaagcccgtcacagatgagtatgaccagtcaaaccagcgtagtaagaagcctgtcacggatgactaatctcaatcgggcacaccactaagcccgtgacggatgagtagtcatctccatcgggcatttagccagagcccgtcactgataggtttgacgccacgtgttgagtcaaactagtcccggttcggacgacttatctctatcgggtgtattctaaaagcccgtcacggatgactaatctctaacgggctggactctatagcccgtcacggatgagttatctctttcgggcattagctaaatgcccgtcagggatgagtttagaaccaaaaaaaaaataaaatttgtctttttggctagcctcagacctttgctagccatgcccgctgcaaaaatgacagaagcatatatatatacatagtcccattcccagcaaccccattcccagcatcaattcacatattccatcacagccatttcatatagacccattaccagcatcacatcagccaattcacattcatattccatcacagcacagtcaattcacaaaatcaagcacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctaaagaatataattgtattacaaagaatatttacaaaaatcaaatgtttgtcgcatatgcattgcaaatgttctgccattctgagacgagctacctaggacttcactctaaacatccctttcggtgacaagatatcatctagtatgaattgtgctatctcctctctaatgatttcgaagttgatttctggaatccttgaaataaattcctgcatgttcggcgccaagttagtctacatacttgtaaatttgtcgtcctatgtgtatataaacaattgaattacacaccttagggtcgagcaatgtcaccttgtctgcgaagctcctcatgttatggcagacatggaacccacactggttgctaacttgttgacatattgggaagtctttcttgtgaccgagtttgggatgcccatccttatgcctcccgcctcttgccacgtattggtcccatgcctcgttcaaggaagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactgttgattgtaggcgcacataatgaagtccttgtcttgacgggcaaataagcagtccttgatataggtcaccatgtttgctcgatcatttttcagcgttgtcacgttgacgacagctggatcgagtaaggcaatatggggtgctttacgatggacatgcttccaggttaacctacaagcaagacatgagtcagggtaagcgtaatttatggacagtcgctaccatatcgcgtaccaagaaatacttacaaggagtagcacttaaggaggttggtgtcgatcgctcgcaccctatagaggtcccatagatctttgaagtctacggcgatgaaggcagtaggcccgaggaacggctgaccatcgtgctggcccaacatggaggtctctctattcttcctccttgcattggacttctccctgtagtacctgtgcaactccttgcatgcagggcccatcttgaataaggcatcgtctccgaccaatggcatgcccaatgtgaattctgctggaggctttggaggagctactggtgccttgccaagatcaagcttctttggggctaatggcacctttatttttcctctccccgttccagcagcttttctgcgtgtgtcaagcttgggtggagaagatttcgccctcttgctccttttcgcagaaggggggaggtgcggcctgctgtcaacctccataccgtcgtcccaaaaatcagtatcatactgtaattggagatcttcatctctttgttcaacggcaggagggagagatacaacagtttgatggggatgcgtcggcggcggacgagaacttggcgctggccttggagttatattgatctcaatgttgtgcttgggccattgaataaaggtcccacgtgcagccccaagggtcagaatctcgtcattaggtgggtgtgggatagtgtagccaacccaatcgggcttcactaagtccacctgaactttggcattgccggcttgctgctgcgccccatgcactcgggtctccggggtaggcttgaaagcttgaccctctgcggcaggaattgcaaatcctggtgtcaccctaacgactagggtacacgatgtgggttcctgcgatagattcattagtgtccttagtatatgttgcaa

SEQ ID NO: 41981 - DNA, 2943 bp, Oryza sativa
  unsure (1)..(2943): unsure at all n locations
ttaacataagatagtggcaacggtagcaagttntagtgggatatggatgtnnagtngagatcccgtctgctccgaccctaaggaatatggatgctacatatctgctgacgaggcgaatgcagatagaacacacaggcaaccaaaacccttcctatccaagatttctagacttatctctaacgtaatcatcagcaaactcctagatttctagaaatgttgtatttgaacgaaatgttctgtttaccaatttgtcttggtcggtaccgtgcaggcagtaacctgaccaaaccagatttggcaaccaggacacttcgtattctcctaaatgccataatttcagtaacttcatttaataacagatttctatgcatatccatcccatttcctatgacccatttaatattattcttgtacctaaaaaaacacaagtcatgacatataataagtttggcctcagttttgctcagaaattatgcttcaattatcatcatttgcaactgccccacccccaaaagaaattaagaataagtgtagagggtctgtccttatgcaaaaaagaaacaagtgtagaaacccacatttaaacctaaacaagaacaagagtgaggccggcccaacaatgcatccattttgcaaaacatcccatactgccactcccccccaaataaaatgaacaagtgtagatacaaaacagccataaaaaacatacaaaaactcacaattcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcccaacatcccattctcccccaaattcacaaattcatccatcacagccatataaaaatttatcactagctaacacatatagaaatgcacaagtcatcacagccatataaaaattcaccactaggtaacacatataaaaatgcacaagtatcacagccatataaaaattcatcactagctaacacatataaaaatgcacatgtcatcacagccatataaaaattcattattagctaacacatataaaaatgcacaagtcatcacagccatataaaaatcatcactagctaacacatataaaaatgcacaagtcatcacagccatacaaaaattcatcactagcacaagtcatcatatgtagacattagcatctaaacattgaatcaacaaataattgcactatcacattatcgaatttaaacattatcatcgaatcatcaaatcatcacatataacatgtacacaacaaatcatcacattatgcatcatcatcggtgaggagtacctaccttgcacggtggcgggctcggtgaggaggttgacgtgggctcggggacggcggtcttgggcggcaccgggctcggggacggcgtggagggaggcgccgggctcggggacggcggtcttgggcggcgccgggctcggggacggcgtggagggaggtggtggccgttggggaggccggatcttgagtggccccggcctcggggacggcggtcttgcacaacggcggcggtcggcaatcgatagagggaggcagcggcgtggaggaggtcgacgtggcggctagcacgaggtcgacggccactgggcatagatctggagaggaggatgtgggacggccgtggttggtgaggccggatcttcgagagaggaggaggcgacagcgttgaggacgaggaggtagcggtcttgaggactaggcggagaggaagccggcggtggcggtcttgggcgtggaggacacggacttggaggaggaggaggcggcgtcagcggtggtggaggaggacgaggtggcggcggcggtggatctgagagagtgagagtgtgagagagtgagaggcggcgtcggcggtggataaggacccgtggatgaggattgactaaataaaccctagtcaatcctcatctctatcaggcagactattatgcccgatgcggatgacacttatccgtgacgggcgttagtaatctacccgatacggatgatacctatccgtgacgggcattagaactaagcccgatagagatgtaataatctctatcgggcatagtactaaagcccgtcacagatgacttattaaaatatttttaagttataaaaatcatttataattatcttctgcccgatttaaaattgctattacatttgatttatcacatataattaacaaatgtcttatttacatagttcaaaattcctattaattttttaaaatcatataattgacaattgcctttctcacatatagtttaaaattcctattaattttttaaaatcatataattaacaattggctctctgacatatagtttaaaattcctattaattttttaaaaccacataattaacaaatccatttcttcaaagagttttaactggaatggcatgaaacatatgcaattcattcattaaggctccaatacaaattaaatacatcattcacagtgatatgccttccgaatggtctaaacaaacgtaagccacttcgtcttcgggatcatcgtcaaggtcgatctgaggtctgacatgaagattcttgttgtattcttcttcatcgacaacgttgtccacccccacaattcttcgcttgccatccctaacgacgtgcatcttcttttttgcggggtcttttatgtagaaaatctgttcgacctgcttcgctagtacgaatggttcgtctgcgtatccaaccttggccaggtccactaatgtgaagccttccttgtcgaccatgacacctgtgcggatattcacccaactgcaacgaaacaaagggactttgaagttcagatagtgcagctcccatatctgctctatgcggccatagtatgtgcg

SEQ ID NO: 41982 - DNA, 704 bp, Oryza sativa
tccctaccgccgacgagaaaagctgacaagagattttgtgtgaataacctgatgtttcatatgcatattagtacagatcatcacaatgaatttgctgtaaatttgcttgattaccaccgttaccacataattacacccgacgcaatttcaaacacgtacaacgaatgctgaaacaatcccagcgttcactaacacatcctacacaaagaaggttcagatagacgaccgatcgatctacagtagattgtacaaaagaaaaattggacgaaatggaaaacccaaattcaaattcgaatgaagtatgcatcaaaaaaaaaaaattcgagcattgcatcgacctcatattctcaatgaattctcaagcctgaatcgactgaattcgtcgagctagctagcgcgccatggtgatcgagccgtccttgatgaggctgttgctgagcgtcttgaaccgctccctcgagtattgccgcgacgccttcctccaatccgtcccggatttcatcatcgccacgaactcctcgtagctgatccgcccatcctgcatgcaaattcagagattgatcagtttcagagtttatttgggagagctctaacgcctaaatttaactccgagagccgagtttgcagtggagttgtggaggaggctaaacccagttacatttctccagttcattttgtaagagcgcttcaagggctgcaggaat

SEQ ID NO: 41983 - DNA, 16221 bp, Oryza sativa
gccagcacacaagactgaggcacatatgaatatgcaatacgctccacaaaggcaaagcatttccagagcccaagacgcatttcggatgagccggatgcagccgtgaagcagtttactagactcaaactccgaaggtattctagctggccttgatttgcctccacctgcagagggttggaatggtgttgaagatctaagaactagttctacgagagatggccatgagcccaaaggcatgctcacacaatcacaaagactgtttgcaacgtaattgagcttggacaatgatgtcagatgtgtgagttcgttcattgcaagcatataagatccaaatctgtccagttcttttagaaccggacagtctgggacacttgcaagtttactacagcgaatgatctgtagcatttcgagctctggaaatgtaaccaaattcttagcctcacctgcagtattttctgcccatttctccaagctaaataacaactctagtttcagagactttaactttgggaaaacttgctgagggatggtgtatccttcagctcccacaccaacgttcttacacaatgtggttagattatccatacgggataactgcagatgctcaagcgagaccgataaccacagtgttgatagatccttgcatcctaaacagttggaaatgcggagagttgttaggcactgcaacatctgtgggtctctcatccattgtgggatcttcaggccactatatccatgcagctctaaaattttgagcttaccatgaggtgtaagtgactccaacacttcttcctcattgtaggcactgttttccggtgtgtaaattttatcacgaccccagtgcaatagtagttcacttagattttccttctgatggagattggcttctattccattgttcctgcaattaatttttctcaaattgtacagttccaacctgttggcaatgtgacgcaagttcttgagctcgtcaattccacaaccagctttagtgtccaaaacaaatgttgttagagtgcgaagattgttcaaaagaccaaagtttggtggcatccgcaccaaactatcacatcccagaagataaagatggaggagcttcctcatttttcccatactttccggtaaatattttagaaagctgcaaccattgagtctcaatgtttgtaagttatacatcacacatattgaacttggcaacataacaatttgagacatagataggtcaagatatcgtagatgcttcgaataagtgatcacatggttagacataaccgaatggtaatggaagattcccttttcaattacaagggttcttaatgatgccaggcttaaatccttgagatccctgcacaagggtgatggcactatccaagtacggagagatgatgttacttgtaacatttccatagtttcttgcataccaaaagtgctagatatattcatgtgacggacatttctgacagatgcatcgtgctgaagtacatgttctgaagttacacattcgtctgccacgtcttttgctaggtcatgcatcaaatcgtgcattttgcaaccaatggactcatatggtaatgccttgtccataatttccttttgtagaatggtcgacggctggagctctgccaaatggtccagagttttctttgctttgacatcttggaggaaggatctccaaaccaaatattggaaggtgtattctcctttttgttccaaatccattattccatcttcttggatgaaaccatttgccatccacagttggatcaagacttccttgtccatctcatggttccttgggaatatggaacagaaggcaaaacattgcttcatttcggatggtaagtgtctgtagcttaatttaagcatggaaagtatttcatctttgtctctggcactgtctgcgatggctttccattcatggagttgttgctttgagctcatcaggccacccatagcattgagagcaagaggaagccccttgcatttcttgacaataagtcttccaatggtgaccaattctgctgtctctcgtacttcttcactgaatgctttctttgagaacaattcccatgaatcatcatcattcagacatgctagttcatgggatctcatggtgcccatgatagatgctacttgttggctccgagttgtgaccactacaacacttccatgaccaccagcagcagagcacaagagtggccttagttcatccttccacttgttctcatcctcgttccatacatcgtcaagaactaacagaaaccttctgctaccaatggctccctcaagctgccgtcgcaagagctcgatggtgtccttgtcaggcacttgacatcttcgatttgtagccaattcaacgatggatttcagaaggggaacagcttcaaaattctctgaaacacagtgccacatcttcagctggaaatggtcacgtaccctcgtgtcgttgtacaccatcttggcgagcgtcgtcttgcctgaacccccgatcccgatgacagggagaacctgcaatctctgctcatatcgctgatccagcaacagcttaaccaccacctccttgtcgtcgtctctgccaacaatgtcacttgattcatccagtgcagcagaatgcatctggagataaggaggtttcagttcttgtggtgattctgtgcgatccactgacaagccaagctcgttcatcttgtcaaccagcttgttcatcttctcgaggacattgctcagcttcttgctcatggttacgcggaacaggagtgggttgtgcggggtgaagtagccgagtaccttgccggcggtggcgtcgccgtcgcggcgcagcgcctcgtagcggaagtcgtcgaggacgtcgtcggcctcgtaggcggcggcgttgaggtccttcatccagcgcctgacggcgaggttggtctcgctcttcgcctcggcgtcggccagcgcgcgctggacggccagcagctggcgttgcagcttgcggcggtcgtcgtcgacggcgccgcacgcgccggtgactctctgtacgagtgcatcggcggccttcgccgccaccccgcgcaccatggggaggattagcgattccgccatggctctatgctgctcactaattagctgcaacttctctcgctttttctctcaggctctttgattgctcgatgcgcgaaagaaagcaaagaggcaattaagcttatatttttggctgtcacagtcttcaattgttcatttgaattgatcgagcatgttgatagttgactttttttttttttgcattgtacattcaaatcttagtttctttgtgggttgtcatattagtacttaccaggattttcagctgattgcactagatttttgttccttctgattagtcccgtcacagagataccatgttctatcttgatgtagactacttaaatggggtattgtctactttgttgtaaaagaaaaagaaaaaccatgcactctatgatctcaggctttatgaatagccaataataacaagaatttcaacgccccatttgcagtacaacacgatttgcaaccgtcatcgtaacacgcaacaacccacagaaggagaactcaccaaggaatggctcagaatcaacaaattatgcatgacatgataactgcatattcaatcaccaactgcatatcggcttaattacagcccagcatgcacctggtttcgatgaatgaaatcgacatcgatgagcttgcaatcgggtagatcgccgtggtggttcagaaatcagaagtacactgcgatagcgatgtcgatgacaggagaagactctgaagattatagaaaccagacaccctaaaatcttagaaaaatctgaacttcttaagagtctgaaaccctgaactttttgcaaacttctgaaggataagggccgtccgatctgatccagacggttaagatattcggaaaattcaacacttgtccacgactttttgcgagaaaccccctcctagtatatggtcttctcgttccaagtccccgtctccatccccatccccatccccttgcctgcccggacttctccgccggattggccttgccggccgccggggaaggacggcctagtggcttcaatgttgggttcgtctgccgccgcgctggatccgccgacgccgatggcttccgtacggggcagtggtgctctccggcacccgcggcatgcgagcggaaacctgcggtggtccgagggttcccggggtgaactaagggtcgcggcacgagccctggcggaagctcattgagacgctcggtgaagaggcggagaggatttctcaccgttggtacctcctcctcctcctcccacctctgctcctgctgcttctttgtcgtattacaagttcgcggttcctagggtttggatgccatttactttcctgcagtggtttctaggatttggtcgcgatttgtagggtttggacgcgactttgttgttgttgtcaaaagattggaagggttgcatccgatggtattaaggagactcgttctgtatttatgtttaaggtttgcatatgacgtgagaatgagaggattaggaggatttctaaaagattttagggtgtctggtttgagcggttttaccatgtttacttgtttgctggtttacgttatagaccctttgctgtttttcaggacgtatgcttgcaaaactatgatggctagttgcaatttgggattgtttttgtgttttacaatctaatgcaaataaattctatgctcagactatgtatctttggggttgtgtacgaaagggcacgtagtctagtggttacagtgacctgagtagtaccccaagatcctgagttcaaatctccataggagcgaatttcagattaggttgtttgcggggttaagttccctatttcaatggccgtatatatccggttccggttggatgtagaggccggtatatatatccggttccggttggatgcagaggccggtaaaaaatacccttctctaaaaaaaaatctttagggttgtgtatatcctgtgggatgtagaggcagggttttaatccattatctaaaaaaaaataaattctatgtctaaattcgaagcaaatgcagtgtttggtagtggtgatgtctagctcaatcttcagatggcatatggattcattgactgcaatctgtgatctttaccatttttattggttgagcaagcaatggttaacatttagcactactgatctaggttcaaaggtgagggactgatagcccttggattgcgcatcatgtgtgggttgttcactgctatccacctatcacagattcagattcagaggaacacaaacattacatttacataatgagtaaattcacggtccttgagaggtaccatattttacactagaaaaatatggtatctcctcaatgactgtaaaatcactcttacataatccaaggaggagaaggggaaaaaaagagaagaggcagtgcatgtaggcagaccttagttgagagttgagcagcaaggcaggaatttctttgcaaaccccttaacagggtctttcttctatgaagtctctgttcagacatggaatattagagacatactcccagtactcccctcctcttctgcatcgcttatctaacttgtggcttcctagtgtcattagcttcctgaggtttggcagtcgctgaagaagactctgtggcagtgtctctaccccagggcactgccgaacacatagttcctgaagaccagtgaggccatccataacatcaggcaaatttctcagacttgagcaagaaaataatgtgagatctctcaacttggcaagtcttgcaagatttggtggcagagacaccaaagaagtgcattcattaatgcgtagtgtctccagtgaagcagggagcttgggaatctctaataagttattgcaaaattctatgtacaacttttccagaccagacgggaataaggattcttctgatgatgaactggtcagattcttgcaataactaaatcttacacaacgaagggaattcaagccacagagctccttcacaggccaatggacaagatcgtcgcataatactatcgacaattcttccacaaatgcaaagcaatcccagaaaccaaagggccagtttgacgaattaggtgagaagaaacaactagaataccaaatgctcagcttctgaattgattccagagggggcatggtcgtctgctgctcatctgggagaagcgagttccctaaagaggctagcgctaatgtcacaagagatggccaggagcgtattggtattacctgcaaatccttagaaacactccagtcaccaacatagttgagttgggaaagtgctgcaagatggctgagtgagttcagtgcaattctgcactggaatatatccagctctcgtaggataggagcttttggaatattcactagctttggacaattgtaaatttttaattctttgagctcagggaacatcaccgatgttacttcattgtccatccatttctccaagttaggtaagtaatgtaaatgcatcttcttcagctttggaaaaatttccagggaaccattgcatcctggaacagccatgtcaatgccactagataatgtggtcaaattatccaaacgggataaagacagggactcaagagagacagactgccataacggtggtagatccttacatctccagcactcagacatgtggagttcttttaggcataggaaaattgcggggtttttcatccatgatgacatttcaatatgaccagagccccatacctgcaatgtttcaagtctgctaggaggtaaagagaactctacgatctcctttttgttgtcaacaacatcgagatcaaagtcatggtcactgtactcgaatatatcatgacaccagtgcaacaacaactcagttacattttcttggatatggagattggcttctcttgcatttgacccactttgtatagctttcagattaaacagttctagtcggccacctagatgatgcaagtctttcagttcttcaagcccacatccatctttggtatccacaacaaatgtggtaagagtccggaggttctttagctgaccaattcttggtggcatgcgtttcaagctatgacaaccaataagataaaggtgcctgagcttgctcataaatctcataccctctggtaaatgctgaagtttcaagcaaccatttaacctcaaagcttgcaagctgtataacatacatattgaatcaggtaaatgttctagcttactagaatgagaaagatcaaggtatcgtaagtgtgttatacttgctaatgcctttggagaaacattcaatttatcattatgcaatgctcgtaaagacgtcaagtttaatctcttgatatttctgggtagtggtgatgattttgaccaatatggtgacaataatgtgtgaagaggtcccacatgtttaaataattcactgttctcttgcaacttggcacttgacatcagatggcggacatctttcatcgaggctttttgctggttcaggtcttgcgcatcaacacattcctctgtgacagattttgctagatcatgcattagatcatgcatgtagcatgtaattgacttgtaagtctgtttaatcccgacatgaaaactttctacctttacatcttggaagaaggacctccacactagctcattgaaaacaaactgtcctctctcttccaaatccatcatcccctcctcttggatgaaattattcgctatccagagctggaccaacttgtccctctccatctggtagtcctttgggaagattgcgcaaaaggcaaaacattgcttcatttcaagtggtaagtgcctatagctcagttttagtatggataggatctcatttgtagtcccaacatcctcccaactcttgcttcctgcaatagcttcccattcctggattcgcttcttggaactcataaggcctcccattgtcttcagagcaagaggtaaccctttgcacttcttgacaatacgattgccaatctctgcaaactctggctgctgctcctcttctttactgaatgctttcttccggaataattcccatgaatcatcatggtttaggtatgatagcgtgtgagcaggaactgtgcccattatggatgctacccgctggctccgagttgtgacaagtactacacttcctggagcaccagcagaatgcagcaatggcctcagctcctcccatttatgttcctcctcattccaaacatcatcaagaacaagtagataccttttgcggcctaccacctcatgtagacggctgcgcaatagttcgattctgtctggcaaggtgcaatttcccctggtagccaattcaataatggatctgactagagaaacaacattgaaatcatctgagacacagagccacatgggcaactcaaagcgttgttgaacccttgtgtcgttgtacaccatcttcgcaagtgtggtcttgcccaatccccccatccctacgattgatagcacctcaaccatccgcttggatcgctgctcaagtaacaaattcaccaccatctccttgtcgtcgtctctgccaacgatctccatcaagctatcgaggccggagtgcgtctgaggatggatcacatgtactgttgcctgatctgcacgctccactaggccaaacttgttcatctcttcaaccagctcgttgatcttcttgaggacactgttcagcttcttgctcatggcaacacggaacaggagggggctgtgcggcgtgaagtagccgagtaccttgtcggtggtggagtcgccgatctgggcgtcgcggcgcagtgcctcgtagtggaagtcgtcgaggacgtcgtcggcctcgtacgcgacggccttgaggtccttcatccacctcttcacggcggggctggtctcgctcttcgcctcggcgtcggacagcttgcactggacggccagaagctggcgctccagcttgtggcgatcgccgtcgacgccgcacatgcgagtgacgctctggacgagcgcgccggccgccttgccgaccaccccgcgcaccaccgggaggagcagcgattctgccatgcttctaccactactcagctcgcactagctgacagtgacaacgggccttctttacttctgtgctgtctctgtctatctcaggatatctgattgctggatgtgcgaaggaaattagtagcgaataagaggacgagtgatcgatgatctgaatcgtaatgtaagtcaaggcaaagtcaaggtgatagtattattttggcaaaattatttttggccgtccagctagcctggctaagcacgctttactactgttgttatatactccctccgtttcgaaatgtttgaccgttcgtcttattcaagaaatttaagtaattattaattcttttcctatcatttgattcattgttaaatatatttttatgtaggcatataattttacatattttacaagaagtttttgaataagacgaacggtcaaacatgcaccggcggatctgtagggtggtccgggtggtcccaaaaaaattgcggcgcaactaggtagtataagtttctttaaaaaaaagaaaagaaaaaacttgtacgataccagatcagaccgaagcgccagcgtcaagactcgagcgacgagccgtcttccttctagcgatcaaaacaatcacgccttgttttccgccgcaagattggtgggcaggagcatgaccgcgagcgctgatcgagcgagatagagatcgagtccgcgactccgcaacggcgtctctgccctccgcgccatgaccgcgatggcgcgactgctctgtcctctcgactcactcattcgatttttgatgacctgatcgtcgaccgtcatcgccggacgccggctcgccgcttcggcgaatcagccttcagcgcttctgttcagtggcatgccgcgtgtgtcatggccggttcgtcggcgccggccgccgggatcagcgatttctttttctgttcggcgtccagactccagaactccagcagcgtgcaggcggcaggcatgtggctgtgatgccgtgtgggtgtggcaggtatttaggattttaggtcttgaacttgtgttgttttttcttcaattttcatatttaacttttaaaacttgtgaatttgatactaaattgtattattgtattgtagattgcataaaaaagatgaagatattgcaggatgttttcattcattaagcgggatgtttttcttcaaagtgaatgaagaaaatataatggacactttcatggccactgttagaagtagaccttataaaaagtagtagtatggtaattttcttcaaacttttctagccatataaacttgtttaagtctgaattttactaattaattgctaatttatatatgttttaagatgtcttattaatatatataacatggtacacttttggtttattttattattttgtatttgtattatatatattaccatcattacatttttttcacatttatagtgtttatttttgttaagtcggaccacctatatcataaatcctagatacgccgctgtaaacatgtgctaaaaagtcaacggtgtcaaatatttcgaaacggagggagtataaaagaatggaaagcagtaaagcacgcttggttgaatggacacggcgatgccttgtcttgctccgaaattcctactgatgatgataagcaagtactagtgtactcctaatcagctagctaggcgcacttgtttttaggaggaaatgctagatcaccgtaaaagttgtcttttacagtacttatttgcaccggaaaaatcaaaagaagagagtgaaaagcttcaatgaatatatatcacgtcgattccccccgcaaaatcaataccaagatttggccgccagattgacacgaaatcatcgacctacagacaagacgacgcagaatgctgcaagtgcaagcaagtctgtagttgaggcatttctacaagcaccttgcgtgcacgaacgcggcgcgcctgaagtcccacaggagcggggcgatgatgatgagggagagtaagggtctgttcactttgatgtcattttcaaccttaccaaattttagtcaaaattttagtaagtttttaaaattttggtaactatgtcaaaattttggcaaggttttttttggcattaaagtgaacaggtcataagaggctagggagagggcgtgacatgagcgagggatgaggaggggctccatgtcgtgtgctcgctcaccgtcgccatcgccgctgccgccggcacgcgccgatcgatgggatgccggatgcgagtaagcggccagcaaaggccgcgtgagatgagctaatggagcctgaaaacattggaaattatagaactgaactgttcacgttgggcctcatcctcctctcttcggcttggcccaagccttctccttccctctccgtcactttctgttggaattttgaggcctcatctttccaccgagtttaaacctcatccttaaatcgcaccagaaatcttaacccccaacttataaatccggtgtaaaagaaatcctacggcagtatggaggctggtgagggagcagcgaggtcattgccgatgtcgatggcctcttcggccccgcttacctctctattctccattgtcaccgagctggttgcttgatggagacgtgacggtggcaggatgggtgtcgtggcgctgccgagctcgtcgacgtactaggggtgttgtcgtcggtatcagctgccctattcttggtcatcctcgagccgtccccacccccgcctcctcaccgccatggctacggcgggcaccaccacattgtgcttcctccgccactacctcccactcccactcactaaattttgatgtaatattttagttcttttatatatgagttgacggttaaagtttatacttaacgaccgttaacatcgtgctaatcatctaagcttgtatggagagggctttcccttgttcttctccaagagcatggaactgcaagatggatatatccatgcttataatctaaatttacatgcttccttcgattcaaattatttgtcatgtttgtcctaagttaagcatgtctatctttaatcattattttttttctttaaccgtcttaaacatacgaattattatatatactatgtaagtatttctcaatgtgaatctgaaaatataaatcttatgataatagagaatttaagtgtatagaaactgatggtcaaagattgaaacatttaatttgactcaggaattatgaacaataaataatttgacacgggggaagtatatgcttgataaatatgcaatccagacacaagcattaattctagagaaaagaaatgatatccgatatgcctacactagatcatgttgcatgtaaattaaattacaaacaccagagtagtgtttgtaattaaattaatcctgccacaaaacaggcgaatggcatcccatacaatataattatggtgtgtctgctgttttcagtaatggtactctgcagcagcaatacaagctaggtcccccaagcattaatgcatttaattgatatatgtagcttgtcgatatatatttatgtgtggatctttgccaaaggagctagcccgaaaagtttagtacattccagccaacattttctcatgggcaaggctgcgcgctgtcaaagatagaagaagaggttgaacgagatggagtcctgttttgtaacgccccacgggacacgccgaggcaacgactctggctctctcccctgaccaacagaggccatacccctatcgtgttcgtgtacgcgattttcgagttaggaacgctcaaaaggaggatcctctgaggtattaaacgtatattactgacaaaatcaattccataacccctggctattttgcgagacgaatataacgaggtatactaacccatgtttagcggatgattattgtagcaaatcatagattaatatatcttgttagattcgtctcacaaaaataacccaggggttatgaaatgaattttatcagtaatctacgtttaatactcctaaatagcaagattctggagggctatttaatagtccggatgatccaaacaagaccatatggctaaggccctcgtggccttctacctcttggtaggttgtctcagtgtaagatggtaatggtaggtctaagattgacagcaatactgagggcgcgctctttgttgtggcacgatcaaagctcactgtcgatgccttcagcgatcttaagccatctacagagttgcggatgttgcttgtcccctacattgaaccagcatccatcacgcttggaatacaggtcatcatccaatttggatatattcaatggtctatcataacttgcctgcgttgtgtttgggcggggccgatgccaccttgccagtgctcctcattgcccctccacgccgaccgcctgccacccagttgatggccctggcacaccggacaagcctcccggagctcgccggccaacctccgtgtggtcatcggggagaggaagaaaagaacatgattgaaaaatggacaacagcggcattattagaattttacgaaatttttgtggcatctagtcggtttcacaaattgtaacaatatttttctaaaatagtaaatttataatggtatgggtcaaatttacccgtgaaaccatttgcttctctcaaacagtgaatagcaagtcaaaatactcaccaccttctctgaaacatctttgcagctggtcactgcagccataaaaatcgacaatccattccatcaggcagccctttcagagcaccacagctcctcaccgtgagattccttagccttaccctattttccaaggtttgaagggagtggaacggagtaccaaattatcaggatgttgaagcagctgtcgccacgacacgtcccttgctcggcgtcagccctcttcccagcagcgatcgttgatgttgtactcactgttcagtgcctgaaacaagaaaatctctaggctcgatcgtcttccctctttgtggaatcaatcctggacaccttgccagaacaccagaaaccgggatggcctgcatgctttgctgcttgttcgcacggtctctgaaaagcacgcaacgagctgatcttcaagctcactgaaacaagcgttgcatacatcctacatcaaatcagagaaagtctccaattatgggttcatcgcctaaagcccagccttcgcgaacacatcaacacttgggcagacaagctaagctaggtttcctttttatttttgtgttttgttctttcttcttcattttcttcttccttccttcttttttatctttcgttttctttatccttcctctttgttcccccttataatctcttgccagccactggctttgttacttatatgaccaccattaatacaatggtaacaaggtagagtctctctgccttttgcgtcaaaaaaaaatcgtcttccctccttcggtccctttcccagcgttctaaaccacatgtatgctcccggactaccttccctctcctgaaagcaacggtgccatctacacggctacacggcacgctcacacaccttcatagcattctcccaattaatttgttgaatgttgatgggtctattgtacagttcattgtcacagtaggaatactacaatactcctttaaggtttgtgttctctagtgcaagttcccaacttcacctttttcattttctgtatgtatctttcctaagctactaaatcatctttttttttaaaaaaaagaaagttgctttaaaaattatattaatctttattaaaaataaatatttaattaattatgtattaatccaatgtttcgttttgcttgcataagaaaggagttccaactactgcaaacgaacacagcctatgaagtttggctatagttagttagccaaacaaaagctgtagtagagcactaaaggaaggcggtcctgatggccttgctccgccaggctatacatcaccattgttaccggaccaccacgaccaaatctccaagccaacccaactactgcatgtgcggtggtgactctcctcctggtcctggtacaccccatgtgttgcaatttcaggccttgtagttcgcgagacgaaaaggtttgacatgtcatatcggatatatagatatacatttgaagtattaaacgtagattaataataaaacaaattataaattccgcctataaactgcgagacgaatttattaaatctaattaatttatcattagcaaatgtttactgtagcaccatattatcaaatcatggagcaattaggtttaaaagattcatctcagaatttacatgcaatctgtataattagttttttttaatatttaatactccatgcatgtgtccaaacattcgatgtggcagggtgaaaagttttgtttggaaactaaggcctggtttagtttcccaaatttttttcccaaaaacatcacatctaatctttagacacgtgcatggagcattaaatataaattaaaaaactaattgcacagttggggggaaatcgtgagatgaatcttttgcacctaagtccatgattagccataatgataacaatccgacccaggtggagttggtcgaggcccaacaaattaaggttgctcggaccctaacaggcccaggtagagttggccgaggcccaacaaattaaggttgtccggactccaacagttcttaggcacacccactcggggaaaggcccaatctacctaaaagactagttcgataggagaagggtagctctcccttttaaggtggcttcctcctccctagctaagtaaggtgggattattcagaagctcacacggtcatcgcccaacttttgcgtctttaccagcatgtaatagtggaggatgtcctcatcacataagcgctacagtaaccctcatatgctaatgacggattaattaggctcaaaatatttgtcttgcggtttccaggtgagtcataaaattagttttttcattcgtgtccgaaaaccctttccgacatctggtcgaacatccgatgtaacacacaaaaattttcttttcgcgaactaaatagggcctcactcactcaaggtacaccattgtagctaggtcagtaggtggtacatcatatgatgcagtttagtacgcatctatctgcattatacttgctcccatcgttgtttcgtttagagctgattataacccctagtgtaaagcgaaacttat

SEQ ID NO: 41984 - DNA, 5033 bp, Oryza sativa
gggaggtaagaagggttctccttcgtattggggaaactgttttaacagctcgagtggatatccacatgtttattacatgtcatctacatggttataaaaaaatgaaaaaaatatgaacaatatgtaatatatcacaccacaaacatgccaagttaaaattcaacttctacaaattataacaaaaataacaaacaagactcaaattaatatatgtaaatatacagttaaatttattatttttattacaacttatagaagttaatttgaacttgcatgtttctggagtgatatatacatattgatctatcttgtcaatttttttgaaaatttttcattaccatttagttgacatgcaataaacgggtggacgtccactcgagctattagaatctatctctattggtattggtgtttttactgtagctctaggccgcctctctcttgctctcctgagccttcgtaggttttttttttaagataatagaataaaaatccgggcctttgctacaaagaagttacaaccatttattacaaagttctctcagagagcaaatactctagcaacaataagaactgaaataataaagccaacacataaggagaaaacaattattgaagtctatttgtgaatcttggtgaaaaatccgcgtaactgtaacttgtaaagtttcagcatgcataagagcaggtacaatagccggctataagccaatatattttaatgagataaaagagaaaagagaagagcagcgggctacagatctatagccagctgcaacacggactataagccacaatgtgtgtatgccaggtgagaccatatattaatagtatagtaagcaactattgtataaattggctattaaattggctatagatgaattagagctagtagtgggctatactattaaacttgctctaatgtatgagccaaatcttcgcattacacaaaacttctaaacttggcaggtgtattacaccaaatattgttatatgtgcattgatgaatatagtgtttgtaattgaatagaacctgccaccaaacaacagccaccctgcagcaccacataaatcgcataccaattatattaatggtccccgaagcattattgcatttacaggtagtatgcatctacagctgggtcctgtttggaagattagcatagggctaattttgagagctaatatttagtcatgaattggtaggctaaacattagcttagggtgttatgtttggctctctttctactctctcttcaccttttagccttgaattagctcaaaattagcccacctgtttggattcttgagggctaatttgagactaaaaggtgagggctaaacattagcccatgtaatcaaatagggccctgctcgatgtatatttgtggatggatcatatgatgtatgcaaaaggaactaacccaacagaactttgacactgtaatatttttttgttttctattttctcttagttaaattcaatgttctattatgttagttgtttaatcaagacacttagttattgttactaatttgttgatctgttcatgcgacggctgtctttgaacaattggttattaaatagtcatctgttgctgcttagaaattaatatgatcgtgttttagttaaccagaaaaaaatatggcgcaactatatatagttcccttcatatatatcctgtacgttggtttgctcatccgatggctgaaaattggatggggacaagtctagtggcttgaaccactaacgtacgtatccacactaatgatagagtttaatcttgtcattaattaggatatatgcatggttctattttgtttacatgtagtataggtcacatgctagaagctatgtacgtgagatatgtacaaactgcatatttagtttggctccagctcatgggcgagatgccgacatgccgtgtgatgcggtggtgcgagaatggagcaaacaacgttcatgaagaccaagagctcaactgcatgtggagtgctgcgagaagtagccgaattgcaagcaaggtgtggtcagtattagccgagtgaatcggtcctagctatgcatgagatttagttgttgctagtgattagccgcatgtgctgtgattagtggtaatcatgtgaagtgatttcttggcaaataagtaggattagttagttacttagttgcatggcatctgcacgtttgtgtgcatagcgtgagtcccggtcaagagaattggctggttgttatctgcatgtactgtgtgagtctataaaatgaaaggaaaatgaagtgagccggggtgtggctgcctcgaccaaagctgtgtgttgttcagttcttgtgtgtttgtgtccaccgagtaaatacaagtgtttatgttagtactagtgattagtacctaaacatttagagaggagagattcccgacaactaaaacatgaaaaccacatcatatctcttctttaattcttttcccatcgatgggatataattcataatgtataatgtataatatataacgtcgttgacttttaataaacatttgatcaaaacttttatcttagtttgatcttttattttgttggatgtgtttaattcatttgaactacactcagtgtttaggtgatacgtacttttgtaataattggctatagctctaatgagcaaagtccgggatgttttattctattatctaaaaattcaaaacttttatgcaaatataaaaatatatgttatgtttaaagtatatttgatgataaattaagtcacaataaaataaattacataaatcaactacgttctatattaaaatatttaatatggatggagtataaattagtcagccatgccgcggccagatcaagccactaatctatctcttcccccacggatcggcaaccagagctgctcgggctcacagcctcacactgcatgcgagctaactagctagctcaagaacggagagggcacagacacagactcctcggcaaggtcgccggcggcgaagaggcggagcagccgacgacggcgcggcgacgaaggccggccgtggagaagatcaatcggttaagtgtccattgagagagcagcatcgtaccataatccaggtaactataacaactatttgggttgtactcgatcctgactttaattagttaaaacgtcatacatttttaggatggagagagagtaatagaatgtccaatcttttgtttcctgtagtagaacacacctacgtttctaataatggaaaggggaggaggagtcatgctctttttgtttagaaaaacaaaacaaaaacagtcaaagtgttcacacatcatttacaacttgctaattattaatttgaattttggaattaaattaatgaaaaattaactttacaatagaagattgtacagattcatatttgttaattccgaattgtggactcattaatattttgataaactaaaactaaatattagatggtatttgcagttgcatgcatggcaccaacccgtgcatttcgcttccattgttataaatattaacttatgtaaaaaaaatgtgattaaaattttaatcatacttgtggctgaataagttagttaaatgcctttttaatttttcttcaaaattttctagcagtggtccccaaagcattattattgcattttaattgatatgtaccaatcttgtcgatgcatatatgtggtacagatctatgcaaaaggaactaaccacagcagtactttactactttgcagtcaatctttctgctcatggacaaggcactgaagtcagagatagaaggggtagaggagattgagtcatgttttatagcacccagtgaggacacgcctagacaagggctctggctctctcccctcgacatcgtcctggccaacagaggccatacccctaatgtttacttctaccgacgtgatgttgttgctgccagcggcaacaccgacttttttgaggtaggaaggatcaaggaggctatggctagggccctggtggccttctacccactggcaggtcgtctccatgtagatggcggcagtaggcccaagattgagtgcaatgccgagggtgcactcttcgtcgtggccccatatctaccaagatcttcaccatctctgtgcaccagcttgtagcccttaaacgaatctgttgtggcatgagcacattttgtgccgtgagcgcccttgtatggcagtgcatgtgtgttgctcggcagctgcctctagacgccgagacacgcgtcaccttcccagtcaacatccgacgccgtgtaacgccacctctcccagaccgctacttcggcaatgcacttgtcatcatgaaagtggcctccacggtgagggacgttgtcttggggacattggctgcaagtgctggccaaataaagagcacattgggccgccttgatggtgagatgttgcagtcagtgatagactacaatgagatagcagggatgtccaacaagcctgcgaaaggaaacctaccagatacagaactgcgaatgattggttggctaggcatgcctgtttacgacgtggattttgggtgggggaagccggagatgatgtctcgtgcagagtctgtgcgcagcggtttcgtttatatgatggatggcaccgacaacgatgggggtggcgtgcgcgtgctcatgtgtatggaggcacgaaagatggaggagttcgagcgactgctttatgccaagtttgtgcaatgaggaaactagctatctagctacaaacataatgcatgttttctgttttattatcaataatggatatttcatgtaataatataatcaaatacctccatatattttggtggcatggttgtttcagacatgacaaattcctatgtttctaggaatgttgcattcctatgtttgataaaaccaccaggaacgtttaaaactaatcctaatgccgcgtattaattctcagaatgttagttagcccctaactaacattcctggtggttttatcaaacataggaatcaactagaatttctccacgatttatgggaatatatataatcaac

SEQ ID NO: 41985 - DNA, 712 bp, Oryza sativa
gtatcatatgatatcactatcataagataaataatgtgcagtaagcaccgtttgttgctgctgctgcttaccacttggcagttggtactctttaaataatttttagtggaagcttgatactatttcgaagcatagtcttcattttgctggaaatgtgccaatctgttgtattttggtttattggtatgtaggattaccatctaattctgatatgttggcaaaaagtaatagagtttccagagaaaaatgcaatagcaaatttacaatagaagagaagaagcttgaaagaggaggcccatattaaagcccatgaacgaaagcttagcccatctaattggagcccttctatgcctaggcccacctgcagcgagtgatgggggcatctcctgaaaactcgcgcgcatttaactaagggttaccagctcaatataaagtgtgtcttccctccccgccgccgccgcctcgtcgtcgccgctgccgccgccgccgcggccgcgcgagaggaacatccgttggctctagggactcgcgtggaagatggtaactattccttctgatccttccccttctccctagcgtagccggtttctaccgccaaagtgcgggtaggtgttactcatgccagatcggtctcaagatccgggatggtgtgaaggagagctgcgtttgatcttgctttgtgcggcatgtagcttggatattaccctgctga

SEQ ID NO: 41986 - DNA, 16345 bp, Oryza sativa
  unsure (1)..(16345): unsure at all n locations
agctcctgtgaaaagttggatgcaattaaatattcaatatgacattaatgaagcattcaacagctacagagaaaaatgatctccaattctttcatccttcaatcctctggacagtatgactaaaatggtatagtaaaattgctttgttgatgcccaggggaactggagccatcatttcacatagtaaaacagggcttgtccatcgtttcttttgttaagtatatatttgtgcaaagacaaaaattaaattagcaccctcaaaattgcaaaaggttttgcaatgctagacctattgtagcaaacagccatagtgaacacatcaatgagccaacctatgcgaacatgtgaatgagcatattcataccttccctaatttagcaagtgaaggaggaagtgatgtccatgaagcgctagcatctgtcaactttttgctgtttgaagcaatcttcactagatttgtaatatttgtgttgcttgaaactccagacgtcctcctcaaaggagaagaaggcttattcactattttctcagaatcatctgaaggggcacttgctgagctcttccttggaggagtctgaatcttactgtcatccttatgcaatggcttctcttctactagtggtttgcgtcttggagtctgataacaaaagagccagcaaagattagtaactttggaaaaaaaaaagatgggcaataaaggatcaaacatgaattcaaatgttactgaaaggctacaatgtgttaagggcttaaggcaatagcttaagtactacatgaaggatactcaataaagtaaatcacgccacatttgtagacaaatataactgataagcgttgacaacaaccgcacgtaccgatgtgcttctattctcagacttcttctcagttttggctgcctttgaatctgaatttcctttgctctttgcttctgcattcccttcccagcttcttctcagggcctttggtcccgattcaatacttgacatggtgttactaagcaagttacctgcagaggacttcctccctgctgtagtagccttcaaaacagaagcagctttctctaacaaggaaagcctagaaggtgatgacttatctgctccttttgattttgttctctgctttatgtcattcgagaatctctcaaatgatgccggtagagaataaacgctggtcggagatgaaggtgtcgacctagcactggtaggttttgtctttgagctgactacttccttcttgtctataatgctattcaatgcttgtttcgagagagaagagtttgatttggttaactgtggtttcttgatttctgccccattgtttttcactgaaggttttaatttctccaatttgctctgctccttttctagtgataaagtactggcatcctttgacccgttgatggattgttgtgccttcttacttccgagaaaagtggagtttgttaccacaagatcttctggactgccaacacaagcatgccgacctggaactggcctgactcccctcaagattggcaccggagtggctgcctcaagacggtctacatggatgaactgtcccaactgaattgtgtcgctcaatatgagatcatgctgctcttctggtaaggaaacgtatgttgcgtgcgaggaatcggacaccttgagatagaaaccctggttggtaaacagatcactccctgcaagggccggaacaatgctgaccacctgaagaagggacgaacggtgctcgccggcaactttaacatcgctgttcatgtgctgaaggagcttgagaaggaccccgggtaccagcgaagccattgctgtcgactctaaagcacattacctgcaaatgttaagcacaattcagaaatcacagtaatcatacagaggacttcaaagaattattagaacttgaaagtgacaaaagtctaatgagttaatagtcgacaacctgggtagtcctaacgaaaatgaaatcaccaacaaccaaatgtaataaaggttgcaactttacagtgaaactcaatccaggctaacatgtcggtagcacaaaccgttttgatggctcacagtgaacacgaaaccaatgcattttgtcagtaaatgctaactagtaatatggctggaaattgtcactggaattgaaaccaaagcacaacaatttgctactcccattttgctgaaccataaaaagcataccaaactcaatgagcacgaaaggtgccattaactacaacattttgagtgcagaaaggagaagacaagtacacctagctgcccaacaatactgcttggaatgaagtcaagcatcgaataaatagaggtgtactcgaaatggaggctgcaaggagcaaggactaagtagagcaattttttttctaggaaatgcatttaattcaatccgaatgggatactatacgagtacaagtaaggtgtgagcagatccagtgaggacctcaaacacaatcaaataggagtcccatgatagaatcaaagtggacctgtcccagaactatataccaacagagatacagaaggagaaagcacaatcaaatcttgagcaaaagaacccattttaagcagcagctgcagaactgccattgatcgatagagtaacaagcaatcttcgactagcaacttgttatggaatcatcatagttccaaaacgtacttcagaggggggaaaaacagaacagaatatagaaagatgctgctcgaagaaatcatgggaggaagagaagaaaagaagggacatttctgacgaactccatcaacatcacagatacaagagacaaatctagaagcagcataaagaatacagtaagatggagaagaagaagaagaagcagagggacgcgagcacacacctctcaagcctctcaacacaagcctcgcgaatcccccctcagcctaatggcaatccgagcctaattatcccctccttgctcctcccgtgaagacgatccttctcccgattcttcttctacctctcgttctcagcctctcacctccagtgcagtgccgcctctcctctgcagagcctaaccaatgattcttctttctgccgcttgctctgcttctccctcccccgccggttggcttcttgcggcggtgccagtctctctctcgcttcgcttctcggtgaaagaggagagaggcgactgtggtgtggtgtggagtgtggaggcgagagcacgctacgctgagctctgcgctgcaagtctgcaagcacaggggggaagcaggaggcactgtggcaaagttatttgggaaaagcttcgagctctctctctctctctctctctctctctctctctctcgattgtagggattgtacatgtggggcccgggaagtcagtgggtgggtgcctgggtggtgctattgttgaggtcaggcgtcgttttcaatggggcaaagtggagttccaaggacaatttggagaaagggaaagccttttttttttcttttagttactgctccaactgtgaaagttttcacccaaaagttaaaaaacaatcttgacatggttttatgcttacaacatttgggtaaacaatggcaatgcaaaagccctaatacacgtcataaatatccgacctttagaacgagattcgattgctctttcaaaatatcgatcatcgatatttcctggcatacttggatttaaagcaaaagaaaaatcgtgttctaaacaatttatgatagagggagcatattacaagcttaagctctatttcctccaacctaaaatataacacccgaagtagagataggagtatattctactcccttcatcccaatttaatcatcatctaagatgttttcaaaataataattatttaataaattgcttctttttttatttgtgtaaagagtacatgtgcattgtgaatgccccacatgcatacaacaaatcaagattgatttctattagttcaacccatacaacatttaaagtgtgaattaacttgttgaacatgaagcgacggagcacctttgatcgatgaggattaatttcagaatgttggattagtgtatttggtcttgatgccctctatttaggggatgatcaaattaagataaagatactagtaaatattaatctagacaagggttttgttcagattcgtagtagtacgacgtgtcttattttgtattaggttgttatattttggatcggatagagtatttgatatagtaaggttttgtgtgctgttgtctaagaaaattgtagtaatagtaggagttttgcaagaatttatttagggttttntgtacaaaatttgtgggttagaaactgacatggtgggacctccgggagaagtcaatttctcataaaagcaccaagctcatctcatattcatcaggtcattaagatgtggttggttgtgacttaagataagcacccaagcttgagtgcagatcaagtgttcttttctttctcctgcagactgcagtaaccatgaaatggtccaatctaatttggtcaacgactgtacgcagaatcaaaaatcggactaccgacagtctgtctctgcagtactccagtttgacttcagattgtaatgtactccaactaatccatgttatagaaagggttaaatttaaccaaacacattgatattttgtagatttcagataagtacattttcctgaaaatgattaatgttcaggccagcccccattttggtcaagcgtcagaataatacagtcgctgccgatgattaattgatagggatctcctaaccactgtcgtataatttgcattgccggttggtaaactaattgccagagtatttttatgcctgtattatgtcgtcgtgtattggagccgtcgatatcattgcaccagccaaagtacttagttttaataactcaaaattttatcattgatttggtttagttcgaccttatctgcatgtggttctagtaatgcagcagctagttgatatcattgatcatactctctacaagactacaaacatgtgtacacatttgatatctttcacattcatgtatgtacaaataaaattctgaagcagaacaggatggaaattgcagaagttcacttgaaaagcaaggaacagagctccactttttctcgaaacgaaaaacaaaaaccatgcggttctgaacccaagtgctcgaagaaacaaaaagtcagataaaaaatggcctcgaattagtggcagcaaggtactaacagtaccataatagtactattagctgtctcactccattaatctggggaaatttatgtacttgttttgcctgcctttgctcaatttgcaaggcatcactgtagtactgtccaagaacaaacctgcttaattcgttcattctttcagatgagttaagtaaaaccacttgatccatatgtacaataccttctgtatatatttttttagaaaattgattaaaacccagcctctacatctaaatcaaaagtacataaccaaaatacaagagtaattagacagactcgactgcttctagtttctggacagttaaaactttcagtctggcagcaaagcaaccaagtgacacccatgatggtgagagtgagagatgttaggctgtagtagctttctgggaaataattaaccagttcagatctgcatattatcaaaagcatttgcattggttcatgcatgcatggatggctgcagcctagccctgcatggatggtccatatagatcatcacacatcacaacaactgtggcttaactgaaaaacggtttggtgagcatgtgctttctcccagcctcccaccaatctcaacgcatacaaaaacggatttaatcttggatttatgctaagttaatctcctttttaatacctctcggttttggcatgcgcatgtggctgctgcacaggatgtcggcgccaacgtgggatgtgaatgtgatgctgctgctgcttctgcaataatcactggatgacaggcaagcatcacactgcatgcagacaaccgtaacgaaataaacaggagtaggagtataattttacagatcagataaatttgttgttttgaaatattaatcatgtactagatctgtcccattgatccatcatgcacattaattcaggatttaatgtgccatttggaacaccggaatgtttttagaaatatttatgacttgtcatggtaggtaggtactgtgaaattactgtgttccatggactgttgataggattattccattatctaataaggagaaaatggcagttgatgaggaacacttgagtaggcagtggatatggatggtggtattgctacatgtcacatgcgtgggggcatggaattctgactttctgaacagagcattatctactcccatcttgcatgcatcaattccccccaaatccaatctttttcctacctgtaagtgctgcattgatcattctgttgtctgaatctctgttactccaaagaaacaacagatctactcagagtttcagataaattatgtgctttttagagtgcgacatgatgtactgttactgaacagtgatcgttgcttgaatggcactaggaagtaatcctatatgggaaatcaaaataagggcatatttagttcgagaaaaaaatgtttttggtgtcacattggatgtttgacaggatgccggaaggggttttcggatacgaatgaaaaaactaatttcataactcgcctggaaaccacgagacgaatcttttgagcataattaatccgtcattagcacatgcgggttactgtaacacttatggctaattatgaactaataattaggctcaaaagattcgtctcgcaatctttcctctaattgcgtaattagttttttaaatctatatttaatactctatgcatgtgtcaaaaattcgatgtgatgtttttaggaaaattttttggggaactaaggtttctgacgaaacgatcgatgaatcaatccatgatctgaagtctgaagagagcatggcaaggcatatgcatcatgatggatgggctaggagtaacagttatggagtatggtaagctatgatgcagccatgcaatgcaagccttgtgctgctcctcgtcatgaattcataactatatcttggtgggatgcaattacaaagcaagtttaatcggtactcctcctagcttgtaggttctgatggaaacaagagatggcagtatatatggcactgcaaactggctacgctcgaacaactggtgatagtttccgtgatttgttgtcaaatttgtgatccttgactttgaactttaacccaatgcgatttatgcttcatatcgatgattacatgtgttggtcctgaaatttctagagaatccaactgtttgcattctgagactgaatttctgaaaccctgaatgaatatgctgcaataagcaagtagtacagtaagcattctgcgttgcattcaggccaactgccatgctgctgctctgcgacgagaccagtagaccacagggagagcagcagaaagaaagtctgtgtccggcccatttagtcatctggcccaatatatggagaaggaataagttcacttaagctcccttaacttgtcaattaattcgattttcgtccttcaaccagaaaaaaccagatacaacaggtccctcaactatcaaaaccggtgcaaagcaggtccctcagtggttctgatggtggttttggctgatatggcgcttacgtgaccggtttgacttggtcctcgtcctacgtggcggtgacgtggcactggaagtaaaatataaaaataaaaaataaaaacaaaatgtggggcccacatgtcggtcagataaaaagaaaaacagtggcccgcggcgagcgcgcacgaagatggcgttcgagtgggatggccagcgaggaggtggccgcggcgatccatagcggcaaagttggcctgctccgctactctgctccgggcctccggccgccgcccgtccggcaacaacaagaactccccatcttccgcgcaactccggcgatgacgaccgcccgcgccgccgctcctcctagaccgggtagtgtgacgtcgccggccaccaccaccaccagatatcctgagttggcaggtgagggggacgcgaccgccgtcgccgcgcaccttgacgccggggtcacgctactcgacctcgatcggcctcgacaccggggtcacgccgccgccgtctactgtcccgattcgcgctccatctcctctcgtcgtcgtccccgctgcctttctcggtccggtccgccacgtgcatgccgcgctcgccgaccgtgactagtgcgccccgacgtcacctcccccgccactcccttctcacccttcgaccaacctagcgaccgcgtctccagcgccgcgagcgtcctcctcaccatcgacgccgtctcctctcccaacggcagccgcaaccagggccacctctcgccgccccttcctcttccgcccacagccgccggagccacctcccgctcctctccctccctcccgtcggccggcgcgtgctgcctcttctcccgccggccgccccgacgagctcgcctcctccctcgtggcgctcctatcgaccgccctctccgccagcgcggcgcgcgccgccgttcctctccctcccacccgccggccgccactcctctccctccctcctgccggccgtcgctccattcccgtcggccgccctctccgccggcgcggcgctcgcatcggcctccggatgccatcttaaaagaagaaaaagaatgaaaaaggaaaaaaaaaagatagacagagaggatgacatgtggggcccacgtgggtcccactttttaaatatatttttgaatgtgaaactgacatgtgggtcccacaggttttattatttttctagactgaattgccacctaagcgccacatcagtgccacgtcggatgaagaccgagtcaaaataaccacgtaggcgctacgttagccaaaaccaccatcgaaaccgccgagggatcttatctgcaccggttatgatagttgagggtcaaggacgaaaattggattcgttgataagttaagggacctctgatgaacttattcctatggagaatagaaactcgaagcccaagatggcactgaactggtcatgggcccatgggctccaggagaatacattatgtgggtcccacaggagcggcagtgccggatcgactgtgtctcggaatcggtgtccgactccgaattccacactgagtttggtgctcatgataaattcagatgctggccctgatgagagctcaagcaattcgatcgcaagctcatcgtcgccatcgatcagagcgcattgcacttgctgatccttagcttagcttagcttctccggtgtgatccggcgtcaccggcggcgcgcggccatggcgtccctgtacgctccgcagctgacgaggtggcgcgtcgcgacgtccggcggcgtcgtgcgcgactgcgtggagtacgacgggaagccgctcttcttctcgcgcgaggattgtcgccgccgcctcgtccctgacgacgacgaggaggacgcgcgcgagtgcctggagatcgccggcgaggtgttcccgctgatggaggagaggacggtgccggcggcgctccacgacggcggcggcgtccgcgaggcggtgcggtgcgtggagtacgtcgacgacgacggggccgtgctgctgctcacggtgacgacggagaaggaggtggcggtggtcgacggcggcgaggtgcgggtggtcgacggcggcggcggctactacgaccccgactccggcacggtggagcacgtggtggacgtggaggtggagggcgcacgtgaggcgtacgtgctgctcgtctccgttcgcgaggagctcaaccgcatcgttcgcatcaagaggctcaactggtcattcctacgccgtaatttctgaaaccattggggaaaaaaattccgatgatgtacatggatgcccattacgtacaagtgatgatagatgttagcaatgagctatgtatgagccaaatttttgtatttggatagattgtgcttggtgtgaaatttgtaacaagtatttgtgcatcaaatccctgtattgattttcagataaattaataacaacgatcaacacagagtttcagatattttttgtgtccatatcaaaccatctagttggatggaaataaaatgtactcctaaataaaaagagttgtctgacaatttgatccatccatattctgaatgtgtctcaacgaactgagcatgccatggcatgcatcatggcaggatcatgcatgaaccgaacaaacccttatgcttctgcagttctgcttctgaacgagatcatatcatagacatctaacgtccattttcagtcagcagttatgaatcatcaccaactgtttgcacaggagtatagttgcaaaggagtaaagctcaggggctcaatattggatcagagcttacctatactttactactagctccaatcttacttataactagtataagctctaagatcgcaaaatctaaaccgacagcgctctcgatttagtgttaaaagagcgatgcattcatacgtgagaaaaggtccagtgctatagtacgtgagagaaggtccagtgttgctagtatagttacgtgagaaaaggtccagttgttactagtgcacacaatgcatgtctattttttttttatagaattttctctcaaattacttatccgatctacaatccaattacacaattgtgttcattgcaattaaatcttcagaacaagatcttacatgattatattacgatgaaataaaattatatttgtaaattacttttattacatatgtaagttacttttatcatatgtttgactaaattacttcttagacatataaaagtaaattcaataaagtctaaaagtaatttacatatattataaaaagtaacttaaaataaaacggaagtaactttgtcacgacattagaagtaaatttgttgtagggataaaaatatgactatctagaaattaaatttaatcagcacagatcaacacatgaaagtttaacaatttttaaaaataacttcaatgttaaatggaagtaacttttgcatggttcagaagtaactctctataaatatatcttaaaaacaatatgtgatttaaaagatataagttattaaagagattaaaaaagatacatactattgcatttttcaagttgaaatgagacactagaaggaatacaaaccggctaccactagctgtgtagtcacgtccaaaataaaaaaaaaggcatgcattaaagttatttttttgttataagttacttctataatatatgtaaattacttttaggctttattgaatttacttttatatatccaagaagtaatttagtgaaatctaaaagtaatttagatatattataaaagtaatttatatttttttatcaaaatataatcatgtgagatcttgttataaagatttactgcctccgttttttaatagatgacaccgttgactttttctcacatgttttatcatttgtcttattcaaagattttatgcaaatatataagatataaatcacacttaaagtactatgagtgataaaacaactcataacaaaataaattataattacgtaaattttttgaataagacgaatggtcaaacatgtaaaaaaaagtcaatggcatcatctattaaaaaacggagggagtaattattacgaacacaacggtgtaatcggatcgtcgatcgaatgagtagtttaagagaaaattttatttgaaatatatgtggatagggtctaacatagatggagctaccactacctgtatagtcacgtccctctaagatgtgtacttccaatgttaaatcaccatctttctatctatatgacctttttaatattctgcacggtttgggtttggataattgggttcaaaaagaaaaaaaatccacaataaatttcatagcaaaagattggattccacgaaaaataaatgcacacaaacatttgggttcctgaggaaaatacaatgaagtcctcaagaaaattggaatttctagggggtgaaggcaataaattcattaaagatacatacactaaattcttccaaatagtattaaattcctcaaattggatgctcaaaggcattactcctatttggattccataagagcaggtacaatagcaggctataagctggctataaccatatatcgagaaaaaaagagaagagagaagaaagcgggctacagatttgtagtcggctgtaacacggactccaagatattatgtgtgtatgagaggtgggaccaggtattaatgatgtagtatatttttatagttagctattgtatgaatagactattagattgactatagatgttttggagtcagtagttggctatactattgaccttgctctaagggaaaaaaacattaaatgcttcaattaatgagtttttttatatttgggattcttttcaaagcctatatatacacaaactagctagaacactcatagcaaaatcaacaaacacaagaactagagtaattaatcaaggagttcatcgatcaaactgagttgggttcagcaatggcgagaccagctgctgccgtcaccgtcctcctcgccgtcgtcgtcctcgtctccgtcgccgcctccctcccctccgccgtcgtcggcgacgcccgcttcgtcgcccgcacgtgcaagcgcaccaaccacaccgagtgcgtgaagatgctcagcgccgaccggcggagcgccagggccaccaccgtgcaccagctcgccggcatcgcggtcgacatcgccgccgccaccgtgaagtccagcgccgccgccgtgtacggcaagttcctggagaatcacggccaggtcctcgagctgacgctgctcgagtgctggtggatgtacgacctcgccgccggcgaggcccaggcggcggtcgacgcctacagctccggcggcgcgtacctcgacgtggtcaggcaccagctggccggttactacgccgggatcatgtgcgacaacatgatcgtccgccgctcgaaggtctctccggtggccgacatcgacaggacgacggcgacgcactgtaacatcgccgtcgatctcatcgggctgctttactaactgaaagtttataggattgttttacctcctgtaaaataaaataaagtggtaacctttcaaagacaatgaaaaatggcagtttgaagttacaaattgtgcatttcgatatagtgaaagattttcatgcccaaagtacaacttcatcacaaaagaaatcacagagtcagattttgcgagcgccgtcggctgattttgctgattggtggcttacagcccaaaaatctgttgctaaggttgacgataaaacattgatgcgggggtgatccttgtaacctggttgatttggaaagagtgaaacacaagggtgttcgaagggatcgtggcaacggttccatgggggatgaacaggagacttgcatagctgcaggacttggggcggatgaatgagagacttggatagctgcacgacttgttaacctcatatgtcactctgtaacaactcattctgtgagattttagctttctttttatgtctataatggtggtgcattgacgtaccgcgctaccttgtacattcccttttttactcttaatatacatcggccagctattcgccggcccatcgaaaaaaaacagagaaagttagatttctctcaatagccgatgtttgccttagattattgttatggattatctacttaaatatatgaataaattaaatagtttttagaaataaatttaataaatagcttaaaataagcagtctaagtgaagtacttttaagaaaatatatttttaaaacatggagcaaagtaatccatttcacagtccggtaaataaactaaaaacacggccaaagtagcttcaattcttccagtgagaatcaaggatttaatagctacttatattatccatgcatgattcacaagttaaacaaagaatcaaagatgaagcactgtagcccgtctatgaaccatgattgagatcccagaatatatggcagggtgatacgtgacagcagcacaggacgattttatatcgcatttgatcaccttcatcccagaaggtactttgacaaaaaaaaaagcttcattcagtgcaatgtaaactgtaagagagaaatcttatccagaaagcagtttatttctaaaataagctgaaaatctgctgggttaaaataagctgaaaatctgcatcacagaactgtggcaaaagacaccttttctccaaagcggagattacagatcaagaacaggcaggtctaatttgcttaggagtccaaaagattcaacacattgcatgaactgctaacagacagaaacttggacactaaagatgttgcctttgtgtcttcagacctcctggatgctcaaacctggaccaaggaatgcaaagtcatcaaatgcaaaactttggtacatgaaaaaaaaaactctgcattcacaaaacaaaacagacagctcaaatagcttcttggtcagaacagtgaaggaccatacaaaacgagacagagaacaaaaggtgacagccttttgtgtctgaaacgaccatagtccacgtccctcaaatctcatagctactgcccatcactgatgaacttaaaaattgaactagttttgacaagccacatgcatcataagaattaaaaggatggcttaaagctaaaactaattgcaaatccatcttaggtccaaacaatttatcttcatggggacatcccaaataacaaaggtgaaatatcataatattttatattgtacagttgtccctcggatctcatagctattattgaccatcactgatgattcttgataatggttttagccacaagccatccaattgtcaaaatggtcagacagaaggcttgaagctaaaaccagacaccaaacatctttggaccaaaactttatcttcgctagggcatcaacttaccagacactttctgtgaacctggtgggagaaattgcttcaacttgtttgcattctcagcaccaaagaccttggatacttcattaagatgttgcctttgtatctttatacctcttggacgctcagacatggatcaatgaaaacaaaattatcagatgcagaaatttatataaagaaaatctctacatcattaaaaacatctctatttttaaaaaaaaaacagaattgacagctcaaatagtttcttgatctgctaatagttttttttttgtctgaaaaaaccataacccatatccctcggatctcatagctattgccaatcactgatgaacttaaaagcgtaacctagttttaaccaaaagccacacacatcatatgaattaggaaggatggcttgaagctaaaactaattgcaaatccatatttggtacaaagtttttatcttccttggggacagctccaataacacatccagttcaagagaaaccaaggataacaaagaactgagataccagaatgtgttgacatctccaataacacatccagttcaataggaaccaaggataacaaagaattgagataccagaatatgttgtactgtagggttgtccctcagatctcatagctattattggccatcattgatgattcttgataatggttttagccacaagccatccgtgtcaaaatggtatgacagagggcttgaagctaaaaccagagaataatcatctttggagcaaaattttatcgtcactgggacatcaaccaacagatataagcaataccagcattataaacaacaaacatattggaacaaagcatcatgttgcagagaaagaatgcccatcaataagaagaacaaaattgtaagcaagatttataccagcacaaactactcagatacccaaacagaaatgagatagtgctaaacagaactagagccactttttacaaacctggtgggataaattgcttcaacctgtttgccttctcagctcgaaggtgcagagggtgtacatgtacttggagcagccgaccttgaacttgaaaacatctttgctcctcttgatgttcactgaacgagcatccttcttctcacagtgagaaagaagtccttgacctcacgaatctgctttggctacggaatcataataattgtttagtttagagtttagacacaggatgacagtagataacaaattaatcggctccattctagcatcatatcacatttgaaatttacatgcacatcaaggaaaccacgcaagcagtagcatgaagaaaataaatgttccatgacagggatattgggaaaacataactagtcctggtgagcatacagaaatcctacctacaaactaggtaaacgggtgtagattacacaa

SEQ ID NO: 41987 - DNA, 20674 bp, Oryza sativa
ccgaaattgttgtttatcgtcacaagtagttgcttagcttttgctgccctcaaaggtacatggccaacatcaaagttcttcatataatggctgcattctaagtcttccctgacatatccctttcctgcaaacattatgacagacagtaagcataaaattcttcaagaacttcaacatatagaggccggattgatatacattatttaaaaaaagataatttcaacacttgaaaacttctacactttagccaaggagggtcatattagtagttacttgttatatttgatgcaaaactgaatttcaactattagtaatgtgacaacctaagctatagattgacatacctgtagatccaaaagtttcaatggcataaaattccccctcctccatctttgtttgttcaccacctttcacaactggaactgatttcccaaaatggatttggtatggcccaatgccgtgtccattgaggttccgcacactttttactgccgcatagcaataatttaatttgcgttgtcaacttatcactttacgttaccagtgtgaaatgggaaaaagatgcactagcactaaccttggaatacttttccattaatttcaacctcatatgattccatgacttcttgaattgctgcgccaacatcacatagccgtgcatctattccagcttcctaaaatgaagggaacaaccaaaacactactgaagtacaatggtagattctattacaatttagagaaaataaaacaatagattcattatacatccatcaaatcagtagtgaagaacaccatgcaataactagccaaaaaaactgtataaatgctacacaacaatttgactaacagtttaatgaacaactatgaatggattccgttaaaacaagcccttaacaagtgacatgacaaaggtgttttcttaaggggccatttccaagcccattgatttgctatattgagggcttcagaaaatgcacagaaaagtgtagagaattaccttaacaccagcatttgtggcatctcttgatgcttgaagcaatggatcaaacatgggattgaatgcaacagtgaatgcgctatcaactatgtaccctgagaagaatcgaaataccaaattatttttggcagtagaaaaggtgtgactttatactttcaaggacaaagccacaaaaaactctgacgcgtataacaaacaatatacataccatttatatgtgtcccaaaatccagcttcatcacatcatcatattgtagtacagttttatcaccaccatttggagtccagtgagctgcaacactaagcattgcatttttgttttcgttagtttcataagggaatgcagagtaaggaacttacgaagtactaaatgtaaaatactggaataccgtaccaattcaaggagcatcctgttggaaaggcaataccagcttccaatccattctccttgataagtttcctgaccatgttttccaaagtttcacatagatcaatcattagcatcccgggcttcaaaatgcttctcatatacttccggacctagcaaaccacaacatatgtttcagagttgtaacatatagagcatattcaaatgaattcgcaaatattcaaagatatcaataaattttaaacctgtctatgaacttctgctgcccgacgaacagcattgtacattggcttttgcaatctttccagttcccgcttttcttcactagttgtcctccataagttactgatgagcaatagcacaattaatttatgcaaacatatgctcactgttattacagtccattgaatttgccattaggaatttttagaggtgaaaatggctaagaaattagtgtgccaggtttgctattatatacaaattttatgaggattgcgtaaaaaaaaacaaattttatgaggataaatgcatacttactcatccttatagtgttggatctcaccctcaggaaattctcctgatgggaagagttcatcaacagggatcgatggaggatctgtctgctgaagaggtcccttcttctttctacagaataaataaattaaagcatggttctaaaaagaaaaggaacagtaatggcttaatttaacataaacttacttcgctttgcttttcttctttttcttcttggcagctattactgttccttgcaatgagattattttaacttggaatgagattatttaatagcaagtgctaaagagaattgcaaaagcttcaactctagctgaggaactcagcaataagagcttgcaagtcagagttgtcaccttgtgctccatcttgagacggatagtccacttctgcatcatcatcattttctggtggtgagtacggagctcctttgctatctgcaactttgcttgcttttaatgaggcctcctgtgtttcaaaaccgacttcctcctgcagccaaagaagtaataataatgttaacttaatagaaagtaaatttatagaaaggcaatgagccaaggaccaatgaaaagatggaagccatgagaggttcagctatcctagaaaccaaatgtcatttactattaggtggagtattgaaatcatacatatagctttcaaactcctggtatggaaatggtacctctgatctctaacaaaaaagattagcaaacaggccattggtaacaacttacaaggatatattaaggtaaactatgaacataaccaaactaacaatatcaataaatgagaacactgcaaacactgaataacaggttaattctaaacggcattcgcatcattgtctggcacccaattttcaaaagttacacatctattatcacggtatcacctatggaacatggtagtgcaaagcatggtcagcagtattgcttagtgcacaaaacaatttaattcacgccaaagatgaaactagtgcagcacacctactttggtttcttgattttgtccgatacataaagcctccatctccttgattgccacatcaacagaaccgcgaaccatattgcacgaataaattatcaaaatccaataaattattacaagcctgaatgacacagcaagaagaacataagcatcagtattcagtacacccaaaattccaagcacaactaaatcacaggacatcaccgagtgcacttattcgccattccactcagaaaataagcgcaccttctagaatcaacacgaaaagctcgtggccatggcgcggcggcgaccatagaccacccctcacatgacataccttccttagtacaggctagaggggaggtgggggggggcgactcgcgagttcgccggaagagccgccggcgatcgcccgccgactgaagagcaggagagagcggcggaggcgtggctcgccgccgctgcctttgagtgagtcgtcgtcttgagtcacgacgactgttcttgtacgtgtcatcgccgccgacccaacctgaccggcactacaactgggccacaccaaccagcaagaaaaagcccaacaggcccactacaactgggccacacatcattaatgggcctaaactttcgtgagcccggcccagtaagagatgaaaaggccataataagacggtgagacccagacaccgccgatccccgaaacccttctccctcgcgtcgttccgccgccgccgccgtcgtccagggcgaagcttgcgtagagatagcggcgacgatgatggcggaggaggggacgcagcagctgccgtacgtgcgggagacggtgctgaagaagcggaaggtgaacgaggactgggcggtcaagaaccgggagcggaaggcggccaagaggcagcgccgccgcgacgacggcaagggcgccatcaagaggcccgaggacttcgtcagggagttccgcaacaaggagctcgacttcgtccggatgaagacccgcctcaaggtccgcaagctcccccccgccgagaccctcaactccaagctcgtcttcgcgattcgcatccctgggtcagtattattactgtattttagcagcagtacaagtgatgaggagttcttgtttttgtttctgcaaggtttgtctcttttcattggtgatgattgcggttcacaattttaacaattttgtttgtgtgtaatctgcagcacaatggacttgcatccacacatgaggaggattttgcgcaagctgcggctgacgcaggtcctcaccggcgtgttcctcaaggccactgacgctactatgaagaggcttcttgttgtggagccgtttatcacttatgggtaactgaactcaaacatgcttctctattaacagttcttttgtacaaaaacatattgatttgtccatctgtagcttgcagtgctgaaattttatttattgttgtgtaatataggttcccaaatttgaagaatgtgaaggatcttatttacaagaagggccgtgggttcctggacaaggaacctttccctcttaccagcaatgatctcattgagaaggtattgttttgttacaccttataaaacttgaggttgcacggcattagtaaatttgtctacaacaggctattttgcaatgagcatgggaattgggctggcttattttggagatatagtttatataaaaccactaggtgtagcgctgtctgaaacctgattctttaatctcggctaatagttttgttgggttctggacctcaaatttggcatgctacaatacttcatttaggatcaattccattgttgcatgcactgctttggtagagctatttctgtctccttccacaagtgtaaaaatcactgtggttatgcttttttttgtgtgttgattatcatctcggttatgtataatttcccagacataagatacattttcatcagtctctaaataaaacaaaaggatatttggtttcagttttcgatgttgaagacaatctcatggtttggtaatgtacactgaaatatacccatctgtgctttttttctgaaaacaggctctgggagaatatggcatcatatgtttggaagatcttgtgcatgaaatcgcatcagttggcccacacttcagagaagcttcaaatttcctcatgcccttcaagctcaagtgtccagagaggaggttgcagatgaagaagaaacccttcaaggatggtggtgactcagggaaccgcgaagataaaatcaatgaattaattgagaagttgaattagtgcagaacctatgcccagtcgtaattcatgtgcaagggatggatccgttataccttgtcagttttgtaatagcctagccgattgtacctttatttctgaaagcttaatagagtgttcatgctcagattatgaaatagcagaatctgttttcctacccgccttctcgttcttagttttgatgaagtgattctactgaatctagcttttgagaacctctctgaccaagtaacttgagttggaaggtactacggcatattgtgatgaaaatgtttccgccttactgaaacttgttgctgattatatctgacccaagtggtttgagatgtaaaggttctcgttattgggtattcccatggaaatggttggtttcgtgctctgtttttttttgggagaattcgtcatgtttgtttgggatttgttcgttggaagtatgtttagcaaatatttcatccagactttgtcaaaatttggcctttgctattctgaattctgatgcattcgtctcaacaggatcatattcgaagcccaggatttgccgactgccgtgccagtttgtttcagcaaagtatgtttttgctgataagaaaagacggcgagggccgaggagatttcaacgaaactgccaaccaaactggtggattccacgacatgaatgcactacgcaaaagttagtcttttttttttttgagaaggacgcaaaagtaagtcaagttgtaaattttctccatattatactcatacgggccaaacatgcccacttgaattacggaccagagtgcccagagcgcttcatgctttgcctttcatcttcattcattccaccgtgctttgcagctgagaacgcaacatggcggaatcgcttcccggtggtgcgcggggtggctggcaaggcggcgaacgcgctcgtccagagcgtcacgcgcgtgtgcggcgtcgacggcgaccgccgcaagctggagcgccagcttctggccgtccagtgcaagctggccgatgccaaggcgaagagcgagactaagggtgtaagtgggtcagccgcgaacctacttataggtcaaaataagcgggctcgcggcttattttagcctataagtgggtttcacgggttagccacttacaaccctaagcgagaccaaccccgccgtcaagcgctggatgaaggacctcaaggctgtcgcctacgaggccgacgacgtcctcgacgacttcgagtacgaggctctgcgccgcgaggtcaagatcggcgactccaccacccgcaaggtactcggctacttcacgccgcatagcccactcctgttccgtgttaccatgagtaggaagctgggcgatgtcctcaagaagatcaacgatctggttgaagagatgaacaagtttggcctgatggagcacacagaggcgccacagcttccttatcggctaacacactcggggctggacgagtcagcagacatatttgggcgagagcatgacaaggaggtgttggttaaactgatgctggatcagcatgatcaacagaatttgcaggttctccccatcgtggggatgggcggtttgggcaagacaacgcttgcgaagatggtgtacaacgatccgattgtccagaaacatttccaactgaagatgtggcactgtgtttcggagaactttgaacctatttctattgtgaaatccatcattgagttggctacaaatagaaaatgtgacctacctgactcaattgagttgttgcgaaggcgacttgaaggagtcattgacaggaaaaggtttctacttgttcttgatgatgtatggaatgaggacgacaacaagtggaatgaacacctaaggccacttctgaattctgtcgggggtccagggagcattatagtcatcacaactcgcaatcggcgggtggcatctataatggaaacccttcaaccctataagccagcatgtctaagtgaagatgaatcatgggaattgttctcgaagagagcgtttggtagagacgtacaagagcaagaagatttggtcaccattggcaaatgtattgtacataaatgcaaggggctgccacttgctctgaagacgatgggcggtctaatgagttccaaacaccaagtcaaggaatgggaagccatcgcaagaagtaatattggtgatagtgtcaaaggaaaagacgaaatcttatcaatactaaaattgagctacaaacacttgccatctgaaatgaaacaatgcttcaccttctgtgcaattttctgcaaggactatgagatggagaaggacatgttgatccaactatggatagcaaatggttttattcaagaagagggcacaattgagttgtcacaaaaaggcgagtttgttttcaatgagttggtttggagatcatttcttcaagatgttaaaacaatattattcagaagcttagattatgactttgttgtatgtaaaatgcatgatttaatgcatgacttagcaaaagacgtttcaagtgaatgtgcaactacagaagaactgattcaacagaaagcaccatctgaagatgtttggcatgtgcaaatatcagaaggtgaattaaaacaaatcagtggatcattcaaaggtacaacatctctccgcactttgttgatggaattaccattatacaggggtcttgaagtgttggaactgaggtcatttttcttagaaaggttaaaactgaggtcgttgagaggactgtggtgtcactgtaggtacgattcttctattatcactagccatctcataaatacaaaacaattatgatatcttgacctttctaggtctaatatacatagactgccagattcaatatgtgcattgtataacttacaatcactgaggctcaatggctgcagctatctagaatgtttacctgaaggcatggcaaatctaaggaaactcaaccacctttatctgttgggatgcgatagattaaaacggatgcccccaaattttagtctactgaacaatctattgacactaacaacgtttgtcgtggacaccgatgctggcaggggaattgaggagctcaaacagttgagataccttaccaatatgttggggctgtacaatttgagaaaaataaagagtacatcgaacgcgaaagaagccaatctccatcagaaacaagagctgagtatattacgattattttggggctgcatgtcatcctacatgcctggagacaaagacaataatgaggaagaaatgttggaatctcttaaacctcacagcaagcttaaaattttggatttatatggttatggtggaagtaaagcctcagtgtggatgagagaccctcaaatgttccggtgcttaaaaaggctcattattgaacgatgtccaagatgtaaggacattccaacagtgtggctatcagcctctcttgagtatttgtccttgtcttatatgactagtttgatctcattatgtaagaacattgatgggaacaccccagtgcagttatttccaaagttgaaggagttgatattatttgttttaccgaacttggagaggtgggcagaaaacagtgagggggagaataatgatgtgatcattttcccggagcttgaaagcctagaattgaagagttgcatgaaaatttcaagtgttccggaaagcccggctctcaaaaggctggaggctctggggtgtcacagcctctcaattttctcactttcacatctcacatcattgtctgacctttattacaaagcaggtgatattgactctatgaggatgcctttggacccttgttgggcttctcccgtgagcttagatgttagctcaccagcgaacatgatggtgcctctggaagacaagaaaagccgtagacccttcgaagccctacggagcttgactctgcgtggttctaactgcttcttagcaacgtgcagtttgttttttgccgggacggccaaaggtaggccggccaatttcattaagattgggggaaataaagttttaattacaacgacatgaaggatgtcgcgccggtctcaggcaaactcaagcccggaaagaaaaagaaaaaatggggcaagtcccgcctctaatcgggattactcgctagcatgggaaaaaatccctgctgccctccaaattgcgatttcctcgttgatgtcatccgctagccggtcaaccgacttggcgatgtgttgaaagatccttgtatttcgctctttccagataagccaacaaattagcatgaacagactatcgaaatccgtcctatacgtgttctgaaaacgccgtcttgtcgcgatccaccaatctgcaagcggcatgccatcttccgcagggattgcaatgttaatgttgtaccaacgtctcagcttgcgccaaaccgccgccgtataatcacaggacacaagcaaatgatggcagtcttcgttctcgcaacgtgcagtttgtcaaaagtgcatcttgggctctgggagtgctttgcttttgtgaaggatttgactgtccatggttgtgatgatcttgtgcagtggccaatggaggagctccgttgcttgatttgccttcgacatctgtcttttcgtgcatgtggcaagttggaggggaagtgcagatcatcggatgaagcccttccgctgccccaactagagaggtttgaagtatcgcattgtgacaatttactggacatacccaagatgccgacgtcacttgtgaatttggaagtttcacattgccgaagtttagtggcactgccttcgcacctgggaaatctgcccagactcagatcgcttactacgtattgcatggatatgctggagatgctgcccgatgggatgaatggcttcacagctcttgaggaattggagatttttaactgtttaccgatagagaagttccctgagggtctcgttcgacgtctcccggccctgaaatccctgatgatacgtgactgtccatttttggtaagacgcttccaagagggtggagagtatttcggcttggcaccgcatgttaaactgagtcaacgacagaaagtacgcggcatgattcactgattcgtcatttgccaaatatttcatccagaagtgacttaaatttgtcaaacattaggccattgctgctgttctcaactttctgatgcattcgctggtctagtttggagttttttgtcccgtcccttcactgccttgcccctcacaagtcaccaacgaatctcacctctcgcggactcgccccgctctgtccttgcttccctcctccgccgcggtgttcagggcttcaggcggcggaggaggcggcggggtggatggcgccggtgttcgagaggctgacggggatccgagcactcgccgactccgcccgcttcaaggtatgccctctcttttccccctcacctatccatcaagttagcaaccgccgacctgcgcggaattactactcgttttgctcattcagttgcgcttgtgcttgtgattattcccctaaccattgattactcgtgcgtttcctagttatggtaactgcgaatcacgcggtcgattcaggggtggatatggaattatttgggggaaatttcggctagaaaatttacggggaaagttgatttcccacccagcgcgtagtactagcatttaccactagcacttcttctgctcgtttgattaaagctgcatttgtctggcttgcaggcgtggttcctcgaccagattggtgttcttcaccatgggaatatgccttacctggtgccatccttgcatgtatgtatcttggtacacactgtatataattatattctctaacttatatatccatttctcttattttgttctacatctgactcaatgcactgattaagttatatttggttgttgcactagtgttcagtttacttttttttccccttctctgatgcgatgcactggttaagttatattttggttgttgcagtgggaaaggggcgaagatggttatcattagcaattcgttaaggaggtcgactgtaaccatggagaagctagagagccttggtttcacaactcgtcttgtttcctctcggggccatcactagcggggaactcacacatcagtatcttcacaagaactaagcttctagctgtcggtatcttctgctaacagaagctgcagtggggtctccttgaggaatgtggggtgcaatagatattatgatcagaattaaagttggcttaccagcagtgatctatttaagaaggtatttctgttgttgcaccttctaaaaatttatgttaaccatggaaatttggaactttcaataacacatagctctcagtttttttttttttttgcgtggacttattttggaggtctagtttacaaaaaaaaaattaataaaaataaaaatcactaggtgtaacaatgcctgaaatctgattctctaatctcaattaatatttttgttggattcaagagctcaaatttaaaatgctaccaggacttaatttaggatcatcttcattgtcacctgttcggtggagcaatttttggtgtcctgccacaagtataaaaatcatagtgggttatgcttaaatttttgcattgataaccgtctcgatcatttgtaacttcccagacataaagatgcagtttctgtctccaaaggaaaacaaaaaaaaggatatttggtttccctttttttggtggagtaaagaagatacttctagctgtttctcatggtttggtaatgtacactgtaacatcaccatctgtacttcactgaaaacaggctctaggagaacatggcatcatatgtttggaagatgagcatgaaatcgcaacagtcggtccacacttcagacaagcttcaaacttcctcatgcccttcaagctcaagtgtcaagaaggaggttacagatgaagaagaaaccctacaaggatggtggattggtggtgatttgggagaccgtgaagataaaatcaacgaattaattgataagttaaattaatgcagaacatgccccaaatcgccatttgtgtgcaagggatgaatccattaccttgttagctttgtaatagcctagccgattgtacctttatttctgaaagcgtacctgaatgtttgggatcagattatgaaatagcataatctgttttcaaacctgccttcttgttcttagctttcaagtgttgtgccgaaactagctgctgagaacttctattctctgaccaagtgacttgagatgtgaaggttacagtatcggagagattaaaggggaccgcgaaatggagccaccacagcgctccggggcttttttggctggcgtgttcgcttccggtgatatccacgtcaccctgcgctggagctggcaattttgcaaaaaaaccctcgctttctttgataatcattcctaactgcctggtcgtacttctctgtattttgtattcttacgtagtggtcctctatgtactggtattattatatgtgaaagagaagaaattccgaatatagggggcgcgctctaaaacaagaaagtaagagggttttcttgcaaaagaaaacatccccatcctccatcccctcgcttgtccgaaaccctagccgccattgtaccccacccttctctcgattgctctttccctgcctttgcggcgccgccggtgctgcatcgtcttccctccccctcacccgcttctcctcaccgcagatgacatccctcgcgctctcccccgccttcctccatctcctgggctcctggcgctccccccacctttgctcccttctcttcctctctctgtgaggtcaagcaggggattggatggtgctgcgctagctccgaggatgctgtgatggagattgatggcgtggggatcgatcttctggccccgacgcttgatttgggagattatgagaggagccaggggcatcgggccgacggagggcgccggcgtagcaaggcggatggcgggaggcggcggacggcgggaggcggtggagggagctcgtgctcggtgagggcggaatccgtccccccggcggcggcggtatcggggcgccgccgggagcaacgcggcggagaccggcgggcgcccatcgtggagtcccaggaggggtagcgaggaatccgggcagcggcgacccgcacaagtcggcggtggaggcgagtccccccgcagcggcacaggagacggcgaggcaggtgccggcgtcatccggccgggtggagatggtgacgacggcgaggccggagctcggcgagatgggattgaccgcaacgacgacgacatccagatccgggcggcagcgtggatggcggaggatgcatcgacggtgaaccggcggcctgcaggcgtaggcggctgcggcgggcacgagctccccaggcggtggcggccgcagaggaggagccggcagggacgggttcccccgtaccctgtgccgcgccgacgacgccgcgacgaccttgacgacgccggcggagcttgatggagatggcaccggcggcatcggggcgacctcgcaccaggtgaggccgacgaccagcgggcggcgcggcctaccaacgacgttggggtgctggtggagatcgggtcggccatgccctccagatcagcgacgacgatgtggacaatatgatgctactgcttctgcttgattgcttcacaatgacgcgaacgaagaacagccgcatgtgtagatcgactgcagaagtccgaatcacaaatcagaacaagaaaatttctctgtgttttatttttggcttgggattgtgcaccgaataccagatattcaagcagatattagtctgaaaaacattctttgtaagcttgtatgattgagggagattataactgataattcagtggcttgatgtaatcaaagaggtttagtgggtgttgtacgttgttaatgtgtatgtgtcctctatgctcctttcagcttaaatatgcattgtatttctatagctcttcatcggatataatttattctctacaaaggtattgttatgcatgtagataagtggaacctttttttagagagtaataagtgcatcctattataaatatcaaatctgatgactccttttgtcttattcatgtaaaaagggttagttgctaccatatatggtgctcaggtatgtcaaaactatagggggcatgtttcttcctaatatgtgtagtagatttggctatctagcaaccttgtggctatgctttctcatcttatactatgctaagcagttgcattgcagtttaagatgtatcattttatacccaatctttagaaatttatgaacatgatgtcagattttgtggccacatactctttaggacacccacatctacggtagtttaactgattacttctcacattatatttcaatagatgtattatccttttcttttgagtgaaagaagagttttggatgctacatttagttctttgaggagtattttggatgatcaactgaccgttctattgccaaatctagaaatcatttagtttcttggaattattcttagcgaaggttgttctataaattcctttatcttcattcacataagcggatgcttctatcttggtattcatgctttcagctacacgagatgcaacatataaatttagttttgcatatgatggaactaaattagttttttttaaagaaactgaatctcactaaaatcatctttgattatatacattgatatgtctttctctgttaagcatgataagttttcataatttctgaactaactcttcagtgatttctatcttgaagaattcaaccactattcctaaaagtgacacaaatgtcagaattcaggtgttgtgacaatctgtgttggaatgaagacctccagaacttaatattgaatgatgtaaatgctgtgacactttgagctgaccacttacaattgaaattaatcaaaaaaattatcgattgatctgaatgactatctttggacttgatctgattctagaggatactatgagccttatcatgaatgtctgatttttcttcaggtttgaatagcattgttatgtacagtcatagatatgatcgtgggcatataaagtttgatatggtactcttcaatttatattagtacaatatatacttctggtttatattgctctcaataaacgataggacgctgtgaagcaagatgccattgatttcataactaaatgttgagtgtctatttgttgctacctccacaaggcaattgggatgacatttcatatttttgaacaggtgatcttcttctgttgcctttgcctttattttctttgctttttccagatttccaagttcttctgttgcttcttgcctttttcgatgcagcataataggaacttacgtgcatttgttcacatgaacatcatatgatggttcatagaaccttagtcctaaatccattatccttagttatcctcatgcacatactccatgttattgcaactgtcaatgactgttctaatgttcactgttgacgtgatagttagcctttctaaaaatttaccatgggtgcacagtagaataaactaattaagctaaactattcatgggaggattagaggctgtagcacctgtacagatcatttgttaatatgacaaaaaaagaaatcctcttttactgcacgcactttatcatatggcctcatttagatgtctaattgatattctgaaattggtcttactttggatattcttcctcattaactaagtattttctcgatgggaaggtcatatactagcattacaaggccacctgaatcatggaacaagaaggccataacaaagttgcttgacattagttgcaagattgaaagaactattgcagagcaccatatcaatgtttcagagtaggagtttaattaagtatgcaagaaatggtttatgtgctttcatgcaattatatttaagggacttacaatttcatagttgctgttgatttaaatccaaaaaacttcttgcctaggaaacacaacttactcttttttgctgagccatttattttgcatcatcctagctctgttaaaattacgtcctcatcggctaatgaaaacgttgattaatgtacatcacagttgtgtttctatgtacaagaaggtgaaagattgttaaaatcaatgtttttctcttcagtttgccttctactctaggtgatactttgaagtgttggtcactagataagtggaatcttttttcaaaaaagagaaaaagaatgcaatctaattataaatatgaatatcaaatatgataattgattttgtcttatctgtataaaaaggattggttgctgccatagaaggtgctcaagtttgccaatattgtaggtgttggttagcttgaagctccgtcggccgtgcggcaccaccactgtttagcgattccatatctggtgatattggaaccatgtgttgttgccttgcccagggtccatttgcagtttgtttcccatggtcacttttggtgagttaagccacaaccagttcctttctacactcacttatgtatgcttggcgtgtatcttccctttcctgcctccagttccctcgttagctttgctttttcatataccattattcccttgcaaatgatagtctacctttttttttatcaagaatgctacagtatttctgatttgtactgcatatctttttatttggttgtgtttgtatatagttccaacaaccaaaagcttagatgttcacttcatgaaaccactgtgggtcgctctgctccattacatattttaaggaggtggtcaggacagggtttggatgattctgcttcattgtgttttttaaggtgtcatctagctgtttgatataatctcagagaatcaaatgcaaaatctgaagattcatgacctctttagatttcaggtcaatctaatctgaattaagactcaaattacagaacatagaaaatattttcttttttgttggattatgtttagtaactgcagaagtcagaatcacaaatcagaacatggacaattctctctgatttttttttcttaggcctatgtaccaaataccagatattcaagcagagattagtccgaaagacgttctttgtaagctggtatgattgagggagcatctagcagtggattttagctgataattctggaaaaagggatttaccattatacctaactctgccatttccacagtgtgctgcctgtaataatctccatgtcacattaaacgtgcgcgcgtgcacaccagtaaagtgtctactcagcttccaggattgctagcaacttaattttgcaagcaacgaaaaccagaaacctggtgcatacaaattctgagagtccccatgtgcgattgaagaatatttattttcttaagtgattgcaaacacagtccttcacattacaacttgtgattcatgccccgtaatggaactgaattaacctcttttaaaagaggatgaatgattaaaccgttttttatacattattataccttttcttgctcttttgggtatgataaataattgtggtttctgaaattatcaggtattttttatcttatagtattcagggtctatttcaaatcatcatgtaacatcggaattcaagttatgtcacagcctgtgctagaatgaagtcctttcgtactcaacatttaccaatataagtacatatatattctgactcgtggtactttttaccaataacaaatggtagggcgccgcgaagcgcgcctaaagttctagtattgtgaatttgcgacgaaaatgtttcaccttactgaaacttgtggatgattatgtgtctgaccaagcggttcgagatgtgaaggttttggatacattctaatgaaaatggttcattgcgtactctatttttcccagagaaacatgtggctcaatgtaaaatttgcttaaattttaaacctctgaattaacagtatgtaatacagtactacgtgtctcccacaggtcaccaaaggcaacgaacctcacccatttcggacttctacccactctcctctctccccttccctccctcctccctgctgggcttcgggcggcggcggcggcggcggtgggggtggatggcctccgcggcatcggcgccggcgttcgagaggctggccgggatccgggcactggcggagtccggccgcttcaaggtaatagcccccaccaccattaattaagcagctttgcgcggaattactgctgcttttgctcaatcagtaggccattgattattcgtgggattcccagttctggaactgaatcacgcggtcgattcagttatggatagggaacggggggaaatttcgactagaaatttattcctctgcgcgtagcatttgccactaccactgctgctcgtttgtttatatctgcatttggctggcttgcaggcgtggttcctcgatcagtttggtgttcttcacgatgggaagaagccttaccctggtgccgttctcgcgtgtatgttggtatacagactgtatattgttcagtttatattttcccttcgttgatgcaatgcactgatttaggttcattttggctgttgcagtggagaagctcgctgagaaaggggcgaagatggtaatcattagcaattcgtcgaggaggtcgtctgtaaccatggagaagctagagagccttggttttgacccatcctgtttcctcagggccattactagcggggaactcacacatcagtaccttcagaagtgagcttcttgctgttgatatcttctgctgacataggtttcagtggagcccccttgaggaatgtggggtgcaatgcatattatgatcagaattaaagttaccttaccatattacactaagcaaacaatgtttctgatactaagtagagttctttatttcgcttagttggagattactccttacagtgatatgtttatatgaggtaacttggtgtagcttacactgaatttcgaaataatctataggagagatgatccttggtttgcagctcttggaagaaagtgcgtccatctgacatggggcaatcgaggcgcaatttctctggaggtttgttgttcctgttacatctctcttcctatttctctctttcaagcagtattagcaatttagcattagaatttgttcgggctatgttgcaattgcaaacttgcaatccaatagtaaggcagattaacatatttgaagaattaatattgacaatgacaaacaagagataaaaaatattttacaattattattgatagtatttgcattcaaaatggactttatgaaatcagtttactttctcctattagggccttggtttgcaagtcgtgagcaatgtcgaagaggcagagtttatattagcccatggtactgaggccctgggtctaccttcaggggatccacttcccaaaagtcttgaggagcttgagcaggttctaatgctatgcctagaaaagcgactgccaatggtagtagctaaccctgattatgttactgttgaagcacgagatctgcgagtcatgcctggtatgttactttgtttcatatttcatgatattctgataatttagcagatacctaataacaatcattttcccctgatgcatggatcagtttagtcatactgtaactacagctatactgcttttcactatgtcaaccatttgttgtaatataacataaatggccaatctgtccttttaggcactctggcagccaaatacgagagtcttggtggtgaggtgaaatggatggggaagcctgataaggtataggacatgtatttttttatatatattactgaatggttcagctacttcaacatgttgaaatgtcagtcatgtgttatgatgagccacaagtttgataacctatagttgtaaccatgtgtaattatttttctcttgaataactttcagttttttttctgtgattatccttcatgaattttaacatctatcggtaacatatctagttcggttgcctaagtgctaatctgatattgctttctcaggtgatctatacatcagcaatgtccctggcaggggttaatcctcatgaatgtatcacagtaggtgattcactgcaccacgacatcaaaggtgcaaacgcatctagagtcgcttctgcattcattactggagggattcatgcaactgaacttggactcaatgagattggagaaatcgctggagaggacgccatcgattcattgtgccgcaagcatggctcctatcccacctatgttttgccttcatttacatggtagaaacacggtatacctttgggtaaatgcatcatctgtgtctcagaacatggtgcagaaaccgtcaattccagcaaggtcatgcagtataatcagtaattgtgctcttgaggtacctgctactgtgctcaacgtttcccattttcctgagttgttggcaaaggtcaaaactgagaccagcagagttcaggatgagaatagtcttatttcctgctggatatacaagatggtgtcaaacttacatgtgttttttatgatttgttttgcaatggttccttctctgaaccatttggatttcatagacagattaggggtgcagga

SEQ ID NO: 41988 - DNA, 9160 bp, Oryza sativa
cgagcaaaccatcaaacaactgaaaaattttgtgtgtgtctgcaccctctgttacccttttttccttgcatgttcccgaatgatactccctttgtcccaaaatataacaagatttagctatgaatctggacaaatatatatttggggccggaggtagtacatattgtgctactggtacataatactctgagctagctttaacagctgagaattcctgaattttccgtgtcatctgagtgtcgaatttgaaatcgtttgtcaaaatgaataaatgatagttttgtctgtcatcttgggaaatgccagttaccagactcccttgcaagattcagttgtggaaaggttggttggactcatcaacattacatagcttgtattacacttaactggcagctccgacgccaacattgccgcgttcgtcgccaagtacggcgcagtgatcatgatttcatgatttggtttgcttgtgttcaggtttctgattctgtttactgatgtttggtttaatttgcaagcatagcattgatgcttaagctctagagctacaatgtcattgtgtaccacatgcattcaacccaatctacattgcaatataaagtgattgacattatatatgaatcattcgttatcagctcaagtatcaacctcacatagtaaggtctttttgaaacgcagggtaggaaaaacatagaagtgtgagacggcatgttttgaacatagattccaaacattttgaccagacacgctccgacgaaacttaagaaaatcactcattttcccttgtgagtgcggtgcctaatgtctctcgataaatatcaaaggattggaattgagcacatgatacgaactttggctaagattaagaacctctcttaatagtatgataatcctatgactctgtttttcacatcatagagatccacaattgcgtgagatatttaacaatttgccactcttacaagtggcaattaaggatttgtcactggagccacatgtcatatacacacgagggcccacatgtcataaattgtgagtgacaaatccttaattgccacatcttaaaagttgcaaaaatttaaatgccggtggaggtttttttcatctcaaaaacttttcgggactataacaatgcacttttacttcatgaaacaatcagatctctaattacatttcgttaatcactcaaaacccacttaggggccagatgcacttgtagggtgttctaatgttcctaattgtctattttcaatcttcacatatgctaattacattcataaaactcttataagtccaaacaccatattaaatctaaatcttctagttatgaacaatgagatatctactaacataaatcaagatatgattagtcatgaactcattgagacatattgatgtttcagatttcatatcagtgtgtggttatagacgtgtcacacgaggtgctcgtaatatactaagatttccgggtatataggaggaacattcttttaatggatgaaaacgaccaagatgtcgtgtaaaccaaattaccatatgaccacatgcatatcaataactattaccacttagtaatctactaattaaaaccaaggaaattaattgttttagattgcctaatcttaatgtctactacctaattgtatggcaaggggcacatgccccccttcccaaaaaaaaaactaacacacaactttatacataattaatagtacgatatcctcaaaatgagttcacgaagatcttacagaagatcttgcagttcacgaaggatcaagtatcataaattgttcttatatactccctctatcccataatataaagcatggtcaaagttggcacggtctccaaaactaatttttagcttataatttctcatatacaataaagtttgtagcaacaagattatatgaaagtaaatttaaatcacaatctaatgatataatttttaacaaataaaattcatttcatattatattaagtgttggtcaaatgatttaaaggttgaatattgaaatacgtgcacatgttatattatgggatggaggaagtatttctaatgtagcttaagtgttgacgtgagagatacaacttcatagggagccagggacattggtcattagtgcagctgacacatgatatcaatgttgtattacttctccttgttaatgaactaaatccacaacttgctcatacgaaaacatgagatgtgttatatagtctctactagagctaggacttgggccatgctgggctagcacggcccggcccgttgtgcttcgtgctagaacgggccgtgccgggtcgtgccaggccaaggtggagaagataaggcccaagcatggcccaaagacatgtcgggcctcttcgggccgtgtcagcccaagcacggcctaggattacctgaggaggagccgtgccgtgcctagggtttttgccggggtccgcacggccacgtcgcgccgccaccgcctgctccctgctgcgctgcccgcgccagccgtcgacaccgagagccgccgccgccgccgctgagccgccgtcgcctgctgcgttacatgctttccataattccatgcatgcaccgttgcagtgaacaaggacgcggttcattagccatttaaaaagtttaaaaaccatgaacaaaaatttcattgactaatagtggatatacacgatactaatcgccaatggtaagtgatcccagaattaattagccaagaaaatcatgctttccatgcatgcacggctctctgaattctgaaagattgaaagcacggctcatcagttactgatcagtattcagcgcggccgccggctgaacgcgactcctcgcggtcgaagcccatatatgaatgcgtcggctgaagtctgaccacgcatgcatgcgctcagcggctcggcgctcctgcctcctgatctcctcgcggaagtcccgaattgcacgcgctcttgactcctcgggcgctcggcttggctagagctcgggctggccttcgggcctttttcgtgttgggccagccttcgggcctttttcatgctgggccagccttcgggccttttttcgtgctgggccggcccaggcacggcccaatagccgtaccatgccgcccagcgcgtgcctcaactttggcccaggcacggcccaactacgggccggcctggcccatagccgtgtcgtgcttttcctcgtgctgggccatcgtgccgtgggctggcctgagaaagcacggcccaagtcccagttctagtctctactaccattatactatactaagcactatatatagtattacaaactatggacaatggagtagccagcaagataataagttcaagacataaaactaaagtactaaacacaacaagacaattagcatggtgaaattatgatttgctataactaatcacgactaatctatgaccgactttatgaataaccaagactaattgcacaacttgctttttggtcgagtcgtggccctctagtcgagtgatttgactgactttacggctagtatacgactaaccgcgactagttgaaatactttgctagtagtgtgtgcaccaactaaatggttaacaaactctaaaaaatgctcatcccaaaagacagtgacagtcatgtctaagactaactaaatatactctgcatttctggaaactaatgtccaatagtccaagctgaatgaatacaagatcgatgaggggaaactagacaaaattacactgtagactgagtaataagcagcactggctatgaacctccgtgaccaaagccatctgtcacctggagtgatatggtttggtatgcgtcttattccagtcttccagcttaagagcgggtataataaccggctaatagccaacctacatctacatggaagaaagagagtcctggagagagaaggtagccggcgcttgcatgagagccggccaagcgcaagcacctagggtagtgctataagccagctacaaatatattttaaaaagataaatgatgagagagaagagtagcgggctacaaatttatagccagctgtagtacggactccaagacatagtgtgtgtataacaggtgggaccgggtattaatagtgtagtatgtaactattgtacgaatgagctattagattggctatagatgaattggagttagtagttgactatactattaaacttctaatctctgttgatttttacacggctgcatgtcattattccagtatggtccaatgggagtaaacctggcggtcctcacacacacacataaaaaaatgattctgtgaagatactctaaatgacgtggatataaattggcgccggtgcttactagctccactattaaacctgctctaacaaataaaaataacattcactaacaacgagactttagcctcctgaatttgactccactgattctgaataaacgttaattatgttcatcatcagagctttcctttcaaaaaaaaaaaaaaagttcatcgtcagaactaggcccatcttggcatgtactactgtatagtatatagctttctactattagcataaaacttcatgcaacccatccatatatagctaactggttacagcagatacgaaacttgaggtacttgtgaagttgtgattattacattacacacatatatgaaagaactgaatgtatgaagatgaaggagtgaaggacattattattaggttagaggtagctatgattctgttcctgtttgggccacaaggctttcggcctaaagcccaaagcacgcacgggtacgccctaagcccaaagcgtcacaaaggtcaagggcccaaacaagtagttcaatgttacgatgctttggtaatgctctttgtacttatcttatattttcagaaatttgctcttaaatttaacatgtgttattaatctttgcactatcaaaaatgattttggtattatcagtttttttaacggtagatacgcatccctgcagtagtggcaagtgctatatggttgtgcattagttcaaggaatcaggatacattatcggttgggaagctaaaaattttgagaagtacctggtgctagtaaaaatctggaaaagctaggaaaacaagcttctagcttgtactagttattttcttaattctacagctatagttttccaggatttgaatgaaaactaaattgttgaggagcttttattctgaaagaaactgtaattgtccgaagttacttaatagagaccgacaacgttgagtggtaaatagttagttaattaagtacgttaaacactgtttatctgtgtgtcatgcctaacatacatataccattgcccccatctcttcaattcccatgtgctttgcgtgctaaactgcttgtacgctcggcgccgaagaagcttccgaacccagggtagaattgggaagaagcagtggaattccatggtgtaataattggccgctagcttagctagctagctagtgtagatgctgatgatgtgacgtgtccttagagattagttaggcatacgatggaggaggagaattgtgtttagaactcgtactactatggattaacgaccggatggtccagtccacgccattgactgaattgttttgttcagtcctgaagtcgctcgctttcaagttttctttaaggagtcgttgttcttcagctcgcaaagattaattaactacttcagcttgcaaagattaattaactactccctatatgagtatattataatttgatggttatgcgtcaggtaattaacttaatttaggccgtttggttgttgattggttacccacgaggttgactctatggatttgacttgctggccgggctgcttaaacaggctgaagctgaagctgaagtgagactgggagcaagagcaattgtacagacctaaaataaacggcctttttataagagtaggaaatcaaacattgtcagttgactgggggcacgaaataccatcaagcatccaagagcgagcacgatcgatcgtcttctttctctctctctttttaatttccaacgtgatatatatcgtaatttagcacccatcatgcatcagtcactgcatcagctgacgatcaatcgagagttgcgtacaattactctcaaatcaaccgggcaaaagcgtactgatctgatcagtgcgtgttgcgtcgcactccgtttgcggtttggctagctaactgtaggatttgacagtagaaagcgcaacctgcaacgagccgtatatgcgaatctgcttgctgcaaaatcaaccggcctgcgccgatgcgctcaatcgatcgatccgccgccgccggccgccggccggtagctcgcactcgctcgcccggcgctcggctagccgctattttaacctgctagaaactgaaaaaacccaaggagattgatgactggtggggaggggaactgaaaaccccatttttcagtttttatttagggaggcacgggcactctggctgattgtgatgtgtatttaaacttttcttgttctaatatatggactaatggacgtgtaatacttttgcacgttcgcaaaatagatgattgcgggaaacataatttattgattcctttgtgccataataaattcaattattttcctcttcccacatattccaaaaaaaaaagaattcacatactttatcaaacctaatacaattatttttcgttttatttattctaatataattattctctgcttttcctggctccaatacaataattacttaaaaaaataaacttatttttaggacaaataggataagtcaaaaaataaaattattatgacacggagggagcatcatctgcttttaaatgactaacacatgagtctcacacaacgacctctgtaggtatgtcagagagcagtacgtcattagcttcttttcaagtatggctcagctacggtgggcatacagatcagttagtaattaatatactttatccgttctaaaaaattaacttctaagaataaatctgaacccgttctattttttaacttctaagaataaatcagaacaaatatttgcttagattcattgtaaagagagatgaatttcttttagaacggggatgtagctagctaggttagctgtgttcggacgccccttttcccaaccactctttttttttttccgtgcgcacgtttttcaaactactaaacggtgtattttttaaaaaaagtttctatacgaaagttgcttaaaaaaatcatattgatccatttttgagaaaaaaagttagcaaatacttaattaatcgcgtgctaagggcacccacaatggttatctataagctctctataagagatccatgtcagcatattttcctacttggaagatattaaatgaagagagagagcaaagctatctactaacatagagatagtctatagagaaaaacgaggcaatgcatgagagagctatagataaccatgtagacatactgttgaggtgatttactattaatctagtctattgctgagatgtacatgttttatagatagcaccttactttaccattgtgggtgctctaatagactactccgtgcgaactgtgtatgctttggaactagctccagcgaacacacctaggtacaggacccaacgaccaaccaagtgatcaccaaccgatcgatgttgcaagtgcaactagctctcgtagtagtactactggagtggagcaacggcgcaaccaccgtgcatgcagctagccacagtggtatatatatgcagtgcgtgtgagagtcgtgctgaattgactccgtgtctccgtcgtcctggaactggaagagggccgggggtcaagcttggccggcgcccagggacgtacgcgacaatcacacaaaagctagctactgtgtacattaaattgtctgtccatgcatgaacgatcgagacagattgatctgtccatcttcctgctatttgaaatttgtgtttagccaccgtagttttttaagcttcagttttttttttctttgctcccttcccctcgcatatataagttggttcggccgattatgttacgtgacaaaaactcttttcttctaattaatatattgacgtgtaattttttttgcgcgatcgatctgcccatgggtggtcaccggtggtgaactgtttgttatattactacacatcttacacagttacacttgcaaaattggaatgctaatataacagtcggtcgatcgatgagcgccaacaccggccggctgccttcatcttcactagatagctcactgatcgatacacacaaggtgtagctaaaagaacaagtgtggttttctttttccaagtcatgctatagcttagctctaacaacgtttcatcactagatagctcaatcttaattaatcctatagatgtgtgctactatatcacgcaacttgcctctaaacaaacattaattctcgtcaggacccacgtgtgcaactgattaactagctgctcgtggccttttttccactatatcatactatcataatactgtcattgtcgtgctgatgggggtgttagctgcggcctatgtgcctgattatattaaacaattgcagtgtggcattaggtgctaatctaattcgtctctagcgcaccatggattattactggatggactagggatggatggccgggttaggtgctctgcacacaaggccggggacatcaccacatgatgctacccccatcgatcatcgccagatgtttatctaaccattctgcataattgtaaattatgaattcctctctttgcacgcatgggacaggatcgatcacactgcccagcatatattctctaccttcaattcgatcaggattattgttcatgtgccatttagtattacattgcaatatctatttattttcttgcatttatagcggccttaatttgcaagatccgcaatcgtcggctgcaaattaagatatccatgttgagtaaactgctggaaaaaagggatttactctgttcaaatccagatatttcttttgcgtacatatgcatgcttatttctgcctctaaccaaaccgggcattcttaatttgtttgctcaacaaaggcttaatttcgcacgtgggaatttttcaccaaaaatgataggagccttagagcaggcacaataattctatgtaaacaaactatagcaacaaataagtt

SEQ ID NO: 41989 - DNA, 19790 bp, Oryza sativa
cagatcaattgttgaacttactacaagacaagagaagtccctcccatgatgtccactgcaccattaacttgtatgttgcttatacaaacacaccacatcaaactacatagattttgggcctcttcatgctattttcaactttaccgagttttaataaagttactaaaaaaatggctacatttagtttgctgtcaaattttgataactatataagaaatcctgccaaaattttatcaagttaccaaaattttgacaactatgccaaaattttagcattggtaagttttttttcatcaaagtgaacaggcccttttactccgtaatttacacaactttattgcaaaatatcagagataatagtcatttctagaagaaaagttatgtttattttctgatatttatcatttaatgccaaagggatatgctagccacatgcaagtttgtattctttcatccaaaagaggagaagatgatggccatgttcatccctactctcaagtgattatgcttttggaggctttcggctgcaggagcccacacatggcaacagatacacgtagatcaaacaagacagtgccacatataccagacaggtgggtcctggataaggcagaaatcaaaacgtcgacaccatccacgtgtaatgtatggcgatctgaattattttaggaaagcaaaaaatgtttatctgctttaatttgctttcactctaaccagtgatttttttgatggccgccttggcgccccattggaccataaaaaaagagaaactattgtgaaagtaaagagatataaaggagagactaactaactccactatggtgagagtgccgacaaattgtaaaaacagacactaagagataaagcagagtaaaattgttctaaagcatatagcatgagaaatgcatctttcattagaaaagcaaaatatttctttaacattttaggtgaaaatgtctacttataggcacaatttaattgataactatattttgtttactagttaatattagttgctaatatttctttcattttaaaatataagggatttcagataaatgtgatatatcatattactatgatgtgtcatattcacctaaaatctcttatattttttgacggagagagtctgactctcctagtcccaaaaaactcaatctaagagggtcacatacaacaaatctagattgcctagattcattatattaggaggggatgcttctagattgagtttttttttttggcggatggagtatacgttgtaacttgacttttttatgcctttaagaaaacttgcctttttcagtggaatgtgctgcaattaatactatgtttatcatgtttgtcgtggcatgtgtgcccttgtatcatttgcacttaatcgaatggtatttataaaaatataatgttgattattccataatttattcataaaaatataactatttacagagaggtacaaattttttaggtaacggacaatataaaccataaaaaaatccttgcctttttctcacttagtaggtgccatctaatgcccttgattgaattaatcatagagtcaccacacaacaaaatgagtagttagcgaaatactacaagatgcacaataaaaaaacttatgaacaatatgcaaaaataataattctctcacctagtactgtaatttattgccccccgattgaattaaagatagaactcaaatgttgggatagctagaagaaactagccatttaatggtattaagataggagaagccacattttttccaacccttcatttcgtttaatccagatggaatatgagcaggttaagaggtcgaacctggatttgctggacgaaagcaatcaacccgtaccaattaatgatagagctaccactgaacaaaacgatgagcagtccagtgaaaatagcaacaatggactggcaagttgtacaattatttatgacccattaatttatttctcccccacaaaagaaaagataggaaaaaaaataaaaccagggaccaaactctaccaacttgggctgctgctaggcggcagcatatttgtcttctggcagttgtgctgagaagccaggcagaggggagtttagcctgaaagtgagctctctagggagatagagagagaagagggccaaagaagaagaagaaatcaaagctaggagaggtccaagattcccactaggaccctttcttggttctcttctttttctttggctgattggaaggtctagagtcaatcacttggtttcttttgtttcttttctttggctccattggttcttcttgccttccaatcgttctaaggggtggatagaatttgtaagtgtcatgttcttcttcttcttgtcctttttagtttgttggtttggagttcacttctccattttcgcttcttcgagatgttataatcaactgtgttctaagttctaacatgtggtcaaaatgctgattttttttcctcagttggagtatcacctatcaggcactctgttcatggcccaatgattttgattggtgggcagattttcacagaccccccattccagtttttttttcccaaggggatgcgcgaatcttgctgctaatgttcttgtgaatcaaagccaggagatttctggaaagtgaggaattcttttcttagattgcaatatcaatcacagcgctttctccacaagttgcaatctctgagcgcttttgatctctccacaccaaccaaaagcaacagaaatttaccttggattccgcggttttgaagaatctgttctgatttggagatggagaggcagacgagcttccgattgggcgcgctggagaagctcaagagcttcagggggatggagaagcagaagagcttcaagatgatgtccacggacaacttccggaggcacagggacagccccgggaagcgcggcgacacgccgctccacctcgccgcgaggtccgggaacgccgccggcgcgcagcggatcatcgccgagttcgacccggaggtggcggcggagcgcgccgcgcaggccaaccacgacggcgagacgccgctgtacgtcgccgccgagagggggcacaccgacgtggtgcgcgagatcctcaaggtctccgacgtgcagacggccggcgtcaaggcgaacaacagcttcgacgcgttccatattgcggcgaagcaaggccatctaggtcagttctttcttcttcttcttcttttttgtttgttctttttttttgttcattttctgaacctgatttctgttattagtgatgactgacttcgatctcagcctgccagtgccaagtcaatgagctgatgattagaggtttatggcattaggattttgcattgacttaatctaatttgcatgtgtcattgtgtagggctttgaaaaatcctatgctgaacttgtctgatttgacttatggaaatatacaagtgcttttgcttttgttcatttcttttcttcacaacgtgcattgctaacatgaatcgttgtggttaccttcttctctcttttttttacataaatgtctgagactagtgcatatctcacatctggtttgatttagacctcatgtccagcaaggaagcaaataccttctttttaggtgataggcaagctgagtttttcattatggatttatggtcttgtttagtgagggttgacaaattctgtacccaaagaagctttcacgatgtgtctacattgaatggtttatttaagaatatatacaatgaaaaaaatggtagtattcctttcgcgcgatggtggattttgtgcaaccattattagttttatgaccttatgatctcattctgttttctacttgtgaaagactgaaattcatgtcattttagtcatggagttatatctagtagccagcaaaccacagctatagtcatgatcacaatgatttgtacaagatatggtttagttaagtattttgctaacgaagaaaaaagaaatcctggctcatacgtttcttttgtttcttggtttttcagaagttctgaaggagctgttgcaggcttttcctgctcttgcaatgactacaaattctgtaaatgctacagctttggatactgctgcaattctgggtcacactgaaattgttaacctcctactggaatctgatgcaaaccttgcgagaattgcaagaaataatgggaagacagttctgcattcagctgcaagactgggccatgtggaaattgtaagatcattattaagtagggatccaggaattggtttaagaactgacaagaaggggcaaacagcactacatatggcttcaaaaggacaaaatgctgaaattgttatcgagctgttgaagcctgatatctcagtaattcatctggaagacaacaagggaaacagaccattgcatgttgcaacacggaaggccaatatcgttgtaggtgatcttatattgggaatttcatttgttttattttacctccttgctactatatgtttttgtcgatctttttagatgactatttgtttgccaaatcacttgctatcctgtttactgagtttaattatgtcagtattttgagaacagagattatcataactttactgtaggatacctctatttgattggaatggtgataatgctttctttatgaacaaattcaaaacaaatgcaggtgcctgtacataagttttaaaaagaataaagaagcatatcatatttcaaacatatagaaacaagaaggtttgctttgactgatatatgtgtaattccttacagatagtgcagactctactatcagttgagggaattgaagtaaatgcagttaacagatcagggcacaccgctcttgccattgctgagcaactcaacaatgaagaacttgttaacatcttgagagaggctggtggagtaactgcaaaagagcaagtacatccacccaatccggcaaagcaacttaagcaaacagttagtgatatcagacatgatgtccagtcccagatcaagcaaactaaacagaccaagatgcaagtccagaaaatcaagaagagactcgaaaaactccacattggtggtctaaacaatgccatcaactccaatactgtggttgcagtgcttattgccaccgtcgcctttgctgccattttcaccgttcctggcaattttgtggaagatatcactcaggcacctccaggcatgtccttggggcaggcatatgtagcaagcaacccggccttcctagtatttttggtctttgatgccttggctctcttcatctcacttgctgtcgtcgtcgtccagacctcgctaattgttgttgagcagaaagccaagagaaggatggtctttgtgatgaacaagctgatgtggctggcatgcctctttatctcggtggccttcatagcactaacctatgttgttgtcgggcgcgacgactggtggctagcttggtgcacaatggcaatcggtgcagtgatcatgcttacaactcttggttccatgtgctactgtatcattgctcataggatggatgagaggaagatcaggaaggcgtctacaagccaatctcgctcatggtctcaaacagttgactcagatccagatctactcaacagtgaatataagaaaatgtatgcactataggataatagttacatgatgatggaatccatgtacacgagagtgctgtttttttttacccgaggcaacaagaagaatggaattgacatggaagtctttgttcagagcaaggtgccagctatattaactgaaggcaccttactgcaatgcaaagcaagttaactgaactgccaaaacaaaggaagttaactgaagaaacctcacactggctgctgaatttgttcctggtgtttacctggagctgtggtctcgtgtcagcgaatgaacacctgctaaaattgttttgttgttgctaaaaaaaggtcaatagtgagggcaacaatacgatttgtagactgtactaggaaaagaaaaatactatgctctgtcacataccttggacatgtctgctgcatgttgttgctcgatgagctagaaaatacttcgtatttcctttcttttaccatcctgatttcgacgttgtcataaacagttgagggttcactggaatctacaaccatgcctgaaagaacaaaatttgccatttgcaaatgtgcagagacaatcaggcattctggctcgttcaaactgcaaaaacaacgaggcatggccatcagcaacccatcatctatgaattaatgcatagctgataaaaaggcaaaactaatcgtcatatagccatgtgctgtatgcagacatgccaattgggcaatactcaagaacgagctaagcaccaatatcttcagaaacgttgcagcagcaatattaggcaccgaaatcatcattaaaaacatcataacgactcaggattgaagaaacgatcgcctctttctccaaattgccgttttcgcactggaggaattctcctaagagaaaacagccaagaacaaacagagagcaagcaaaatcgagaaaacaagccggtgtaagggtttaaggttcgtcggagatcggccgtacggtcaccgatcttgacgacggtcacaaccgagacgaagggtacggactacggaggggttcggagttttcttctccgaactccctcagggcctcacgaaccgttggattaagacgtgcggctaggatccgagacaaatgttgcgacctggacctgtggtacatacgggccacggcccatgaaccgacttaagcccaggcaggattgccttgccggcggcctcgtcaatacaacgacctgatgggggtacggagaagaaaactcctctgctttgggcaccatcgccgccgtggatgcctgcgtactttcttctgaaaaacgaggcctcaaatttcatctatggtgattatgtttctttccattttatgatagaatgaaggtcgcattcggaattattttcagtggccgatcagtcttcacccttcagtgcatgggatgcctgcattttatgatgatgttgtaccacatatatataatctcgattctccttaacagagagatcatttcattccctatgaatatgatcccaacaccagtttgcttcttcgttgagagaaactgaaagcaggcaaataaaaacttcagttcagggctttcctcttaggggtgtttagattcaggagtgcaaagttttggtctgtcacatcggatattatatagagtgtcgtatggggtgttcgggcactaacaaaaaaactaattacaatatccgtcagtaaaccgtgagacgaatttattgtctaattagtctgtcattaacacatatttattgtagcaccacattgttaaatcatggagcaattagacttaaaagattcatctcgcgaagtagtcgcaatatgtgaaactagttatttttttagcatgtatttaatactttatacatgtgttcaaacgttcgatgtgacatggtgtaaaattttagaatgagatctaaacaggcccttagtgcaagggatttaaatgcaggttgtaaaagattccttcctctcaacatatatttgtccagagtcgttgtactagaatatatcacatccagtcttagattcgatttttaagtacggagggagtactttagaatttcagcagctgatcatggccatgtcgccgtacgtcgtagaggacaacggcggtgaggtcggtcgagtgccggcaataaagaaggatcgagaaatgttggatcttggacatatgttttgattcaacagtttgtttttgtttgtgggaggggtcggagaagaaaactccgaacccccaaggccctaggttctcctcgatcgctctccgctgcgcaatcaccttcaaggatcggcgacttggataattagttctctacgctgctccactatcctttttgtaattgtacatcgtgccttctgctgagaagagaatgtctgaattttctgaattcatttttttttggtagtgttctcttgagaatgttgttgttccctctgataaaaacaagtgaagtttatgttctgaactttttctgtggcggtcagtctttgttgcaagggactgaaaatactggcaacaaaagaagagtgaaaaattctgagagaaatcattcacaattagccactgaaatgagcaagggcattgcttgctgcaatataccaaaacttcacaaggtttcttattgtctctttctgcaggattgaaatatttagaaaaaaaaaacatcataccaggtcacagcaatgtgtgaccaagtgactggttgcgtctctgaagtctgaagtatacgagtcattcagagaaactacatccatacatcggtacattgcggggaacagacacaaccgggggtgttaggaatccttgttctccctgacgtgttttaggatgtgatggcccccaaccgattactattagcttgctagaaaaaatgatcgtgcgttgcaacgagtgaaggctgttgttatatgatttagttaaggtgaaatttactgtgagaattcacttggatatatatacttttagaaaatcatgagctgtagttaggagtttgttcatctcaagttagcatgcgagtttttgtaaaaagatttcttatacggatatgcatttctaaaacaaacttaaaaaccgactcaaatacgtatattgtatatttctaaaagcgaacgaacttagaaccaactcatacacagatgacatatcaaaataccggcaaaaacatcttcaatttgttaacagtagagagtagagaagagatagagatactcgtggatgaaaatttagatacttgtggcacgtttttcaaactgctaaacggtgtgtttcgtgcgaaaactttctatatgaaaattgttgtaaaatatcagattaatctattttttaagtttgtaatcattaaaactcaattagttacacgttattattacctcacttggcgtgaaacatttaatttttatcttcatatataggagattcaaacaccaccgtgagggggggggggagtactggtacagcagtaacaggctgggatatgttgggcttttgggccgaagcccaactcgctctccgggtagagtacacgtcaccacccgactcgtctcctcttgtctctcttcccttttgccgtcttctcctcttctctccagagtccccccaagcaaacccttcttctctctctctctctctcctctcacgcttcgctcgcggccgctcctctctctctccatccatccatggcgcaggacgacgccccggactccaccacctcctcctcatccgcctcatccgcctccgcccccgccccctccgccgcccgcctcaacgccgccgccccggagttcacccctcgatccgccgcccaccaccaccaccaccacgccaaccctcgccgccagcaccgcgggggcgggggtggggcctaccaccaccaccagcagcactaccagccgcaccaccaccaccagcaccaccagcactggcaacactacggggaggatgagggggacgccgcggcggccggggcggtgggagaaggagggatcccggaggatgtggctcgtcgggtcgtcaagcaggtagcgctcccccccacccacctgatggatgatgtgtttactgccttttgccatgctgtttggtgctgattatgaggattggtttggtgtggaatctcaagtttcaaccgataaagcttgatcttttgatcaacgcaagggttagattgggtcgtctatggagtagaaataggcatgtaggaagtgtagcttaacccagtgattgcaagtgaaacgatggaattagtgtgactttacacttctgttgatttgtctgcaagtttgatctttagttacagatgtatgcactagagggatgatgtctatagatatttgttccttaaaactgtttattgcctattattttgcttattcttgtatttctgaaactatgaggataaaaaatattacttcacagatcactggcaccttgattgtcctgtgtgcactagtaaggggctaaggtggaatctaggacgagtaaaacagggaatgtctgttagagattgctatttttagaaaatgcactgtaattctgcacttcttttcttggagaacactatagggtttatagtctatacaaatcagatagggtggggatggcgggaagggtgcatgttgtctttccacatggcgcggtctgctgcatttacgtgtgtgtggggtttgggtcgagtgacatgtctcatgcctgccaacgagcaaatatggaataacaagatatgcatgtttgtgatgtttggcaaacatgatgggcctcagtatgatttattagcgacacggtgtaaaaacgacaaaaccatatcatgtcgtcttgctgaagctcgtaattgctgcatgcatagtaccatgaggagttatactgttttcttttttgaggataataacttaggaaatagaaatagtgcagctctccatctattttatgattgtttctctttgcatctttctgaaggggagaaatggagagagaaatcaattctcttcttttgtattgtttaccttctgcatctttttactttcttattagtttaccttttctctgatcattgaaagtatgatattaacttcgtcttatattaattcctttttttgttgtttattagtgcaatcaagctgttatgggatgcttgatttgcacctatataagtggtacacccttggtttgattgtattttaaaaccttgacaggtggaattttacttcagtgatgtcaatctggctacaacagaacatttgatgaaattcatgattagagatccagagggatttggtgagtcaactgttcaatttcaaatagaccgcctgattgtgctttccaccttcctattttccttttgaaatgagaaccaccataatgttttagggttattctcacttataccttaacaaacctacgacaaaaatcgctgtccaccttcatgtctatatttttctttaaatgtttggtgccagcgataatttcaaatttgtcatgcaatatatgatgataaaattcctgtgaactactgcactacgtattgctaattaggctatttttaattgtattctactgatatagatatctttaacctgggaatgcattcttccgtatgaattgatgcacattgatattactgcagttatgcatgactgttgcaccagcattgatgtttgacaatgttctgctgtaaaaagactactggcacatttagaaatgggcgaatattatgttgaagcattctaatatatttgcaccttttgttgtaccactattggaatctgcatatacttgcttgatataactactgttcaccaaacaacagttgatacttttgagttgcatcatatcattaagtggtgtacatgaatttagcacatgctttcctacacatgatatttgttggctcatattttctgatggcattgacatgtcttctgttttccagtgccaatgtctgtagttgcatcttttaggaagatccgggagttagttagtgagagatccgcattggctgcagtattgcggacgtcagcagagctggtaagcatcttatttaggccctgtttgttttaacttaagattattgtaatctatattattaaatcagattactataagctggattataataagctgacatagaataagctgtgagctatttgtttctctagattattggaggcatctaagggtagtgggtctttagccaccaataatttggaaaatgctcctccagaggagattattagattatactaatctggcttataaatcataattatctacttgtttgtttcagtttactcctaataatccagtttataataatcctaagctgaatcaaatagggccttaatgactttttaatttttttttctttccgatatgcctgttcatcctattgttgacacttgacacagcccacccttcattttaattaaagatgcattatacgttatgaacctttgctcagtaaggaattatatttagtaaacaaattattttttttaataagtgcatgaatataagcgaataaacacacaccttttcatcaatctgtaccatcctaatttaagattcagtttaccaatctcattttcctctcattctgaatggcttctattattctctaccaagatcctaagactatagatcttcctatatacaggttgtttcagatgatggaaaaagggttagacgtcgagtgctctttactgaggcggatgctgaagaagttcaggtcagaatctaattaatcaaataaaatctattcattatatatgtatgggaactgaattttctgttatatgtgtactcagtcacgcattgttgttgctgaaaatttgcgtgaagagcaccgctatccaaatcttatgaagattttctcagcttttgggaggtatgcatcaatgcatgtctttgagcacaaatatatgccaaatgtggtgttgaacacatgatgttctatattgcagtgtgaaatcaattcgtacttgctatccacaaggtgggattgatggtgctggaacttctactggcaaagcatcaaagattgagatgttgtttgctaataaggtaatgtatcatggtatatctaacttctaaaggaacacggaaagtttattagttattgcatatacttgttctagctctgttaataaatatttgacaccatacaagaatgtgtattccaacttcttaatacttgatcactaatacatttactgtttggattgatatgtgcagatgttagcattagatttctcatgggatagtttcacattatggtagcttcatatattcttatttagtgttttaaaaaaaagttctacaaggctgcttacaaggttgcatacatacaaggtacaggtgccctaaccttgtaccgtgtaagctgcatatgtggccgattacaccacataagccctacaaggtggggtgaccacacgaaaccatgtactgttttttaaaacattgcttactatttcatagatagaagtgatgatcaaaagttgcatgttggtgaccttgtccatgtccgaaatgtcatacttgaaaagagggataagcaatgaaatactattttggaaggcatttcaagtttcaacaccagtaccttgatttcgtccctcattttttttggctttacttgcaggtgcatgcttttgtggagtatgaaactgttgaagatgctgaaaaggcagtatgtcttcttgatttctctaaccatttgttttttttttctaggaattattttgaggtgctttggtagttgccatcaacacaatttaaaggaactctgtttttctgtatacaggtttctgaattcagtagtgggagaagctggagagatgggattagagtccgctcactgcttggttgcctggtactttaacggaccctacacaatgcaacttgttctcccttaaccatggactgatttttaaaatgcatttgcgattcacaattgtcctttatgcactacttgtgtttcctgactagatcttagtcattaacatttatatttcattaatcggcaatactgggtggtttgttcattcttgatttagttacttctatatttaactgatgggtaaacattaggtgtaagcttgtttttggtcatttcatcatttatcaacagatatagctcccagaaaaacatgtttgactagcttagtaagatttaacattcctacattactatgcatgttattttatttatttgtaaaatagaagattcttaaatcgttaaacatttgttttcattaattgtcattagaaacaagccatgggtcaaggaagaagaggtggagatgaggtggatgctgcagacgaagatgaccctgaaacaactgaccatccacaagactacgaaacagaggatgcttcccagatttcagaagcacatcttgatcatcaggtactttaaatgatcctctcctgctcaccattattgtgcgccagaatcaagtgtggatattataacgacatgtataaatttcataggctgatgatggctaccatgacaaaggcgggatgaggcacgggagagggagaggacgtggtggaagagggcgtggccgtggtcagtactatggccatagccgggatgccaatcatccaattggcactcctccatcgaatcacagtgctcttgctgatcatccttcaaagccaccccctggtcctcgtatgccagatggcacaagaggatttaccatggggcgaggaaagccactcaatcctaccaatgctgtttaatggcagtggccatgccggtggcagcctgttgccctgttccctcttgcaaatctgatacttgcctcaggttccaaaccgatgaacgccgattaccgttgatactatagttagatacaacatgtgttggttcgtttggtgcaagattctgcagagaaaagttttacctggtacatgcatgtatactggtacagcagtggtgctggcaatgtgaacatgtcttttgatatctggatgctagttaatttagcaaaatatgtagatatagatgaaaaatgaggtgtctgatcaatgatcatttgcagcgggataattctgctccacaaatccaagatacccaacagctgtttaaaagccttcaacttggaaggcatgcaatttcagagttgaaaccacatctacaccagatgtgcaaatagtcttgtgcgttacatgaaaaaaaaaggagtacaaacacgagaaaacgccaggaaaatgtctcataaaattattggtttcacaaaattataccaaatgacaagctcacttcgcttgatttccatgctttggcctctgctctttcttcccgtctgttcttctcattcccttgatcaatgtggcatcgcctgcacgaccacggttattgctgacagtcacagccttcaccttatcaggtaagcctttctgcttgccatccatgacagtaactggtaggcatgactgccttcttatcctgccaatttctgctgtgtcatgcacaccaaatgctagatcactacgccatgctttcgctgtcaatggcgttgtgatcagattcttcggtgcacagtaggggagctcagggttcgtcactctcttgagtccatttgtactgctaccttggcttgcatagcatctttcagagtgtttcttggttgcattgcaagttgcggtaggagctgtaggtgtaattgcagcaactaccttctgcttcctgctcgttatggctgcagaagttgatctcctttcaatttggttcttctcattggagatggattgtgtggacactctgaatatgctcttctctgatgaagagttaggtgcaggaaacattgatcttgccgatgttttcgttgcctctgtctttcctgatagctgtaattgataaaatcaagatcaagagaagctctctgatgaagagacaatctagaaatgcagattgcaattgagcagaaaatccacttaggagctctaaactgtagcattcagtaaaaagaaaatcattcagtataatttatggagcaaattagtatataccctggaagctgaaggtttaacttgctgatgaattggtagctccttctggaaaaccatttgagatgagttggtttccatctctatggaaggaaacagtggtgtagctggaggcgtcttcagcctgaaacaagctgttcttctaaaaaaacagttccaacaacacaagtatatgatctagtcatctggatgaattgaattccatcctaccagtcgtagtcatgcttctcgtccactgctatgaggaaatctgtcttccctgacggagctttgctcgtgcggccacctatcacagatacaaattcaaaagaacacaaacactgcagtgaggtcatccatctttgaagcaatttgagtgggattttcaactgcaaattttcatattgctaatcaaatgttcatattgctaatcaagagattgtgaatatgtccataacatttctgacgacacatataggaaaaatagaaacgcaagagccgaagatgtcaccttggatagcatcaaactcaacggattgcatgggttccaggaggttgatgtccctatctttttcacgcttgtacatctccctgaagaaaactacgctctcgtctttgtctttatgtattgcagatggggcgttaggcttgcgcatcccagaaaacctcctgatgctgttcatcttcaggaaccagagagattgatttactgcacggaaaaaaaaaagaatgcaaagatcagagcatggaagaagtcacaaacattacatgaatattactactactactactactctaaaggatccaaattttccggcaactccaaagcaaccgctttaatcaattgcggattgggtatgctctttttttttcattcaaaaaagacccttttacttagtttttcagagcgcgggccttaacttaagaactcggaacgtaaaaccgtttggtgagggacctaaaagtattatctactaagaaaaggtcctttctgcaaaaatccacctgcttcatcctagccgtacgctcaagccaatcggacggcacgccagccagcggcttgcgcggacgcggaaggagacgcgctcgcgggcgacgtggatagctccgcatgcgaacacgccacccccgaatagctctcaactcaccaaccaattcagggcaggttttaatttaaccgatttgggtcacatactggaaatcatggaggcctaattcatcggtgggaaccgcacggttggcccttggccgggaaacaacattgtcgcatactcgcatgggcgttttcttccactgccatgctgtgtgttgcaacattaattcaccaaacaagtaataatctattgatttatctctgcacagaacatttagtagttcttacttcttggagatcaaatgggtggattaacggtgaagactgttttcagctcaaacatattagaaggtgcttcagcgctttgggggtatattgcagacagtatgcatagaagtagtaaacatatgatttctactattattttacgaaggccacctttggatgagcacggagaatatgcttgtgagttggttgccttgcctttaaggtgttttgctatttttcctattagcacagagtctgaaactatcttaaaatttttcaactacgcatgcatggcctattgatatgcattagttgggcatgggagatttggatgctaactttggattattttgcttcaaaaattgtgttcttggctccctatcctgatcggttgtgctatatgtgtgctgtgcaatcaaggtaaaagaaaggtctagaggagagctttgctttagtgattctaaattcgatattttagctcttatacatgtaatttttattgtgtttttgctcaacgtgcaaaaacatactttgctgtcatatatttgtttgattgatcatccatactccgattgaatctgaatgtagttcagttattggcaattgtcataattaaagtattaaactggctatgaattacatgtctgtgcagagcatcagctgagtaggctgtaaaattgctaaatgctactaagaatcaacataggtatacccatctctgaaactaagtcccctcagcattttgtctgtactaacttcccagtttattttcatgtttgtgtgtctgaaaataatatgtttttggtagtttggctgatgtatcaagcagagcaggtactcggtggtccctttgtactgctgttagctgccagtttttttatccaactgaatgtcaggtagaaggaacaggaaggaaattgggcagtaacaccattcaaaactgtatagtggagctgtggaagtatgataggtaaaagctttccgtgattgaacttcaactagatttttttgccttttgtatttagtattgtttcaatggtagttttcctatggaaatagctgtttcaggtatatttagctatgccttttttttcacggtgttgatttggtgagtagatcatctgctatgtttgctacgaatattatagttctgctcttcaatgaaatgtaaacaatgtgaattgaggttaatttacgatagttggcatgtgactaggtgagattttctttgtgtatcctgagcaaatctaccgaacatcaataaattatgcattgtacacatggtcttcagattgacggtcatattttttttcactctattatgattacttttgtgctgtttcaggtggaaccaaaatcaggtatgcatccagtcattagtttcactctgtttatttgtaatttttgttttagatttgtgtcgtaaattgcttagattttttttttggggggtgtctcaaacttcacatttgagaaaaatatattgtttagtgcattggtcggcatgcatgtatgataatcaatgcacatcaggctagcaaatctgacacgtcatcctttgagtttggtattgcagttcctgtcaatgccctcttggatatatacatacatgggctaaaatggttctagcacaaaatgtccttattcctacagtgtatgaagatacttcgttatctaacaaatgccttttctgtgtgtgcagattgtttggtggttgaacttttgacggaaatggactatggagatataaatgtgacacttccagattactgatatatgttgggtatttgtatgtaattaaacaacgtgtacctattcgatagtgtgatgacagctgacctgaattgatgaattatgatgtgcaatgtgtgatctgtattttaggttaagtgatttataattgtaatgcattgtccagtcatgtatagatatcggtaaaacaaactactatttcgctatcctactgtgtgatacggtgatagggcgtgcaacgcgcgtgaaatgtctagttgaaagaaagagcttaacttgattcgaggatttgggggtttatttaggtttttctcaatttggcggttcggggaatttccacatatgacttggttatgttggtttcaaactttctatccctcctagataattttattgtgttcaattcagagtccatgactaacacggaggccacggctgaaaaattagccccgtacagatgaaaatgtttatttgattcgatctctgatctctctctttttttttgcttgcaattttttttataatcgatattttttttatctcaaacaaatatgaaagtgaaacttctggtgattttgatgtcaacaataaaaaataatcgatttattttgttgtgctttggcacttgccaattgccacccacacattaaaaggaattatgttttgttctgtacaggtttctgaattcattggtgggagaagctgaagagatgtgattagaattcgctagctgcttgtttgcctggtaccaagtttaatggatcctactcaatgcaacatgtttccttttaaccattctatggtctctgcaaaatctggagtagtcaatggtgaataaaatgcacacacaattcacaattgtcctatgttctccacttgtctttactgaatcctgactaacacctagcagcaggttaaaaaccttctagaaggtatacaatacataaaatttcacgattgaaatctggcgcatatggttaattggttaccaacttgtatgtttttttttaagattatgtagataattttgcttgttactcctatatcattaagaaaaagaaaggagttctttccgttcaatgaaatactagccgctttcctacttttacattaaa

SEQ ID NO: 41990 - DNA, 923 bp, Oryza sativa
gtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtatatatatatatatatgtatatatatatatatatgtatatatgtatatatatgtatatgtatatgtatatgtatgtatatgtatatgtatatgtatatgtatgtatatgtatatgtatatgtatatatatgtatttcttccttcaatcccttctttaactgtggggaggcttcttcaaatttttctattatcttccaatcaatatattccccatctaatggatccactccttttgttaagcattccttgtatgtgggttttttaaaaaacccttcttcttttatagtcatcttaatgggtatttctgaagtcttctttcctttagcttttttgcatttttgaatatattcttttgcagcaggctctagataataatttattcttaatatttttctagcttggcttaatgcttcatcaatatccttatatttcttccaagatattcctcccattaatttagcatctattttttgagccacaatttcttcaaaagagatgtagaccccagggagctttccatcaaatactacatatataggcttttgttggattacttcatgatcttcattggcaggcattaatgacccatttattaggtgaaaatattcagagaggctattcaatattgataacaaataccctttttcttcccttttattattgtattggtaccagaaattatccaagatgcactcttgaacttcatctaggattatatggtcctttggcttaaatttatatgaatttggtgggaatattctgagtttgttgtcatctccaaatgtgaagcactcgactccggcgtaattcattgatcttttcatacctgaa

SEQ ID NO: 41991 - DNA, 4818 bp, Oryza sativa
aaatagggcaggtgcatttttaatcctagtggcattactagccattcatagtgtccctggggacaggtgaatgcagtccattctatagactcttctgccatttttacttgccaaaacccagcttttaagtcaaatttcgagaaatatttgctaccttgtatcctattaatccattcttgcttatttgggatattataggcatcttctatagtattatcatttagccttttataatttatgaccatcctagatttacctctaacttcttccgcatgatttcttactataaatgctgcagacctatgtggacttctactctctcttattgctcctagtttcagcagttcttctatatgcatcttaaattcttctatatctttcggagttgcttctattgggctggtcttaataatatattctgggtttattatattaattttacactcgatagcatttttctcccaatatttcataggaatttctcctataatttggatatcctctaatctttgaacaattttttctatatcctttttagacttaatatccctataccaatttggtgcaaatgcttgtaatcctatgcactctatattggaatttgatatataatagatgtctatattctcactaagttcatattcattaatagatgtctatattcatgtatatatatatatatgtatatatatatatatatgtatatatatatgtatatatatatatatgtatatatatatatatatatatatgtatatatatatatatatatatatgtatatgtatatatatatatgtatatgtatatgtatgtatatatatacatatatgtatatgtatatgtaaatatatatatacatacatacatatatatatatatatatgtatgtatgtgtatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtataggttattcagtctctttctttgcaaatctatcgagttcatccaagtccattgcatataattcaattcatcgaaatcatgacatttttttactatcttaccagctatgtaactcgggatatgttcttatgtttttcattgcttttttggagctatggccctgagttacatagcttgataagaaaatagcgtaggttgcagtcttgcagagatctcagtgtaaatttgattctaatggatgaattgatggtgtggcgtatgtgatagttacttacttagatggtgtggcgtcccgcgccttcccgccgcctacgacgtggagctccgtcgggctgctgccggcgccgccctcctcctctcccgccgaccatcctacgggcagagagagagagatacgaggaaccgagaaagagaagagtgggggagagagatgacacagcctaacatgtgggtcccacgctgactcagccgcaacataggataaaaccggtgtcaaaaccaccaaaggacatattgtcaccggttttgattagttgtggatatctggttttctggtttggatgacaagttgagggaccttcggtgtactttttcctctgggaaacccaatcaggcattcaggcctaagccattcagcccaactatcaaccatgtaaccctagctctaggtgctctccagtctctctcctgctctccacccacacagccgcccgccagcatctgcatctgcatctccctctgcgccagcgacggccggcgcgccccatcgccgcctccgccgtcgacttgccccatcaccgccaacgaggcgttctgccgcctggcgccgctcgtcacgtacgaggacatcctccgcatcgccaacggcgacacctcaccatcctatccggcaagcctgtcagcgagttcctcaccaggtaagtgctcgatctactccctgcatgcgtacatggtcgaccacttcgggagggaagaggaatataactatgtactgtgactctgcgagtccatggttgtgtttagttcacgctaaaattaaaagtttggttgaaattgaaacgatgtgacagaaaagttataagtttatgtgtgtagaaaagtttttatgtgatggaaaagttaaaagtttgaagaaaaagttgggaactaaacaagggtatgactgctatgtgctaatgagtaatgacctgatgtgtgtgactatgtcagtgtgtgatactgtgatgtgtgtgagtcagtgagtgactatgttagtgtgtgcaagtttgtgctaatgacctaatgttaatctgtgtgactatgtcagccgtcagcgtgtgcaagtttgtggatgtttgtcgatatggtattattaatcgctaaaacttgaaaatgttgacattttctattagaaaaaataatgaagttatatttcttcgttgatttgtgatgcttagtttgaggggtttttatgttccgattaatatttgtcaccgcattcgtttcgtttcgtattcgctccgtatctgtattcgataatattcaatcctgttttcatatccggttctgattccaattttgaaaaaataatatgaaaacaaatatgatagagctagtttctgaccgtattcgatccgctttcatccctaatcccagcagtttagtatgcattgcagccaatattttctcatggacaaggcgctgaagtgagagacgacagacgaagaggtgaaaaaaatggagtcatgttttgtaacgccccacgaggacacgccagagacgatagaagaagaggtgaaagagatggagtcttgttttgtaacgccccacgaggacacgccaaggcaagggctctggctctctcccctcgacatagtcatggtcagcagaggccatacccctactgtgtacttctaccaacgtgacactgccactgttgctgccgattttttcgaggtaggcaggcttaaggaggctatggcaaaggccctagtggccttctaccccttggcaggccgtctcagtgtagatggtgatggtaggcctgaaattgactgcaatgccgagggtgcgctctttgttgtggctcagtcaaaactcaccgttgatgccttcagcgaccttaagccatcaccagagttgaggaggttgtttgccccccgtattgagccagcatccatcatgcttggagtacaggtcagtatatatctagtttgtgtgtgtatgtgtgtatattcaattgtatagagctagctttggactagtgtggtgatatgtacctaggtgcacattaattattccttgcaggtgactttcttgagttgtggtggtgtggcattagggacggtgttgcaccatgtcgccatcgatgcccttagcgcgttccatttcttccagacatggtcttctttctgccgagatggtgaagccgccatgttggagctgccctgccatgaacgcaccctcctccgcacacgctccccacctatcgtccacccggatgtgcactcaatgttcagtctaaagctcaacttctgtgagccatcagaccctatatccaccaagatattcgtcatctccaagaaccagctcgatgcccttaaacaaatatgtggtggattgagcacattttgtgccatgagcgcccttgtatggcagtgcatgtgcattgctcggcaactccctctagacgccgagacacgcgtcatcttcccagtcaacattcggcgccgtgtgaagccacctctcccagatcgctacttcggcaatgcacttgtcgacttgaaagtagcctccacagttagggacattgtcttggggacactggatgtaactgctgcccagataaagaacgcattgggacgccttgacgatgagatgctgcagtcggcgatagactacaatgagatggcagggatgcccaacaagcataccaagggaaacctgccagatacagaattacgaatggtctcttggctaggcatgccagtttatgatgcggattttgggtgggggaagccggagatgatgtctcgtgcggagtctgtgcgtggcggatttgtttatatgatggatggcattgacaacgatgggggtggcgtgcgtgtgctcatgtgtatggaggcacgaaagatggaggagttcgagcgactgttttatgccaagtttgcacaatgaagaaactacctagctagaacatgatgcatgttttctgttctattatcaataatggatgtttcatgtaataatataaccaaatacctccatatattttggtggcatggttgtttcagacatgacagggtgtggttgatttacgcggacaccacaaaaatgtggttgatttacaccaatgagctttttttaagataattaaaatggattatatccctaggcccccagcccctgccgttagggtaagtttggtcacaggaaatcgggatggacagtaatcttaatgtaatcctaaccatggcaatcaggcaatagagaatgtaaacattcgtagaagcgtactccctccgttaaaaaaaaaatcaacttctagagtttgaattttatctcacaaaaaaccaatttttatactcctacctaccctccgcacgtaaaacgagaagttttattccttcaataccctttaacaacatgtcactcttactatttttttaatgattaaatgtattttagtcattctcactctctgctaattttatctagggatgctaggaattgactctttgtgggaccgagggagtaggcgttaattcctaatgccgtgtattaattcccaggggctgcaggaat

SEQ ID NO: 41992 - DNA, 7886 bp, Oryza sativa
tatataattcaattcatcgaagtcatgccatctttttactatcttaccagctcctcatcagggttggcatctaatttttagagctatgtaactaaggatatattcttgtgcttttttggagctatgtaactcaggatataaaaaaacattttttatcaagctatacttaataaaaatacaagtacatagcctgataaaataaattaggggtagattgtagtcaaaataaaccttaccaaattttgacaatttgacaatattgtcaagttttggcagaatttcttatgtatttactaaagttcgattaaaaaaactaaataaatgcacatgtttaacaactttagcaataatagtatttgaaatagcatcaatctgaacagcttgtagatgtcaccatttccgatcttcgtagcctggaacatttttagatagaggccattgcagcctgtaactgaagttctcatctgtatgctgagaagatgtgccaccttgctatccaacagcgtctagcaaacacaactataaacaagcgctgaaaagaagtaaaaaatggaagtggttgataacttggtaggagctatattttgatggattattcaactactgttaatagttgaacaagatgatggaatagcagcaacgtacgcacctcaatcaggtactagcagtcagcagaaggggaggaacctcttgcgatagtacctttctgaaaatattattgatttatctggaatggaggagagcaagtcaaaatactcaccaccttctttgcaacgtcttacaagctgatcattgctgacactgcaggaatataaatgtaggtattcgagggtcgggagccgctggaggagaccctccggaaatttctctatccccgacaaccatcaagatgtaatttcctcagggaagtgaggccatccattccatcgggcagcaatttcagggactcacactttattacgatgaaattccttagacttgccaaatttccaaggtttggaggcagtggtacgaccaaattctggcaactttgaataaacaattcctcgagcgatgcaggcaacttcgggatctccactattccggaacaactagttatatttaattcctctagacaggataaataaaggatttcctcggacaaagaaaaatttattcccaggctggtaaacttaaaaatatgaagggagcggaggcgaatcaagcacctgagctcctccgttggccagcggacaatatcatggcaatctccaatcaccaaatgctccacaaaggcaaagtgtacccatatcccatggtgcaattcagagaaaccggataccgtcgtgaagcatttggggccatgtagattcaaacgccgaagatttacgagattactttctccttggttttgttggtcctccagagaaatcaccatgtttgcgagagaccttacttttaatctcatgagtgatgaccatgagcccagcggcatggtcatagaatcaaagccttctgcgtcgtaactgagataggacaaacttgttacgtgtgcgagcgagctgacagcaatatttgaacatctatctatattcaggtctcttagaaccgggcaatctggaatgcctgcaagtttagggcagtcactgattcttagtatctcgagctggggaagcgtgatgaagctactaggatctcctgaaatattgactgcccatctctccaagtttggtagatttcttaagaacatcttcttaagcttggggaaaatttgcagagaggtaccacatccctcagcttctacatcatcattcgtacataatgtggttaggttatccatgcaagacaaggacaactcctcaagagagaccaagagccatactggtggtagatccttgcatcttggacagtttgaaatgttgagttttgatatacgctggaacgtgtgtgggtctctcatccattcagggatttcaacaccaccatatccatgtaactccaaaactttgaggttactacaataaggtgcaagtgactccaacacacgctcctcgttataggcattgtcattaggcatgcaacgtttttgtcggccccagaaaaacaatacttcacttagatttttcttctggtacatattggcttgttttgccttctcttcgctttttactttgtgcaaattgtacagttccaacctgttggtaaggtgttgcaagtctttgagctcctcaattccacagcctgcttcagtgtccacaacatatgttgtcagagtacgaagattattcagcagaccgatatttgggggcatccgtcgcaaactgtcacaccaatatagataaatatggataagcttcctcattgttctcataccttttggcaaatattctagctcatcgcaactattgagcctcagtgattgtaagttatataacatgcatattgaatctggcaatctaacgatactagtctcggaaaggtcgagaaaccgtatatgctttgcatttgtgatagcactattgataacagaacaacgcaatgctctcactgatgccaaattgaattccacactaacattccataatgttgatcgccatgatcggtctatcagagtatgcagagatgatgtgcctttgaataactcggtcatcgtttcttccatttcttcaggaattcgcaagtgacggacatcttttatcgagcctttcagctgatccaactcttttgttgtactagcacattcatcagtaacatcttttgctaggtcatgcattaaatcatgcatttacaaacaattgaatcacagtgataaccgattatgaactcctctttcacgtcttggaggaacgatctccataccaaatcatggaagatcatttctcctttatgtgtcaaatccatgttctcctcttcttgaataaaaccatttgccatccatagttggattagttcgtctttaaccatctcgtaatcttgggggaaaattgcacagaacgcaaagcattgcttcatttcaggtgataggtgtctatagctcaatttcaatatgtccatgacatcatttttaccttggaccctagccccaatattactttctgcaatgacctcccattctgagactgattgctttgaactcataaggccacccatcgtcttgagagcaagaggcacccccctgcatttcttgacaatacgtgtgccgatggaaaccaactttgcttgctcctgtacttgtttaccaaacgctctcttggagaacacctcccacgaatcatcttcattcagacaccgtagctcataaggttcaagtgtgcccattatagatgccactcgttggctccgagttgtgacgacaatgacacttcctgcaccgccaacagagttcagtagtggctttaggtcatcagcccacttgttttcctcgtcgttccatacatcgtcaagaacaagtagaaaccttcttcggccaaaggcttcctcaagttgccgtcgcaacagctcgatggtgttgattagttggcatcttctatttgtagccaattcaacgatggatttcagaagggaaccaacttcaaagttctctgagacacagtgccacatcttcagttggaaatgttcctggacactggggtcattgtatatcagcttggcaagcgtcgtcttgcccaaacctcccatccccacgatggggagaacctgcaaattctgctgatcatgctgatccagcgtcagtttcaccaacacctctttgtcatgctctcgcccaaatatgtctgctgactcgtccagccccgagtgtgttagccgataaggaagctgtggcacctctacgtgttccatcaggccaaacttgttcatctcttcgaccagctcgttgatcttcttgaggacatcacccagcttcctactcatggtaacacggaacaggagtgggctatgcggcgtgaagaagccgagtaccttgcgggtggtggagtcgccgatcttgacctcgcggcgcagcgcctcgtactcgaagtcgtcgaggacgtcgtcggcctcgtaggcgacggccttgaggtccttcatccagcgcttgacggcggggttggtctcgctcttcgcctcggcatcggccagcttgcactggacggccagaagctggcgctccagcttgcggcggtcgccgtcgatgccgcacatgcgagtgacgctctggacgagcgcgtcggccgccttgccggccaccccacgcaccaccgggagaagtagcgattccgccatgttgcgttgcacagcattacagtcacagcatgaggcgttctcagctgcaaagcacggtggaattaatgaagatgaaaggcaaagcatgaagcgctctgggcctctggtgcgtaattcaagcggacatgtttggtccgtatgagtataatatgacaacttgactataacttttgcgatgtaaaactgaaagctcgactatcttttgcctagtgcattcgtgtcgtggaatccaccagtttggttgcagtttcgttgaaagctcctcggccctcgccgtcttattcttatcagcaaaaacacacttttgctgaaacaaactggcacggtagtcggcaatgccttcgggcttcgaatatgaatgatcctgttgagacgaatgcatcagaattcagaatgcatcagaccccgcgcaccactaggagaagcagttaaatgagacaattttaaatgaaacataattaaagtttgacacgaaaacttatagctacgcttaaaataagacagagggagaccctgactgatttttcctccgatgcaacccatgtaagacaattgttactataaaacgctgtacaccccatgtaagacaattgttactaaaaaacgctggtactgtatagatgctggctaaaattcaacagtttaaaatgtggcgtaacaccatggaagggcacagatgctatcattcgggtgccccacgccacggcacgcaggcatagacaagttacaatggttgcaaaacttcctcagtattttctgatcgggaactagtttcagtacaacttgccaaaacatggcccaatacaggcgctgcgaaaagcaattggtgcggaattaaattcacaacaattcattctggtcatcttcgacttcaacccttttaaaccttaaaccaaaacatagcttcacatgatttgctcactgcccttcaaaccaactggacctgcaatgagagaaaaaaaattgaagcatgtgatgctgagttccatatacaaacaacgtgtgtcagataatactctacatatagcctgataaaagaaactagacgccgatgtaaaatgtatatggtactgtagtttgctaattactctcattcaacactatggtactatacttgtctaattctaaaccttctactccctccatttcaaattgcttgtcattctagatttgtcctaagtcaaacatatactttgacaattaatttttggaaatccatgtagtttaataacatgtcaattacttattatgaaagtatttctcatggtgaatttaaaaatataaatctcatgatgttaaactatatgagtatattgaaattggcggtcaaagattaaaatgattacttaggacaaacgtaaaacgacaagtaatttgaaatagagggtgtatgagctaacatcacctatatccaattgcctctagaaacagaataacagtagtaaataaatctacaaaagcatagtaacttgactaacttctaaacaaaaaataactactccgtaattaccaaaatagcaatagcagctcctactttttacaccagagtatgaaatcgtaccgaacgacaagccacttgctcatcttctggaaatgtatgcaggccccgtagacctggtacatacaaggaatttacagtaaatcagcactaagaaacaagaaagactgtctaactacaataacacataaaaatggttcataccttccctgttgcttcccaccataaccatgcctggtattacctgcaggaaggccagatcgttcctgtctgactccatttgcagaaacagcatgcatggatgactgcccaggtcgaacttcatctgaaaagccattctcctggatgtcttttactttacttgcaattgttacatcaccaatcccctgaacaatgttataaccaacactatcgttgggttttgggatatgtccacccttgtcaaactgatctccaaagctagcagtggtagacccatttctagatggcattacatttgaagatctggaatcaacaacaggtcctctcttttgcctagtgctttgtgccacgggagtgacagcaactgaaggtaacaatgagtaaggagccgaagatgcaacagcggcaattttggcggcagctgtagtagctgaaatgatctgctgtgctccttcccgaaggtgaatgaagtctccttcaatcacaaagagctgcagaacaaacacaacaatcaataacaagaattacccacggttattttacttaatgattgtgaaaatagacctctggatggctagccacaaaatcatctagcttcccatagtgcttcttatagtcatgccaatgaagaggagccaacattttgccaagcctatttggtagctgaaaaaaaaatttgcacatgagtcagtaaatgttccattagacaacaatatatacagttcccactagtcaggaactcaatcataagcatgcatgtataactcacagttgtgctaatcttgattcggccatcaggtccagcaggaactgcacgtacaatgcaagccagaagggatctctcatctagaagggaaggctcctttggtatgcgaggtaagagtgaacccaaaccaccaccagcagaagtatgcgtgtcagtctgattcccaacgttagcagtgactctgctgcaccacctttcaagtggatttgagtagttgatgcatcaaaatctgaagctttatgctgatgcctagctacctgctcctccgactggttgcccgatgcaactttttcatcctggtgtacatagagctttgatataagatgcttacacatcaaatagaaatttacaaaagaaacaatggtaaatattttaaccttgaattcatttgtttgctcttgatgttcaaattttcgaatagggctgacaattgaagatgaatcctgggccttttgttgctcattgtaaactaaatgttcagttacattggattccacaacctgtaactgttctagaaagaattagattttaaacagtgttaaattgtatgagtacacaaaacgaacaacaagaaaacagactagtaaccttttgttcatgagtggattcagaaaccacacttgggaaacgttgttgttgctgttgtttcccatgggctgtagctgtaagatgttctgcacgggttgcctgattctgcttcaaagaaagctcatcattattaccagcagcttgttgcaatgccttctgatctggtggggatgtgtgatagtttgtttcatctggtgtctgagaggcattctgagcttcctaattgacaaaaaattgtttccgcgttagaaattataggtggtcaaaatgtcaacagaaacaggatacaataataaaatgctacacagtattgtgtacctgttgattgggccactgcatgtttggttgaattgtcgactgtgactggaaactaccaaactgaggaacagcggagttaggcgatgctaaagatggaggaacaccttgaggatgcatcatataagaatgcatcccggcaatctgcgcagaaggaacaaaaccacctatacccaacagtgatgaaggaacaacaggtacaggagaggcattactgtttccctgaaagcaacaaatattgcagttccattgagaatattcttcttggggctgcag

SEQ ID NO: 41993 - DNA, 3480 bp, Oryza sativa
ctgcaccccgataagcactgaaaaatgtttcaggaagctacaataaaaaacaaccatacgtccatacctttgtgggacaatctggaactccattacttttcactgactgactactatctgttgttccactaccatttgcagccatgttgttccctttgttctgaccaagtgttgactcgccgaactctcctgtgcagtttgtgaaccatcttttggtgctccagttcggtctcttaattcatttagttctagctgaagttgttgtatggtatgcagaaaacccctttgcatctcaacatactggggaaaagcaagaggacagggtgaagagaatgttaatataacgcagtcaagacatacgcaaacagtagaatgaaggcatctaatgaaccacacatcgtacctgttgttggaaactaatccaatattgattgaattgctcagtacgatcacgtaactcagcttgcattgtctgagactgtaaagtatccatttcttgaactcgtgccatccaagcatgagcttccctcaattgttcatctttgtaaataatgttatcttgagcagccctatgctgtaaataaaatgctcgtcagggagtggctggatgctaatttgaggaaggcaatcatgcaacaaaattattgaccattgatttagaaattctcacaaagaaataaatgttagattgttcatgcatggatacaaagcactagctcaatgcctcaatgttgataatgctttaatattctccctgaaggtaagactatatttgcagcaacagaaaaacaaggagaagccatgtcattggaaaggaattaaaactatcataaagtgtttaaaaccctagttcaacaatatacattgcataacattagaaatgaactgcagtaaactcatcctatgatactaagttacactttctgtaagagtctatcatgttaatcattcaaaagtgaataactaggatactgttataagcacattgtcagtaaagatgtttatgtatcttttgtagtatgactatgcgcatagagacatacagtcatacacaatctaaaatagaatggaaacaagagggttgaaaaaagaatacctgttcctctaatgcaagcatttggctttccttttctcgcagatgttcttggagatcatggatttgtttaagatgctgtgccctttcagcttcagaattgtcacgttcccttctgcagaagataagaaaataccaaacacattttattttctacaacaaagattttgctcaaaccaaaaaaaaaatgtcctggtcagggattgcaaatgactacatgattttttttatttgttatgttcttttgcacaataaaactattttatcatgcataaatgggcatcacatgattcacaaaaaagaaaagaaaagaaaagaaaagaaaagggaatcaacatcacatgcgggtttttcattgagtaagaaaacaagcaattcagcaagtccataaacaactctaatactttgatgaggtgcaactcagctgctttgttgctctaactagtaataaatacggtcatcccacatgatactgaaatgaatcagtagtacctaaaagttgcaagctcttttgtctgttctctaagaagatcttgatttgcccacacctgccaaaaggaaacaaagatggtgagagatcacaacctctaaatctcactggtgcaacacagagcactaaccgtttgatggtcaatcttcaaagcatccagttccctgtccttgtcatccaatttcatttcgagctcaaggatgtacttttcccgttcatgcagttgttcctgtacaattcgaaatcagtattttttttcccactaaaaaggacaaggcaatctgcagtatgtacatcaatcatgtaatgtaccccctccatcccagattataagggatttaggatggatgggataggggcacatcctagtactgcgaatctggacagactactaggatgtgtaccatctatcctaaatccctttatattttgggacagagggagtatagatcatgacttgtgtgtgaaccgtaaactaacattacttgagctaacaagcaaggcactgcacgcatcaaatcaaacacaataacagatatactcagtcaacaacagaacaccacataaccatcattaaggtattagccaaaatttggtaaaaaagaataaatgcataaatttatcacagcataaagaaatatttgatactacgtacttcattctgtaagaagcagcaaagaagctaccgaggtcacccactaagcaacatcctagacatcaaaataaaaaggaacaattcccacttcacgacagtgtaaccatctgtagcaatactgatcatcatgccaacagaaataatgaatgagtgagtagcactcataagcagccaataaccgcagtacaggccaaatcatgtgcaattagtaagttacatgtactcagttcccacctaatgcatgatacgactggcaacacgaagtgcgtgtaagtggaaagcaaaatcagaaccttcagctttgccgcggccgttacatgctccttggcagcagcctcgaagctgcgctgcgcctcgatgatctgcgggtgggcgatgacctgagctcgcagctccatctcaagccgctgaagctcctcccgctgatgcacgacgctctgcaggcgctgctggatgatgtcctcgctgaggcccccgcttccgtcgatggtgatcgagcagtaatcatccagtcttccacccccgtcctgcagcaaaacaaaaagaaaaaaacaatccatcgatcgtctcaaaccgctccacagctcaatccacaaaccaaaaacaacacgggtggcgatgacgaagggagaagtgtggcgcgcacgcacctcgtacatggctctgtcctcggattgccccatcttgccatgctccccgggatcctgcgcaccaagcaacaacaacaacagcacagcacagatgagtacactcaccagcagcagcagcaaccaagggatgggaggggaggggaggggaaccgacgtcggcgccattggagcggagcggggcgtcggggacggcgcgccactccttgcgcgccgccgcggcgtccatccctgcgcgcggggccccttccccccacaagcgggatcgggatctgggcgacggggggtgctagggttttgggggtccctatctctcccccgcacgcgcggggtcggggtcgaggcggggagcgacgtcgccctcaccgcggtcaagctggagcgcgagcgtggcggtggcggtggcggtggtggtggcgatggctagggtttacggcggccgcggcggatggaggaggaagaggaggcgatcggacagagaggagaaaagcgggggatttgggtcggggccgaggcgtgtgattttggggagggattggattggagtattggagtgtaggtgcagggatgaggagaggaggcagcccggtctggt

SEQ ID NO: 41994 - DNA, 4318 bp, Oryza sativa
ataatttatataagggcacagtgcttgtttaaaaaaacaaaattgctttttaaaaacatattaatctgtttttcaagttttaatagtaataaatatttaattaataatgcgctttcgagtaagcgtttttacgtgcacggaagagaagtttccaaccgaatctccggaacacggcctaatattgtatctaaaaggaaggggaaagaagagtattgaggagatccgtaaaatgagatgaaccgttagcatatgattacaaacttgaaatatggattaatatgatttttaaagcaacttttttatagatctttttttaaaaaaaatgtatcatttaacagtttgggaatcaccagcacaaaagaacgaggacaatttcttcctctacgtgcttctctcgaacacttcctaatagttcgttcttcctccctttaagaatacaagtaaatttattcacgagactaataagaggttaaattaaataaatattggttgtgattgactaagataaaaaagcatgtggaaaaattaaagcaaattattattacaatgcgctgagatagtaaataggaatagaaactaaggcatttttttaccgtttggttgtctttagctctaagagaggcagaggtagccaaccaaacggttttagtttcacccagaaaaagagcgaagcatgcaaatgtaatctaatctagagtgtagttcaggctactacataactccactctagactatgctccttgagttataaggagttgagccctgccaaatatgccctaaatactatgtagagaagtagttgctccctccgctccaatgtataagcatttataagaacaaaattaaggtaaagattagaagtggttgctactttcaattttattcccattatctaatcatcaacagaaagttaccatacacgatacactattttctaacagcaactaccctatgttttcccttcttgtagtttgcgttgagtttgctttttgcatgcaagacaactccactcattctctgtcctttttcttacttcacctcaccatccaatcatatgatctttgaggttgtattataggtttgttatgtttcctctaaattgtttagatcaggttaagatcgagcataagagattttgatgacctcattaaattaggtatgtttgggtttaatatgggaataaattagaattggagataactgatggaataagtagtatcaaaacagtgttggaagtgcttacatttagtgtaaaatttaaatgctataagtgcttatatttcggaatggatggagtttttttttttttgcatctgtgtgactatttttcttccatttcctttgaccctcttattttctcttattttctctagtgaagattacagtagctgtacagttagtagtactagtaatcataggttttggttggagctagcttgtgttttgtttcatgcagatgtagaagtaggagtacgtgcataagacaggcatatgtgaggaaaaaagattggtgataataactgagttggtgcattaaccaagtggtgtttggttctttgtctcctttttcttgagaagcattgcagcaatgtataggtgctgtttgggaaggagagactaaactttagtctctctcataaaagcataagtccctatgagagagactaaaatttttatgagaagactaagctttaatccctcctactgaaacaccaccatagtacgaaggtcccgggcaagtggacgtgcgcagagagaaggaaacgatccagatgtgatgtgttgtttcgcatgccatttcaccaccccaaacaaacccaaatcaatcacaccttcggttcatcttaattgggcttaatgtccagagagcccattatagatttagagcccactaacgaatcaatttggtgtgaaaaggagtctaattttaatctctcaaccgcaaaactgggtataacgcacgattcctctggctgttaaaaccgatataaaataactactcccagacaatattgaaggtgatatttattgactgtgtagtccactcatcacatgtttttttagaggtgggcccacatgccatcccctatcgcccttcgttctctcgtctcctctctccctccccctttatgtccacgatccacatcaaggaaaccaccttcacaccaatcttaacaatttggggttcgaaatatattttattgtgatcaaaggatatgaatcggattagaccaataattgagggtgcgttcccaacttaggttgcgttcgttagctctagtgcccaacttccctcccttgttttccacgtgcacgctttttaaactgctaaacggtgcgttttttaaaatatatatatatacaaaagttgtttaaaaaatcatattaatctatttttgaaaaaaatagtaaatacttaattagcaaatacttaactaatcgctgctccgttttccatgccggagggaaacagagcctaaccatgtggtgtcttagtatcttatagcacactaactatatacagcccatataagccatagctatatctgggctcgtgatcggcagttagttgggcctgtgcctcctcaacgaccatttcgatggagaccgtacggacatggggcacatgcataaatgcattgcaaaagcttcaagttggcagaagtaggagaatcctgtacactgtactataaaccaatcgatctgcattgttgacatttgttgaggctttgaacgggacacggccgggagcacataaacaaagcaatatttcggcaatcattagttactccctccgttttctattatatgcgccgttgattattttagatatatttaacattcatcttattaaaaaatatataattattatttattttattgtgacttatttattatcaaatgctttttaaacataatattatatttttatatttgcacgaaaattttaaataagacgaataatgaaaagtttgttaaaaaatcagcggtgtcatatattaaaaacggagggagtataatacttgtagaaaaacatcttactatagattttatatatgtgttgtccctataagtaaatcaaagaagcaaaattctccttttggaatatgacgtgctatctctgtgtgacacatgtgcgaatttgagccgtcaacacatctccatcgccaggcaccgaaaagggccaatttaattttaatgttctattacaccatatatatgcttctatcaacggtctttattgagtttttcctctgtcggaacaaaattatacaggacctcggtcctttgcatatttggaaagaatttgcttctccactgccacgtgtccgcaccaatcttagaccacctatcttttacctctagctcaagtgcttttttctcattctctcctcttctctgcttatcatcaaccgaagcaatggagccccatcttcgcacgtggaatacgttccccgggcatggatggagagctcacccaactattccccatgtctcctctccactctcactacctctcttccactttttcttccccgtagaagacccaaagtttagctagggtccgatgcgtagctacggcggcggcgacgccctcatccaaccgcaggggcatgggatggccgacttagcacgctcccttgccgggaacatactcagtctcaactagacatagtactcatgtaccacattgcattttgcgtcgtaacagtgaggaggaggaggcgagggagcgtgttttcacgctagatatgaggctccagccgagaagcaaaagaagatgcagcgtggagcgtgtttttgcgctggagatggagggctccaaccaagaagaacagaggaaggggatgtggggactggggagagtggcgaggagagagaatgggaaatttggcattttggctagaggtagaagatatgtactataagatcagtacttgaaaggttatatttttttttaacatagggaatacacataaattaaagatgttgttgccagccaaacctactactttcagtaaaaaaaattaacttatgttagaatatgactaaccctaaaaaatcttaggatatgtcacatactatatatactagtactttcttgaaccgcaccgagaaaatacaccaatcgacacacgatggtcggccctcatggaactcctcatcacatgcagttgggcatgagatgaggggaagggaggtgctgatccaacccgcgttgccaccgcaatcacgggaacaaactaatttttttaaaggatttttttttgatttttgaaaggaggaagaatctaaatttaatttgcatcactagata

SEQ ID NO: 41995 - DNA, 2820 bp, Oryza sativa
  unsure (1)..(2820): unsure at all n locations
caaatgatccacatatactccgtattaatttgccagatctggaccgaaggcgaaattgaaaaggcaaattgatgggattgatggctacgttattcctagaaattaagtggttaaaaccattgatcccgaaaaggaatagtggtgtagtatgaaaatgggctgtcacagtcagtgtagtaaaagtcggccgactatatatatacggccgtatatacgtacggtcgtacggatacgtcggctaaaccgttccgtatagttggaaaatgctcaaatatggccattttgttcgcttaatcacccaatttttcataatcaccggattggacttactgtatgttataattaagtttcattggaacctgttttaaattgttagcaatccacaagacctagtacaacccttctgctggtatataagctagtaagaaaattactgtctgtttcagtataatcacatggtgagatacgaacacattatctcattttgacaatataatatgttaagaatctctagaactacaagaaattatctaatatattggtattagtgtgaacatgagtaattgcttgacggtacccattccgttcgaacaccgtattccgttctttacaacactggttacagtgcatgaacacatcaatatattatactctctccgttctatattatacctaatctcaccagtacttgtgaagaaagagcaaaattagatcgaactagaccctagcgaagtttaatatacaaggggcaaatattcgtttaacaccatatcaaattacttcgtgtacacatcttgtgccaaaaaagacatatataaccctagttagctgcattgcgtttgtttatgcaacatgcatatatagtaaatttgaatggttcaaaatgtagtaactagtactcctacaattaatccaaattaaactaccacgtacgtactatagctaaatggcagcgaactgaatcaaaatttgcaggtcctgaatcctgattaatatatatgccaatatataaagcttcaaactatttgatcgaatatatatatatatagttggacagtacaagtgtacaacttggttgacaataatcttcaagaggaaaaacaaaacaagcaaaaaaaaaaaaagctagccaattgagtcgatgcattgatcatcgatccatgcattgagattgagagtgagaaatatactaatatatcacaactactctactaacttgcatgcatgcgttgatcatatgcatcatcttccattacagacacgtacgtagatcaatgtgtatatatactcacttcttttcaggtaatctataattaaataaatttttataatatatttatcttaagttaagaatattattatttttttataaaattagttaaacttatagtagtttaattttgaccaaagttaaagcgtattataacctaaaacagagggactaatagattagctagctagttcgatctagccatgtatcactgccattgatcagctcgagctagcaagagctaggtcgtgtcggcgagctgcagcgtgtgcagcagcgcggcgcggaggcgggcttcgtcctggagcgcggcgggcacgtcgtccaccatcacgtcctgcaccgtcgcgccgcccacgcgcgccaccgacgcgtgctgcaccgccaggttcagcgcccgcaccgcgcacatcatgcgcgccggggcgtgccgcgccgccgccgccgccgtcgtcaggcgcagtatggcggcgtcacgcccgatcatccgcaccacgagatcatcccggccgatggcgccggcgcccagccccgcggcccaggcggcggcggcggcagcggagggagccagcggcgccctccgcgcctcggcctcgagccgctcgacgcggcggcgcagctcggcgatgtagtcaacggcgtcggcgaggagggacgccttgtccatccgtgacacggtgggcacggcggcgcggagttcgcagaaccggcggttgagcttctccctccgctgccgctcggcctccacgtggccgatcgggggcgcgccgccgccgccggagcgtggccctggcttccgcccccgccgcttcgtcgtcgtcgtcgtggcgggcgggttcctgggcacgtcgtcgttgctcgccgattgcgaggccgctgccgccgccaaggcggaggcggcggcatccttgtcgagctcgtcgtgtccgagtcccagcagccattggtcggggacctcgcagaactcgaagtcaagcgtcgggaagcaggccgtggcggagaaggaggaaggggagagtacaagctcgtccatggccggggtggctagctcgtcggtagacgtggcgctatgctccaccaccaccaccactaggccacgtcaactgttgtatagtgctaaaagtggaatacctttgctgcagccaggtagcagtatacggagtatatagcagcagtgtgagagtgtgagccatggaggaatcaatagcagcaaagctagggacctcacctacatgtttggctacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41996 - DNA, 3275 bp, Oryza sativa
  unsure (1)..(3275): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggctcgcgtgagaactccagcagctggttctgggcctcatcctgatggcgcctcaacacagcaaacagctcagggcagtcaaggaagtccaaaaacctcatcctgaaaagcttcatgagagcagcagcaagcaaggctagacgccaatgtgagcgccttgtctgctcaatcaacaacttttggttgccaacccaacacttggtgatgcgctctcctagtgcttcttccatcttgttcaaatgggcggcgataaccttggcgatagccttctcctgatcatcccaggcctccggcggagcctggcatggccagcaccgtcgggtgacgtaggaccgaaccccctcggtgatggcggcggccttcttcttcaccagagatggcgccgccttgccctccaacgccagcttcttggcagcagggccggccatggaggtaggcgcgaagagcagggccttgggcttgggcaccaggtgtagtgacgatccccccgcggctccggcgtacggaaagcccgaggctttggccggagatcccgactgtggtggcgccttgggcaccggcgggtcgacggtgaccagagcgcgttcccgggctccggcggtgcacggagcacccggtggcgcgaacagcagcgccttgggcaccaggtcgagcgtgaccaaagcgcgttcccgggctccggcggtgcacggaaagcccgatgatttctccgtggcgaggccacgggcggtttgggcgaccagtgccctcgcggcggccgtcgtccggccttgcttcgcggcgttgaggaggaggagggccatcggctggttggtggcggcgccggcggcggggaggaggaggtgagggggcttagggttttgagacgaggaggacgagactaggctaggctactagctttctctctctacttcttggttcttgcttgccttgcccctctctcctctttttactccggtagaggaaggaggaggaggagtgggtgccagcctttcaatcccacccggatggccgacacgtccacagccctatcaatccaacggctcccggctcctgacgcacgctgacatctgagagccgagccatatactactatctaggagtaaataataataactttcacataataattctttcttgaaaaggataaacgaacacaaagtatacgttttcctcgatccattgatagcttttcaattcctaaccctccctataattaaataatgagagtattttaagtgctttattttgtgtagcgagatccttcaattctccagtggcggctcgtctcacacatatctggccatatatatactcattgaaatgagaaattcaaacaaattaacgccgttgataaggcctcatttcaacaagtgacattgaacacgctaatttatctacaaaatgacattataatccagtatttctttccctaaacgcccaacaataatactacccgttagcgttgtagagtagtactccatccgttaagtcgttttgactttggtcaaaatcaaagctgcttcaagtttaatcaacaaaagtaatacgtaacatttttaactcaaagacaaatttattatagaaatatattcaattattaattttgacgaaactaatttggtatcataaatattactatatttgtctataaatttaaagtagtttgacttggcatgtaatccctccgtccctaaatatttgatgctgttgacttttttcttattcaaaaacttttatgaaatatgtaaaactatattatacataaaagtatatttaataatgaatgaaatgataggaaaagaatagataattgctgttggggggatggctccggatgacggagccaccctccgtcagtaggaagactcagctcgaagccatccaccacgagagaatgatcgaaggctgtagctaccatgatggttgactccgataaggggcttcagaatcaattaggagctcacgaatcatctcggagccgaccacgggtaccggagtgggccaacgactccggagcgagtcacgggcccgcagctaaccaatggcttcggagccaatcaaaggctccggagtgcccggggaactagagtgctcatcaagcatggaggaatggtccacgggtgtagaggggcgccattaatacgcactacgcatctgtcaaccacctctgacatcctgacagtggcaagaggcatccgctattatccggaagcatgcctttgcccaaataatagcccacaccctcggaaagcgtcaccacctccttaatggctagggattttaccagtagccctacgactggctcactggccagtcactccacatctgtttttagctagggtaaagatgtaacttccccttgtaccccttatatataaggaaaaagtacgaattaccccctgaactattgggtgagtacgaattaccccataaacccgaaaaccggatatttttcaccctcaactatcaataccggatgaaaaacccccctagcagctttgcaagcggttttggtatacgtggcagtctagtcagcaattcttttttttttaaatcagcggggcccacttgtcagtctccaaaactactatcccatagactagcgtggcactggcacaactggcgagcgacgggtacagcctgtcgactgatgaaccgctggcggaggagcacacggaggcgacgaagcggccactcgacgacggcgtggtcgagatcatcaacctcacggacgcgtccctcccgtcgtggagtgcgacgtcgccatcgtcggctcagactgcggcgggggcgtggcagccgcggtgctcgccggggccggccacaaggtggtggtcatcgagaagggcaactacttcacgtcgcgggactacacatccttcgagggtctgtcgatgaaccagctctacgagtctggtgggttcgtcaccacgatgaacggcggcgggctgctcctggccggatccacggtcggcctgcctcaagacgcccgagttcgtgctcagggagtgggcggccgcgcacgggctcccgctgcacaggcggggacgggcgaggcgagcgtggcggggacggccagctgtggcggtggaggcggaggtgcccgggcggttggtggcggcagcggaggcggaccgggcggcgggtgacggtggcggaggcggaca

SEQ ID NO: 41997 - DNA, 6343 bp, Oryza sativa
ccgctgctgcggccgccgccttcctcccgccgtagcctcccgcgacgccgccggccacccgagctcgccccgcctccgcctcctccaccggcgcggatctcgccccccagctgctgttgcggccgccgccttcctcccgccgcagcgccgcgccccgccacagcctcccgcgacgccactggtcacccgagctcgcctccgccaccaccgcccgcctccctagcggccaaccgagtgggcagactccgcctaagatgacgccgatgcctaagagcggccggccgagcaagacagagaaagcaaagggattggggaggggagagggatgacatgtgggtctaggtgtttttttaattttatttgctgactggattgccacgttggcgccacgtgtgcaaattcaagtcgaaaacagctaaaaacagtgctgagggtttgtatagttgaaggtgaaagatgtccggttttatggttcaggaggtaatttggtcgaccacgatagttcaaaggtgtaattcgtactttttcctatatataaatatgtaaacattgtccacggttgggacacattcaatacagaacacatattaagcacactagttggattttgttccaacaattatttaaattttttttaataaaacgaacggtcaaacatattttaaaaaacgatctcaaatatttagggtcggagggagtaatataaaatggaaggaataataaacacgataaatcgaccaggtcgaaggagggaggcggtgtgaggtgcaccacagaagaggcggagggctttcggctcgacggcggccgggttccaaacttccaatcctagacagataggcaacgcaaacgtgccagccgccgtggaaggcaagacgatcggcggcggcattttgcatgcagcagccgcccgtgccggccggccggtggcacgcatcccaatgtcgtgaccgatcgaggaccagtagtggcgcgacctccacccctccctccagcagcctcgtctcgtcgcgggtcctactgcatcgagccatcgagggccaccgtcttctccgccgccggcggatggatggccctctcgctcctcgcgctacctctggcgccgccccactgcctgtgcttcaccgtccttcgcgtcgcgcggcgccccacgttctgccgcgcggagcgaattaatggaggcgaccacgacgaggagctcgacggggtgccaaatctgagccgaccaccgccggatcggatggacggccaaatctgcgtccttctgccgcgcgcagcagccgcgatggccggcgacgacgatgaggacctcgacttcgaggcgcgccacgccgcggccgggttgtcgatccgtgtcttcaggggcggcgaataccgcggccacggcccgttcccgtggcgcggaggctgatgccgccgcagccgccggcaacaggtgggcgcacgtcgacagcgacctgatccacttcagcaacgcgcgtacgccgccgccgtacgtcgtgctccatggtggcagcttccatagtcgttagtatagtaattaattgtctggtggaatcatacgcatattgattgccagtacgttggaatgtcctaatatcggagaaaatggatatttggatcttcaaaactaggtttcgctattacatcatcatcaaattttcaaatggaatgtgctgacatgtgcttttgatctaaaacaggtcaaggaccttcaccatgcttcgaggaaatgagcaaaaaatggggatagctgttgttctatggtcaatttacaaatataggaataatgcatgttttaagcatgtcatccctgatgtggagattatgggtaccccatacccacacggcatggttatctgactggttataggggacaactaatatctatgaaatatgtaacggatcatgacttggggcgtctacgtcttcaccgaccggcttgcctccgccgccgccgactggtgtctctgcctgcatggctagtctattatgccgccgtcgtggggcgtctacgtcttcaccgaccggcttgccttcgtcgccgccgactggtgtctccgcctacacggctggcctattataccgccgttgttgggtgtctacgtcttcaccaccggcttgccttcgccgccgccgactggtgtttccgcctgcacggctggcctattatgccgccgttatcgggcttctacgtcttcaccgaccggccgcctcgtatgacgccaattggagctatcctcttcacggttgcccacgtcgtcgtcatcattctacttctttcgtcgccgactggttatgccgccgtcgactggtgtttttaccttcacaactacgcgtcttcgctaccggtttgcttctgttaccgccgattcgagttcacttcatcactgctatgcaactttgtcatcatggtggagcaacttcaacttcattgtcttctgcaccggcaatctctattgctgctacttcgcaagttttgctacttcaccgaccacgacgtctacatgagcctcaacatattgacgtgtcacgaaatttgacgtcgtcctaatctactactacaagtggttctacaattttcaagacttcaactcggacatcttcaacatgtatcctcactcaagcaatgagtactcgacgacaagctacagtttttgactctatattcagttgcttcccaactaaccaaagagtcgggggctatataaatacaagactcaaaatccgacaagttttatgtcaagataaagcaatcaattaatcaaggagtcaactctgggagtcattatcttcgtcttcacttccgagcaagctttctacttcatcaactccaattatttcaccggcaattttggcttctctgtcgtcgccacgatctacttcaaatttctctagtatcaagtttgagatttaatctacatattcgggaggatggagttatcaaccaatttcaacgagttggacaacaatttctacttttcttcaagtgaagcatctacaacagctacaactccaagttctattgccatctttataaatcaaggggtgttgcatcaatctttgttatgtacacgctcgcatcaaggaaactactcgagtttcaatatcttctcaacaatttgatggattattgtcactgacatcatcaccaacacctctgcttcatcggccctgacgtctccgctgttgctaatggatgattatgtcttcgccgacttattatttcaccttcacagttgacctactacgcaaacgctgatgagcatctttgtcattatcatcggctgctacaccgctattgactggatcaccgacatcgtcatcttcatcaacatcctgtcaagcctcttcaacatagcccactctactaatattgatgggcaacttcgtcatcatatttgatcatctctattgttgccaatcgtcattaccatcggttgcatttgttgtcgtcgactatttcctgcattttcatgattggaggatttcgtcatcgtcgttgatgcgcgtctacatcttcatcgttggcttgttttcatcgccaccgactggtattctcgccttcacggatggcttattatgttgccactagtgggcatcttcatcttcttcaccagctgcctcgtatgtcaccgactgattatttcgctgccatggttacacaactttattgttgggtgccttcatcttcattgttggctgacctgactgctgccgactggtttcttcacctctacggctgtgcaacttcatcacttttgattggtatcactatcttcactaccaccaatatttttgccacctctgttgggtaatattatctttatattggtcgtcttgtctctatgccaactacgtcagctaccatcaatggacaattgtgactacgatagaaggacaagctatatgctcaggggcttactacctcaaacacaagtatcataccttcaatttggacttgttccggatacatgcaacatgaattcatgatcatgggtctattttctgtgctcaaggactagactatttattattccccgtaaaggttatcaactgaatacttgcaccagtcgggattcaattgttatatctattttggagtatcccataagggataatcactcagatcagaagctattcatatgagctacacttggtctatatcacccggaagatttattactcgggagcatgttatatgcgtcatcctttaaagggtgtcgaaggcatattttttggcctaggcctaatatgtctgcagcccacattttcaggtgtggtctgtcacgttcttttagggacttaggcactttttgcttaggccaaagtgcacgtgatcaagtgcccaataccttaaaatccttttataccgcagttacttaactttttaggagttggtacaatgcatcttaaaagctgtcaaacagtaaagctttatatagctgccccgctgacttttttatatagtcaaggcgctgtttgggtttatcaagcaattgattggatacaatatcgttgctttttgcgatgtaagtgtgcatttttattgaccaatattatggcttaggctgattatatattgtggtcattttccaggcagctggtaaatcctttatgagtttatttacttggattttacaccacatatgctgtatatttctaggtgtggtgaaaccatgtgtcttttagggacttaagcacatctgttaaagcagtgtgcgcatgacttatgcccaatactttggaaatttctttattcacagcattcaagcttttttataactgttttgctatgtgaattttcaatgatgtagtcaactttaggttgctctcatcaaattttacaaagcagtcggtatatcatctggatcatgttatttagggattcacaccgcatatgctatatattgatatcaagtcacttggttgactataattatcaaaaaccactcggttggttggattatttattccttgactatatgcttggtttgttcaactaatcacatggtcggaggctacacctattaggtgcatatactcgatgcacctaaatttacattcaattatttttcagccctccacagtctttggatttggtaaaagtactcgagagaccatggcatagatgattgaagcactcggctctggagtaatctagttcgagagaagattatcttttcgactgtgaaggtctcaggggctactgtggagattatgggtaccccatacccacacggcatggttatccgactggttataggggataactaatatctatgaaatatttaacgaatcatgacttgggtattacgtttccctgtatattatggaacggcctaaagtcctggtttgataatattataaaatagatttaggaaaccgataccatattggttaaggtttctatcttgtaaccctgccccccaacctatataaggcgggcagggagccccctctaggggcatgagcacatatgactcaactagatcgatagatcaatacaacacccggcggattcaaatccccaaacaggagtagggtattacctctcatcgagagagcctgaacctgtctaaattatttgtctccgcatccatccacttttaggtctcgtgcgccacccccttttactattaccgaatttatgtttcgacacctgatgacccaactgacatcatcaactgaatgtcgaattgggcgatcctgcgtcgcgttttgggcttttggctggagaagatgtgcacgaagactttaaggttgaaaaaaagatatgcatctacaggtgggataaaagaagaggcttggatcctgaagtggagtcttttgtatgcagatcatgttgcatctcagtttcattgtttcttcaggaaaactatggaaatctggatgtttttgtatttataatatatatgctcgaataggttgttgttttttctgtctttctggaggcctggtccacgagtgcagaacactttatgcagctctatctcatttctcttaatggaaatggagggtatatccctttgataaaaaaaaatttaaaacgtgattcgacaaaatgtcaatctcgagcacatgctatttgccgctttgccattttcgttttccagtgatttccaaaatgtttttttgcccttacgcgtggtgataagatgaaaatgcccctatctatggtaagatgaaatgtttttttgctctttttatttgacgaaacgaacgcagccggccacggcaacagccggcgcagagcttcttctcagcggcctcgtcactgtcgcggctctccttcacgagccacgccaccttggccttgggcagccgcatcagcctccatcgg

SEQ ID NO: 41998 - DNA, 12777 bp, Oryza sativa
gacgacgccgctcaggtttttgatcaaaccaatccattgacacaaacgattgatgggcgaaaagtgggttgtttggatcttggagataagtgagttgttccggtcctggaggattgacggggagaactgcaagttttcggagccgagatatccattcgagtcactatgggcgtatttgttcaattgacacgtccgaaggaatcatcgttggacttactggatctttagctattcatgtgagaattgatcagctaatactcatccgtccaaaaaaaacccaatcatagctacaaacatggatatatagtgttcagattcgtagctaagtttgtctttttttttaggacagagtagtaatatttcccaagtatagtacagtacactaaataaaacgggagagcagtgtacaaaacatactacctccaatccaaaataagtgcacatttgagtattcgcgtccaacgtttgaccgtccgtcttatttgaaaaatttatgaaaaaatttaaaaatattaatcacacataaagtgctatgcatgttttaccaactaatagcagtaaaaatactattacatcaactgattcatatacactaacgaacaagaagtgcaaggagaaaagatgaataatgatccaaaacagaacagaagcatatggcatggcaaagaagcgaccccaactaattccttcctttgcaaccctcgtcatgactcatgattccaccataacagctatccgtattagtctctacttataaacagtgcacgctccaaattcatccgagaataaacgtcaccttagcatctaattgcagacagaacgatatatcaggttgaaatacataagagtgcatatgttacacattatccaaatgcatgccacattaatacaaagccacataggtttgtaccgtctcatagataaaaggtgcttagacttagtaccacaaaatacataaccatcaaggataacattcagacaggtgaatcacatgattcgaagggctaacagggatatggtaaagctaatattcagacaggtgattcacatgattgcgaagtgctaacagggtgaagaacacagcaccagacgcagaaacagcggacagcgccatgatcctgtaatatctcgcttcatctgcatgtcgtttagccaattcagcaagaaacctgatgtcctcttcaagagtagaggcacggcccttgccagtaggagttgtagtcttgggagatgctgtgccctatgcatggttccacatgaaggaagaaacataatcagattgctaggcattgccaagtgcaaacaaacggatgctgattgaagaaaaatgcccagccaacagatgaagtagctagcataactagtcgctcatttagtcagttgcacataccctcaactggtgcatcttgcacttgcctagcagttacatattccctctatccctaaatatttgacgctgttgacttttttaaacatatttgaccgtacatcatattcaaaaacttttgtgaaatatgtaaaactatatatatacataaaagtatatttaacaatgaatcaaatgataggaaaagaattgataattacttaaattttttaataaaacaaacggtcaaacatatttaaaaaagtcaacggcgttaaatatttagggacggagagagtacaaccagtatgtagatagagagtgacactaattctatttaccataacaaaccggatactcactacttacacgatcctatccatgcactcttaatataatatataaatattttgcttaccaagccagcaatttaagagacaatattatatgcatgcatgcatagacaaggtaagttaacatcaggcaggccatgaagcaattgagtagagaaaagagaaacttcgattgaaactttttccccaaattgtgctctctaatctgggtcgggtggggagagcgcgagatgaatcgaaacagatcctgaggccaggaagcgagcgagcggggctaattgcgcgcagctgacggtggattaaacctatgcgggatcgatcgatcgatctaacgaaaatagggaagctgagaaggggggcgaaggaagagagacaacctcgaggcggtggagggagcgcgatggcggcggcggcggcgcccggcgcagagcagccgggaccggcatgaccttcctcgcaagagtgcgcatcgccatagccgccatgccgccgacgtacggacgaacgggagcaaggtcgggggcggcggcgacagcgagctagggtttttctctctctctctctctctctctctcggtcgcttcgctgggaaggacgaaggcgtcttggttgagagccttgtgtgtttcttcgccttttccttttctctctcttttgttaccgctgccctacccgttactgggaccgactccagatgcgccaataggttcggcccagcccaccagcctgtaatcctgtatttatgctgttatagaaaaactatacatataaattttaatttcatattttaaaactttatacatacaaacttttattatttttttacgatcactctacatgaaagcatataaatctgaaccaacgtacatataaaatgttttgttgtaggtgtaaaatgtttgatgcataaacttgacaaaaggaagacatggttgttgaaataggaaatcttccatgtttctatagttaaattcactgtgtcgctttaggacaagcacattttcggcgtctactttaggctccgccatctttgtagtcttggtagcctagttttccctaattaattgtgcgttgtaaggtttagtcttattttctctttaaaatgtgacaccttcttctttatataaaatgtcggcaacagcctaaacgttcggaaaaaaaagtttgctagatagtccgaattttttatttatagtaattattgatccttaaataaaataaatagtaaatctcagattaaatttgtaaaaataggaaggacgttgttcccaatagcgtccagacttggacacacttctgaggagcgtccaaaggtggacgctgttccggacggcgtccaatctggttcacctcatcctcttgggttcggttgttcttcgacgttctccacaaccatttgcaggcgaaggtgcaccatcgccggctttcctctcctccctgcacggctagggcagaggagccaccaccgctgtccacctcgacgtctgggtggcccgcaccgacttccacctccacctgggaaggtactgagtccacctcggctccagcctccggggaggcggcccatcgctgtcctcctccacccttgagaccgtagccgcttgcctccatgcccaagaaaccaccatcgtcgttcccctccatgctgtcttccatcccttctcaagtacgccacaaggttgctgccaccgccttcagaggagatgcgagcctgttactcaactccgcagtgctcgtcggtggtagactggaagcccaaacgcctccattgcctctcaccgccctttgtgatgtgttctcttcaggtaattctttatttggagcttccattcctcagcagttcatggcctaccaaattaaagcaaaatgattagttcatttacttcagtacttggcaatacttgcatcaagttcagaaaaaaatctctggcttcacgaacaacaatattactgatgctaatgtccatcatgacatacccccaatgttgcattggtgatcgatcttcttgataaatttgaatgcaggttagaaaaaccggctactaattaataatgtcaattatgtgttatggatgccttggccagtcaatgtatcaaaactatccgaaaacaagacattggttcttattttgctttattttgtgtgctcaacgtctgtacttacaggctatactttcaaatattagtgaattccatgcataccactaccagttaattgtcatattctgtttatatgtattcttctgtacagcctgctagacgctaataggagtaaaaagatagagtaattgagtaaatgactgcatcacattgacaaaattgataacgtgtacagtctgtctgttagagaaagggatgaaggcaaagctattatatatgcacttcaatggctaaagacaggggtacagtacgtaaatattccattaaggacgcaaatcatcatttgttgatcctctcctttcggcgtggtgggtgaatggagaggagacttccgcacccagagaccccaaatgtgcgatccattctggccggacgcgttgcgcttgcgaaccaggatatggacgctgttgccaacaacgtcccgatctggacgcacttagttacagcgttcaatcctggacgctacagtcaagagcgtccttcctatataggtaaatcccaccccataattactaaatttttaatttaggtataattaattattacaaataaaaaaatcggctagatagtcttttggggcatgtgagtgctgcagccatttagagttgggacaacaaacatatcaaagtgaagaacactactactccctccgtacgtcccaaaagattcgtctcgtaattttacacgtaatatatgtaattattttttttatatttaatactccatgcatatttttaaatattcgatatgacagcatataaaattttgacggggcacgatctgtcgccatatattctgacggagggagtatggttcaggtctctttgaatttttgttaagactgatggctgatgctatctcggcttcccgtcgcttgtctgcaataatgttcttttgagctgatgggcgatatgggctgctgattgttgctttcatacggtatagtagtattaagggcctgtctatattccaccctaaaattttacatcatgtcatatcgaacgtttgaacgcatgcatgaagtattaaattatagactaaaaataactaattgtataggttgtgactaatttgcgagacaaatcttttaagcctaattgctccataatttaataatgtggtgtgacagtaaacatttgctaataacggattaattatgcttaataaaatcgtctcgcggtttactgtcggattctgtaatttatttttttattagcgtccaaatacccatacaacactttatataatatccgatgtgacacaccaaaactttacacccctgtatacaccccctaacattcaatccttctgcatatttgaaaaaaaaaagaaaataattgtttgaattgatatgatgtttttcaagttctataatctatacagggtcaaacattaatattaaattaatgtgatgtgagaactagttaatgctgtggatgatacgcctctgcttgctcgagcttgctgccttgctgcaccgctgtttgtgcgagcagtagagctacgggactctttcgatccctgccaaaaattttacgccatctcatatcaaacgtttgaaaaactaaataaagtataaaatataggttaaaaataactaattgtatatattacgattaatttatgagacaaatcttttaagtctaattgctccataatttattaatgtggtgctacagtaaacatttactaataacggattaattagacttaataaattcgtctcacagttcactgatgaattctgtaattagtttttttattagtgaccgaacaccccatacaacaccctatataatatatatccgatgtgacataccaaaattttacacctctaaatctaaactggttttccctggattgttagttgtttgaacctaatatatactatgcttcgagattacatcctttagttctaccggcgccctgcctctgcatgcataacagtattgtctcttaaagtatctatggctagcaagtctaagaggatatgtgcaactgactaggtcctatttagattctaatttttttcttcaaactttaaacttttccgtcacatcgaacttttctacacatacaaactttcaacttttccgttacattgttccaatttcttcaaacttctaattttagcgtggaactaaacacaacataaatgaactgactagttatgatgttcctccgctgcttggttttatatgaagcaacagctgtttatactgtttgcacttggcaatgcctagtaaatgtaatgtggtaacataataaattcataatgccatattgtcatagataaattaaaaaccggtttgattctaaaaaaccgccatcggttcactgttcccataaaaaccttccggttcaccggttttttaccggtttgattgcaggaacagtcttttttgctaaactgagccaccaagatgctagttcaggtttttttggtttaaccgtcagtccagtccggttttttttattatggtccaaagtgatacaatatggtaagaataggggatctaaagtgaaaataagggctaaaggtagttcagaaataaaattcggttagacatgggacctagggttcatgcaggagctagtctgctagtgctaacacccaagcacgtgagtcatgtgatagaaattcgccgcttatatataagttacctagaagttagaacgtgattacatttttagttattattataccgtctatagttatatttgaaagcttttcaaacaagaatctgttgaatgttttatagatacacccaattaattgagcagttgaaactaaagcaaaacatcatgcagtgctaagcagaatgggtgtttggagcaaaagatcgatcggtggatgtggctagcaggctagggcttttctttttgtgcaggctgtgactgtggcgctgtcttcccgcgccttttgttttggcaaatggcaatcctctttcccgtgactcctgcctggctcgtgctgaccaaaccaaaccaatcaaggccgtgtttagtttgtgtgccaaaaattttttttatacgtacacatatttaaagtattaaatgtaaactaataacaaaataaattacagattctgtccgtaaattgcgagacaaatctattaagcctaattaattcatcattagcaaatacttactatagcaccatattgtcaaatcatagcgtaattaggttcaaaagattcgtgtcgtaatttacatgcaacctgtgcaattaattttttttccacgtttaatgctctgtgcatatgtccaaattttttatgtgatggaattttcggaagtttgaagggaacacacagtcgtagggtgtgtttaattcacaccaaaattggaagtttggttgaaattgaaataatgggatgaaaaagttaaaagtttacgtgtgtagaagattttaatgtgataaaaaaattaaaagtttgaagaaaaattttagaactacactcccgccgtagtactactccatcaagtttacacgagtagtagactgcactcgtattatcatatcacttcatcaagttgtgtgaaaaggctatcctctcactcatcagtagcatcatcttatcaatcagatcacatcgtggcagccaatgcgtgcaaaaaggatggagcatacgtatagacagtgtagtttcagacttttacttttgtaggagtagtactactagagccaaattttttcccaaaaacatcacatcgaatttttgacacatatatgaataattaaatatagataaaaagaaaaactaattgcaaaggaaaactaattgcacagtttgcatgtaaatcgcgagacgagtcttttaaggctaattaggccataattagccataagtgctacagtaacccgcatgtgctaatgacgaattaattaggctcaaaagattcgtcttgcagtttccaggcgagttaggaaattagtttttttattcgtgtccgaaaacaccttccgatatccggtcaaacgtccgatgtgacacccaaaaattttcatttcctcgactaaacaaacccgagcctctttctttttcttttgcgctacctatacttgtactagggcgaaaaatttaaaatttagctagggtggaatcaaggcattgtttagggggtgtctacatcagggtgaaaattactgaggtgtcacatcggatatatggacataaatttaaaatattagacgtagtctaataataaaataaattacataatccgcatataaactgcgagataaatttattaagcctaattaatccgtcattagcaaatgtttattgtagcaccacattatcaaatcatgttgcaattatgcttaaaatattcatctcgctcatgtaaactatgtaattgatttttttcatccacatttaatattttatgcatgcgtccaaacgttcgatttgaaagggtgaaaatttttgggacgggatttaaacaagaccaaacgttcgcgaaaagaaacaatagttttggagacatattatattatgggattatgggatagagggagtactaattatttaatttgatgattataatacttattatgagtagaaataaaaaaaatcgggcggatgagcggatggatgtgctgggccgaacgtggtcgcgcgtgggccgagactccctatacctccccgcaacggtcaacctatccgatgtcggtctcggattgtataagtgtaaaggaggccgagtcggtcccagcaacgggtgggaccagagtgtatggaccgggtttatttagggcagcggcaaaattaaagatatgcgatacgttttagagagagagagagggaagggggaaaggcaaggggaggcggagaaaaacacaaggctctcaaggagagagagaaaaccctagctagctaggcgccgtcgcaaccttgctcccgtccgtccgtacgtcggaacgcagctatggcggctgtggcgctgcgctctctcgcaaggaaggccatgcccgccccggccaccctccgccgggcgccgccgccatcgcgctccctccaccgccacagcctcgaggttcttctctctttccttctcagcttccctattttcgtcagatcctgcgtaggttcaatccaccgtcctcgcgcaatcaggccagctcactcccgggctcaggatctgtttcttgttttcgtgattcattcacctcgccctcaacccgaccgcgattagagccccgatttggggggggggaatattttttttcccatcgaagtttcttcttttccgtattcattcgcttcatggcctgcctgatgtgaactttgtgaaacacaagcaaaactgcccccccccccaccctcccaggaattattagttgtttgaacctagtaaaaatttatgcttcgatattgataatccttggattctactggcatttcaaaactcaaaccctgtctctgcatgcatactattgtctcttagagtaattattagcttgccaagccatatacagtatgctgttagactatatggataggatcgtgtagtatccgttttggttttttatacatggtagataaaattagtttccctctctatctacattctttcatatatactagtagtatataatatggctacgcaagtgcgatacataacagttcgatatgtgcaactgactaaacgaacaactaattatgtcttccttccccttccctttttcctttgtatcctgcaataggtttagtcaccatcatcgcgcaatttggccagctcgcttcccggggttgggttaggatctgtttcttgttttcgcaagtcacctagtactccccccaaaccaaattagagaccaataggggaaaagtttcgttttttttctatcaaatttcttcttttctgtactcatttgcttcattcatgacctggctgatgttaacttggtgcaaactggttttcccgcgaattattagttgtttcaacctaaaatttatgcaactggtatttcaaaccctgcctctgcatgcatactgttgcctcttacagtttctagcttgctaagccatatatatcatgtagtaacaactactatctctgttccatattataagtcgctttgacttattttctactcaaacttttaactttgatcgagtttatagaaaaatatatcagtattttcaacgcaaaacaaacatactatcaaaatatattaaatgttagttttaataaagctaatttgatattatagatgttagcaaatttgatattaaatgttagtttgactaaggaaaaaaatcaaagcgacttgtaacatgaaacagagagggagcagtaacaatggctaggcaagtgcaagatgttacagttcaaagggtacatgcaactggctaaatgatcaactagttatgatgttaattgttagcccttcctctgctgactggtttatcctgaagcaacagctgtttggtagtctgcacttggcaattcctagcaatataattctgtatcttcattcatgtggaattgtaggataagctgcgtggcacgacatctcccaagactacagctcctactgatcaaggtcgagtcagttattttgaagaaaatcctgagctttttgctgaattggtgaaacgagatgcagctcggaggatgttcaccaggttggtgctggcgggtgctgcttcagcgtacgctggtgcccttttcgttgtgtcgtctatgcgcgatagcgtgaaggaagagcttcgcaaaaacatctacgactaggagctctatcgccagctggtggctacatatttctgtctctgtgttatctatgactctgccctgcttatcatggcttgtttaatgtaacatggcatttcctactaatcatcgatgtgtaacgtaccatcgtactatagttgcactctataatagtttgtgatggttggttggtagtaacgccgttacttcatggtatttttggatagactggtgaatagccaatacggtttctatagttttgctctgtgatcagtttagtccctaatatttttaacaagtctgcaagatttaccacttggcctaaatctactgaaaatggcatgcggatgtgacatgtcatcctcgcatgcaaagtcggcaattaaaatttcattataccattatatgtgccacagtaaaaagaaagaaagatcggaaaattgaaaaaaaatgaaataaaggccatgcagaaaaaaaaaacacccaacagttcgactatgtaaaacaaacatccgtgcaaaaagtactcccttaatattataagttgtacaagtcgtttgactgtaaaacaaacatattataaaaaaaacattaaatattagtcttaatgtaattaatttggtatcatagatgttgctaaatttttctataaatttgatcaaacttaaataagtttgactaggaaaagagtcatatttttaagttggtttgtccttccactaaaaaatagttagcttgtcttatttttgttccatctctattttcttaccatggtttatataatggtagaaaggctaacttgcatgtaagaataacgtgacatgcccgtataacatttttttgttgggtttaatgattatgctaagccaaataataaacctttagtacttatttggataatttgatacatcaaagattaaattgaccttggagcggagtttcatacaccatatttgctattcacttgatgattatggatcactattatggtatcatgagtcatgacaaaaatatggtggtgtttattaattttgtaaagtcgggataaatgcgccttgggagagcttttggtaactgtagtttctcgcaaattaatagcactccaaaccatcaactttttgtccagaaattatggaagcttctggagattctcatgagctccttatcagaacctaaaactctccaaaacaagcctttagacttatcttacaaagcaagatgtatttgcaaaattatcacaaaaaattctagaaaaaaaatcatacatgtacttccaatagtattacatctacgtgcaaagtcgcatcttcaaattctttctacatagagagtaacaaaaaagataaaattatgacaacattataactttaaaactgtcagattttttttgttacagctaaaatgtaatgaatttgatgttaacattttacccttagatgtaacactattgaaagtacatgtatgattttttttatagatttttggtgacatttgttagttggtgtgcataatatatgttgcatatatatatatatatatatatatatatatattaaatattttgataaataaacttatgtagcttaggacaatggatttgtttaattaattcaataggaaaagttttttgagaaaacatatttgtagagatgtagaataaataattcactacaataatcctatgaagtatagctgaaaaacaggatttggtcgtcaaagttagctatgcccactaaatttgtgtgcacttccattttcgattgggataattctattttactcctcttgtactctccactttatctaaaactcaccccaaaccctaacaagtaacacctcaggattttcataatcccaaacattcagcaacgtttaaccgacagtcgttggcctaatctgaggtggttctagaggcctagtcagccaataaaaaaagttgtagtaaatttcataaaaccacaggttttgggacatttataaaacaaaccctagcttttgcaacttgtttcaaagaatcatgggctttatggcaaatgtttcataaaaacccacattcatccctatatcttttgtttggctattatacttacgcaaaatacatgtataaaaaataatatgtcataattttctaagtagatacacaggttagctacttccataataaacatgttagct

SEQ ID NO: 41999 - DNA, 5753 bp, Oryza sativa
catactatcaaggggggtaatgacctagcaaagagatgattaaattgccacattaggtcattgcattttcatttatgctcacattttcatcacacacacatattcacattgtatctcactgggttcggcctgaccaggggcggtcagaccggccacatagtggcagtctgaccggcgagccctggccggtctaaccggccgcaagaaggcggtctgactggcgcataaggccagtctgaccggtggcacacgcgcggtcagaccggccccctggagaccgggatggtgctgctcggggtggccgatacagagccgacggagccatattcagtcagactgagccgatggcggtctgaccgagccgaagccggtctgaccggccactcaacctcggtctgaccggccaggccgatggggccctctgacagggctacaatggctagttttccagccgttgcagagtagcacggtctgaccggccacatacctccggtcagaccggcagagcacaaagttgggggatttcacccccaacggctagttttggttggtgggagtataaatactccccctccagcagcaagggggctcccttggcacccaatttaattgcatacaccccttgcatctctctcacacccacttgagctttgtgttcatccatctagtgtgttagagggttgattagccaagagacaagtgcattgcttccatttgtagagctagtgtggcacttgattgatcatctccacgccgggtcattgcttgttactcttggaggttgccgcctcctagacggcttgtggaggagttgcccggtgacctctccgagaagattgtggaggaggcccagcgccggtttgtgagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaactggcgagtttccaaacctcagtgaaaaatctcttgtctcattgtctcgtttgattgtcatatttacatttatgcaatttatatttctagagacatacttgagatcatatcaccctaggattgctaaacattgacataggagtgtgatttgcattcctagagatataattgagccactatcaccctaggtttgcaaaacataacttagttgcttagttagagttcaccatcaccaagcctagcaacttaggttagttttgattaggtgttattcatcccccctctagtcgacatctcgatcctacacggatagcaggtgctatatcagacgctaagttccaataacatcatttaattgtcacacgtatttaggtatatatatacttatgtatcatgaataatgaatttataaagcattaacaaagaaatcataaacaaattagtgatagatcgatacacctataacctatgaggataagtagaggtttagtagcacttggagaattcatatctcgtgccaacttaaactaaattaagaaacaaacatgatattctacttattagacgttatgactcacaagaaaatgttttggaagacaaaacaactaacaaactcatcatttgttatgtgttggtggttatataaaataggctcacgctatagcggccgctaaattaaattacagacgctataacggcccattaagttccaacatgctatgtacaatccactacgtcgtcgtagcggtagcggtaggggctcgctactgctatagtgcccactatgaacgctatagggtgtgtttggttgcctcgcacctgtgtgtgcaactttctcttgtttagttgtctggtgaccttttcagcctagcccaacacaggcgggactagttttactgtatctttagctatttttgtaaacgttgatttgatagtccgtctgaaaaaataaaatcatgatgttgaaaaaaaatcgtttttctagtggtggctacctcgttttctgttagcatgttttgcaaactactaagttataagttatgtgtggaaaccttcttataaaaaatttgctttaaaatatcagatactacttttaagtttataatagttaaaatttaattaatcatatgtcagtggtttgcctaagaggagctaccgagccaccccagtaggacacaggcgtacgctcttgcgtaagagtagctagtaatacgcaagttacgtaaccatctgcgtaccgagttatggaagtaaggactgctctaactccctcagctaaacagtttcagttctaactaaaatagaatttaaatggagcgctattataaaataaactaaatatatagaactagattttgactgtttcacaactacacttcaaacctaactcctaaagcttaggtgatgttgagataggagggacttattttagtctctctcacacaaatatagacttatgtttagagagttggagctatcaaatagggcctaagctacgtactgtacgttttttttttagaactacgtacgtgtagtctaatcaaaactctctgcctcgctctgctccatttgaaagatggtgaagtccatgcttagacacagaaccaagcatcttaattttttttctagtcagtggagcttgtatgcatttcgtaagccttatccgatcatttatgacataaatttattagagcgcatgcaaacaacattctcccctcacatccaataattaatatatatacgtacttaattagtaattaaatatcaattatctatattttgggcagattcgctctaggatttgcacactacttaaaaaaaacctattagtgccggttcttaaggcctaataggtgtcggtttttttaaaaaccaacacctataatatattataggtgccaaccggcacctatagtattgctaccggtttttactaatgaatcgacatctatagtgctttaaaggtgccggtttttaattttttcagcgtgcagagataggaaaaggcctataggcgtcggttttaaaagaaccggcacctgtaaggccgatccctatgagtgtttttgtagttagtggcacttccaattatttgatttttgcacaaacaaaataagaatcttaaaaagaagttgaagcttaattgatttggtatagtattttaaaattaaatttcacatgaccgtatgaactatggtctttgttgtataaacggaattttgacatgtgtcacacatataaccttggtagtatatatgatatcagagcttcacataaccgcatggttatcaattgttcttttgattcatcgtaaattctaaaatcaaatatcaaatttattgaatagaaagttttagtcatccaagctgagacctttttttaatctattttactataataccaagatggagtagattggttaaaggcgtagctttgttaaaactatacagaacagttggagttatgtgccacttgctaaaagtgttaaaatcttatttatctttgagggggttggtgtagttttccttctaggggggctaaagatgcccatatacaaatttactgccgtttgttaatggcagctctaattaaattatgttgccaaaaggaaaaacaaatggcatgattgcaccatcggataataaccgttttaccggtttgtgcaggagactgttggtccggttttgagctttaaccaaatcgatgtgatatgacaggtccgccagctagatatccggtctgaccggtttgtgcgatacgtgcatgacaccaagtcactctcctagtgatctactctctccgtcccataaaaacttaacctagaagaggatgtgaccccttttaggacaacgaatctggataaaagggtgtccagcttcattagacacattccctcctaggttgagttattttgggacggagggagtatcataataagaagaagcagagcagagtgatcatgcgttactccctccatccataaaagttacaccaattacttttgtcgataagaccaagcagaaattaaatcaacttggatatttcaaaatcaaagagtgaatgtaagcatgtaaccaatgagtatttagatgactccttaggttctaataaaacatttaatttatctcttcatttaagtattgaatgtataaagattataaataggacaacttatttggaaaaactcaaatgtgaaataggtataacttttgtggatggagggagtacaacggaaaaactatttgatcgggtttataacaccttgtatatgtgtagtattttgtgagtaacggattatgactttggctcgagtggttgactatcgctttcgcatcacacactcttaatttaaaccaaatggcggaaggaaaccatacgttgaaaccacgtcagctttggacagaaatgataaaaaaatcataaataatgacataaaattataataaaccttatcataattcatatcatgaaaagtatctaacggaaattttatgttgattccatttagctaaaacaaacattcaacgagcatgagaaaaagatatgctttaattttcctaacaactgtaaatggctcaaacagtgcaaaccttataccgtaaatggaaaaattatgctaattttcccggtaaaacttctaataatataaagcggagtgagtaaaaattaagaaataaaatcagcatgttcgttatcggtagattcagtatatgtgaggcacgatcgaccaatgcttaattagacaccaactcatcgattgcgcacgtcgtagctagaaacaactttaaaaattctatagcagtagagatatcctcgcaaagaaacaaaagaaaatttccgtcataataaaatttcggtaaaacctacacacacatatgtgtgtgtgtttgtatatatgcacaaatttgtcttcaaacaaagctgtcattttcaatatacccctgataaattttaaattttcagtcttacttaaaatttgtctaaatttgacaacttacacaatgaaatgtttgcaggactttggaaccaaactggctactggaaatactaccccgtgcaagtaaaacacgtgactacagtaagcctagctgctaatctgctactctctccatcctatatataaaaaatcaaactagtaaggattttggttttttttgacggtggaagtagtactagtattctctccatccaaaaaacataagctagatgaagatttgacaccatcaaagataaggaatttagataacctcatattcagattcattgtctaggttattgttgatgaaaatccgtgacaatcctcatattagattcagcttcgatctaacttttctctccgatgctgatattaccaattttggtcgttaacagttatctatttttaagacggaggaattaacgtagctggtgtttgaaactcatatagatgaagatgaagattaagtgttttacacaaaacaaggtagtattaacgtatgattaattgagctttaattattataaacttgaaaaatatgtttatctgatattttagagcaacttccttatataaagtttttacatgaaacacactatttagcagtttaaaaaatgtaccacgaatatcaaatttgtatccaattttcgttagagaaaagagcggggcctaactccatccttctcggctctggaacatccttctggcacacaatgtgacctgatcgatggatactc

SEQ ID NO: 42000 - DNA, 8103 bp, Oryza sativa
atgaagtgaccaaccaaaactatagtttatggacaaactatacagtacgccggtcttgttgatcatgggtgaagatgttcttgtgcacatcttaagttttcgagtgacaaaagattaaaaaaaagtcactactaaacttcaattgtcatcgcatggatttgagatgaatacatagcaattttcttaaaaccaaaaaaacagaattaagaaaataagaaaaacacagtatgttaacatgaatgtaagggtaaaccattgaattatacacgcacgggaaaaaaaatacagaagtaaccgtttcactcgatggcataacgaacacgctaaaaatgattggtataccgtatctcttatgttaaattttgtctaaaaattaacttttgtaggattattaggacaccttcgggacaaaggaaatattatgaagtattattggacggtttgaggggctgtttggatagattactcactttaccaaacttctatgctacaagtgtggtatgccatatagtttttgtggcacaaaaaagagagccacactagcggcaatttttttaacaagtgagtgtatgacatgtgggccatgagagtagaaaagtatggcataccaaaactttggcttcaaccaaacatttacaccaaaaagtcaaacttgcctaactatgaagccatttggaacagatggttggttcctaaagtttcatttgaaaatcctctcttattgtgcccgcaattgctgaatttttttgggagaatagccaataagattcctaaagtttcgcttttgggtcattttagtccttaatcttttatattgtctaaacaagttctttaaatttgtcatgtgggctgatatagtccttagtcccaccaaaatcgccatatggacataccacgtacgtcaccttcctatgtaaaatctatatgatttatctaatttaccctcacatatatcataggaaaataaaaacaaaagaaaaaagtttttaaaaaatatggtatatgtaagagcagaaatatacctcaaaagagtgaaaaaaaaaggagaagtatttttttcctatggttatgtataattcacactaatatttatttttttatgatatatgtaagggtaaattggacaattcatcattgattttgcatgaatgatgacatggcatatccatatgatgattttggtggacccaagaattattctaggccttataacaaagtttaagaatttttttggaccatttaaaaggttagggactaaagtagctattctcccctctctttttttttcatgtgttatgtctacacgactgtttgaagcgtttctaattttcggcaggaattcaaaaagcgtggcatcataatcccgtgctttcaaattcccatgttccaaaagaaagagcgtgtccaatcatttgtttgaaagggccaaaattacactatgaatgaagcattttagtgctccctccgtttcatgttattaggggcacgtttggatccttggcaaaccaaatcctagccttaattagcttagcaaagcgaggtgtttggtagagcgattaaaaacttgctttgccaggcaatgtgggctataaccgcccaaaaaagcttgctcccggcggagagccaaatcggctctcccgagtgggcaagcgatcgtctggttgcaccaaaccctctgtgagtggctctttgtaatcatattaaaaatcatcaattagactgtttattcttctctaggctagagtccggccaatgcatatggatcgttttttcttcgcttgaggacttgcttactagtcaaatcatccattttactatcacatgagcatgcttatttgcccggcagaaccaaacaataagcctggctacttcgagctatagctcagccgggctaacttatcctcacccgactaagcaagatgggagaaagatccaaacgtagtagctgttttgactttggtcagagttaaactcattcaaatttgactaagtttatagataaatatagtaatatttacattaccaaattaattttattacattaataattaaatatatttttataatatatttatcttagataaaaaatattacttttttctataaacttgtcaaatttaaagcactttaactttgaccaaagtcaaaacattttataacctgaaacggagtgagtagtatacctcataggagttgtgggggtgcttcggagtacaattaatgcccagctaattaaaagcttaattctggttagcttagttatgtaacctagtaataaattattggcatgacaaatcgagttgccactactatctactgcaattacttcaatttactccattcgtctcacggtatataaaacataaaactagataagtaatttcctcaaacacgctcctgtcatgtacggtagggttaatttcctgaattgtaagggatttttttaatcgtaatatgatggatcccattgatcaatcctataattttttttcttttctctaccgtattcatttttcctttaccaccaaatatgcaaggtaggaatactctagaaagtgcccagctgtccctccctccctccgtccctccctcaattattaggacaagagacgcggaggcgctcatttcgaatccaaagcctccaggcgagggcggcgaaaccctaggctaggctagtcctctcccggaggccggagaagctacccgccggcggcgcgcccctccaccctcgccgtcgcccatggccctccttctgcgcgtggccaagaaaagccgggcgaccgcggcgatggctctcgtcggcggccgcggggtcgccagctcggccgtggacagcgcggcgggtcgtgcgctggccaccctcgaccacgtccccaaggtcatcaagttcgccgccctccctccggcggccgtcgatcgtcaagacgcaggcgccaagccgggggtggagaaggcgcgccgggacgtgcggcggtggcgcgcgaccaggtgcccggagcgcaacctctagggctcggcctcaagcctggtctggcccagatcctggctccgtcaggcaagctcaagctcggcgccggtggcggtgggttgccctactcgtcgtcggccatctccagcggcggcggcggagaagtgcagccttcccgcgtcgccgccgacaactgcaggtgtggctcgccgcacctatgggacaaggggcgggtggccgtgccaggcgccgccggaggcgttgaaggagatggaggacgccttccgcgcgcagatgaagataacagaggatgcaatcaaagcgcacacagccgagtgtctgtcgagcaagaagctgctcaaggccccccgacctctgtaccaagtcttccttgtctgtgtttttgttctggctgcagtctccattctggtgattggattctttgactacgcgctcacagttggggagatgactgtggtcaacttcctcaatggaaaagagttcaaggctgtcaaaaccgacttcatggatgaagccgaagccacacttctcgatctcgcccaacaggagagggttcgagaggtgaggaaccggtacgtgcaggaggcatggaccgaatcaatgggctgcctgatcagggccctcaccctcaagtcctaccgggactcctggttccgcacaaaggaggaggactccaacaacagcaccacggttgctactccaagcgccaagtagagatccacatatatcacatcattgcctgagtactagctagtgtctagagtattagtatctttacttgtggagtttagtacctgttatcttcattccctagcagtaacaatttccatgattagtactagtaatatgtaatgttgcaagatggatgagactatgcagcaccattggttgtaacccacaccaatgcttcctaggagtatgtaatgatcatcctgctagctctatggcaatctactacagtactctttatggaactcagtcacctactgctgctgctgtgatatatgtggtaactctttatgatgttgatctcctctaattttttactgagatgccatgtgatttcctctcttttactcccaacatatagcaatcttttggagttggacatgcctaggagtgaatattgagatggcctacaaggggaggggaggggggtttgggggtttgtgattttgttgtgtgagaaacaaaactactgtcatgtgattttgctgtatgagaagcaaaaattactgtcatctactgtaatggcatatgatatactgggatattttgataggaatcaataccgaggttttagaagaacttaggattactacacatgtcattgtcttatgtatactgtaaataagtactatctccatctcaaaacataacaactttcagaggcatatctggacctacgtttacttgttagtacattttaacagagggccactacactgcacattacacaagtgtgctgcacactcctcgtggcattcttcctagttggtcttgcattcttatttatactagtatatcacaacagtagcctccacaagtatcctctattgcacattcctatttattcttagttgccagctgcttcaaataaaatagcttgtcctagcatgtattatatatatgtgccatttttgcacctgattcaactgtttctggagttctccagatagtaaaattcacaaacctcagaaattaaaaaaaaacccagaggcatctaaaaaagaaaagctaaatagtacacaattgttaagaatggagcatacttctttttatttagtaaacctaacatacagatctcagaaaagattaagcccacacatatttctgcaaacaaaaaaaaaactaacgaatgcaatgcaacagaaagaaacagcaagtacatggacagcatcaatcctatgattttctgagcccacacgtcagtttatcaacatgtctccaatttatcttggcagtagccatgaagtcctcctaattcattcatatgctactaaaaatcataatagtggaacctgcgtcagttgaatatggtcgtatcgttgtccctgctggttgctaacagcacaagacgctgaacaaaaccaaaaggagatgcagtggatggtattgatagaaaacattgcaaacaaccacatggtgaacactgagttgaatgtgtgttgcaaattgcaactattgacagttcaagttaaccgtatctaagctaaccgaaaccacttaatcagcaacacagttaaaaatccatatatcatgaccaacaactcggttggaaataacaaacttgacaaattaaacagttttcaaaatgaaaatcccaagcaataattctcaagcaagaaagtagcgaaactgatatcacagctccagaggtaatgcaaattaaacagcagcaacttggtcatgactcatgataccataacagtgatccataatatataaacacagaactaattaagctcatccaaaaaccctaagtaatgttgcgtacagatcatccataacaaatcgttacttcatagcatctacttgcaaacagcagatatatagggtaccaatgcatagagtgcaacaacaatacattacaccgataattagtcttacataaagacatgtcacatgcatgccacattaaacacatgccattataggcagagtcacacacaaaaatagaaataaatagcccctagacaggtgggtaaagctgctagtcgtagatgttattgcgaagatcttccttcacactacggcgaagagataacataatgacaagggcaacagcatagcctgaagcagcacctgccaccaacatcctgttgaagctcctccgatctgtatctcgttgaaccaattcagcaaaagtcggatgattgtctttgaaatagctgcccctgccattgccaggaggagctgtagtcttgggagatgtcgtgccacgcagcttatcctacaattccacatgaaggaagaaacagaatcagattgctaggcattgccaagtgcaagctaccaaacagcagaggaggggctagcaattaacatcataactagtcaatcgtgcgtaccttatgaactgtaacatcttgcacttgcttagccatagttactatagttgttactgcatggtatatatggcttagcaagccagcaattaagacataacagtatgcatgcagaggcagggtttgaaatgctggtagaattaaagggtgtaatctcgaagcataaattttaggttgaaacaactaataattgacgggaaaaccagtttgcttgtgttaaacctagttaacatcatccaagcaatgaagcaaatgagtacagaaaagaagaactttttatagaaaaaaaagtgaaacttttcccccattgggctctaatttggtttgggggcaagcactaggtgaatcacgaaaacaagaaaacaaatcctgagcccaggaagcgagatggccaaattgcgcgaggatggtgactaaacatattgcaggatctgacagaaatagggaaggggaaggaagacataataagttgctcatttagtcagttgcacataccctgatgtaactgaagtgttacatcttgcacttgtgtagccaaagatactactccagctgttaaatactactagcatatataaaagaatgtagatagaaagggaaaataattctatgtatcataacaaactacacgatccaatccatacagtctaacaatatactactcatatggcttagcaagcgaacaattaagagacaacagcatatacatgcagaggcagggtatcaaattccggtagaattcaaggattatcaatctcggagcataaattttaggttcagacaagtaataattcgcggagggggaacccagttctgcttgtgtttcacaaaagttaacatcaggcaggccatgaagcaaatgattacggaaaagaagaaacttggaagaaatcgaaaattttcccccaaattggacgctaatcggggtaggggcgaagcgcgaggtgaatcgaatcgcggaaacaagaagcagatcctgagcccggcgagcgaggtggcgtaattgcgcgaggatggtgactagaacctatcgcgggatctgacagaaataaggaagttgagaaggggaaaggaagagaaacaacctcgaggtggtggagggagcgcgatgacggcggcgcccggcggagagcagccgggacgggcatgaccttcctcacgagagagcgcagcgccatagccgccatgccaccgacgtacggacgaacgagagtagggttgcgacggcggctagggtttgcttcctcctctcactcgccgagacgcgtcgcgtttgcttcttgtctcttcctgtgtctgtgtgtctcctctatcttatttctagccgttgccctgtatagaccaggtctatgaaccctggccccacccgtcacgcactcacgctgcggatatagtagactactactactccagaaaattgtttttcttttctgatgttccaacttcaaaacaaacaaaactcgcaattccactcaacaaatttttaacttcgggcttattcactttgctactatttttaaccttaccaaatttcgatattatcaaatttcggtggtaaggttgttaaaattttagcaagattgccaaattgaacaaaatacacacgaagacaccttaaccctactcattcgcattttattctaaacgatactctaatgatgtagtggaattagagtcaaatgtaatgtttgattttgaaaaaacaggtcaaatatgcaaattagaaaaaaaacagagtcagattaatacgtaggtttcgaaacaagatcaaataagtaactaataatattaaatagaggaagtactcctctaacaagaaaaaataatttttatctacttatatatatctggacatatttttatctaggatttgtttttctttagactggaggcgtagataattataacatggagctagtttgtcaatcctgtacaaacccagcctggccgtttgacttttgccccaatgaatccactatacacaggcacatactagtacagccatgggacggatcagccaagcagcagagatgctttgcccttgct

SEQ ID NO: 42001 - DNA, 1517 bp, Oryza sativa
ctctagatgaactaaggtcacgagtgaaagaagctcttggatggaccgaggataatgtggagattcatttttatgggagatacgatgttggtcaagggcataagtatatattaaatgtgataggtcagttggaatgggaagtttactttgatttggtaaaagagtctcagtttagatctctagaggtgtttgcatcaaagttggtacggaccgtagaaaatttggatctaaacaaatctccttcttatcattacgttgagaagaattttgtgacatattcttctcgccgtggagggggtgcaagtaagactgagttggtacgagaagacttggagggggaaggagataagaagagacctttgcttggaaatgatttaggggaggcaggaccatcaaagagacattgcggtagtgatgatgtggatgcagcgagggagatgaaaagggagttagtacaagaggggcttgatctaagtgaacatttgtcggagagtgtgcattggtcgttgtacggaggcaaccctgaatacccgacggaagtagcaagccaatatgtgaatccagatgattactttgatgtcgaattgagtggtggtcacgattctgtctcagtagaagtcaatagagaggaggttgacgaggaggcaagtgttgagcaatatgatgttgaatttgctgaagactctgatgatgaccgtccattccctccactaactaacaatgacaagttagcattagaggaatgtcgtgcgtttgagaaggtgtttgggaggaagccagacatcctgagtttagggacctaacacatgcccatggtgcaatactagatggcggcatcaacctagatcagttgccagaacattctaggtggatggtctcagaaagggtttagagttcccatccatggtcgcattgaagctatggcttcaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggttggtaaggaacatagttgtgctactgccgaaggttcagggagccaccggcagctgacatctaagttcatagcaaataggttatgcaatgccataaaactgcaacctacactctctgcttctgcgttagctttgtatatatttgaggttttccagtatagggtgaagtatggcaaggcttggagggcacaagaagaggctatgaagctcatttacggtgaatggggtgaagcgtacgtccgtttgcccactttgctgcaagccattaagcagagaaatcccagtatggtctaccacatcgatactcatcctgatagggttgtcaacgttgatggagtgaccaagaaaatttttatgcgtgcattctggtgctttggtccttccgttgaggcttttaagcattgcaggccagtactagctatagatgcaaccttcctaactgg

SEQ ID NO: 42002 - DNA, 728 bp, Oryza sativa
caaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacg

SEQ ID NO: 42003 - DNA, 12129 bp, Oryza sativa
tttcaggtgctacctgcctaagagagtgcgtgtgcgcgtgtgcccgatcgagggatttagggtgcgtttagaaaatttttgaaacatccggtgggtgagctatttttgtgtgcggaccatttaacaggacttgttaagtggcccatatgcgaaaattgattttttttcgtgtggtcattttaaaaagccgcacgcgaaaatggagcacgtttttgcagacgtggccacttacggtccgtctgcaatataaaatgagtcccgtccagaaaaaatcattcctgtagtagtgatctacctctccgtacgtttcctcctccaattgattataaaattgattccctattactccctcatcattttccccttgatttcctcttacaattcggctttacttcacaagatttaatctctatttaacggttgtctttttattcccgtcgcttttccggttttttcatctgctttttccatcactattttttagtcacattttttggcacgcggtaaggattcagttttctttacccaattggtttttttccatcgttgggatttaatcttcagccgtcacccgggccaaaccctagcgccaccgccacattgatctgcctccatgtgtgtttactcttccaattgattacaaaattgatttcccactactccctcatcatttttcccttgatttcctcttgcaattcggttttacttcacccgatttgatctccatttaaaagttatcattcttatcccgagtttagaggattgctatgattttagcatcgtatgggcactttcgagattgaaaactatagttggttgtacgagttaggcctacagctttacttatgggctaagctaaaaagacttaggccaagcggagatagagatagcaaactacgctaggcttaaaaggaaataatgggctttcattccaaaaccaaggaagtaatataatattatatagcgatccaaaaattgttttacctgttacaacgcacgggtattttttctagtaatcaaaatacaaatctattggtgccatactatagcagtaatttaatttgtcagaattttgtgaaagttcgtcaaaatttgagtcaaatttgaaagtggtgtacaaaagtatcgaaaaatatccaagagtatacttatttttttaccccacatttaacaccgttaacaagaattaacggaacggaggcaaatgagtgatctgtttcgaaaaagtagggagaaaaactaaaaccctaaagactaggggcaaaatcaatattagcaagaacgaaattgccgcttttcactcttacgagtgttgataaagaatctgctaaaagaaaatacagatcgtcctaaaagcgacaaaaaaaaaaataaatgaccccaaattaaaacccactcacaccccactcccactctccgcttcggattcggaatttcggagagaagaggctctcgcggtctctccgccttggcctcactcaaaccctagcccgccaagaagccacccgccgccgagccgaccatcacccatggcgcttctccgagcggcagcgcgggcacgcgtgcgccgcttggtcggatctggccccccggccctcgccacctttgccggcgccgacagagcgacgggcgggcggggcggcgcagccggggagcgcgctctccaggcgatgaggctatgctgcgctaccccctccgtcgccagcgtcggccgcgacgtcaaagcgccggtctctccgcccgccggcgcctccgtgacgctggtggtcgagcaggcgacgaggttcgccacggccacgacggcgcttccgcttccgcttgccaagattccagccgccggcagaggcggaggcccaagatccgccgggatcctcgttgccacggtcgccgtgggctcgaaaggggcacactttgcgaccgccagcgctccagagcgtgctctgctcacgctagagcgcgcccagcaggccacgtcgccatgcccgcctctcgcggcaccgaggatcctttgccgcgggctctccctctccaccgtcgcgggcgacaagaaagcgcggcgcttttcgagcaccagcagcgccggtgacgaccagtccaagtcgctggagaagaaggagccactgagccgtcgcgctcgcgccgacgacccggcgccggcggtggaggagccactcgagccgctgaaggagatggagcactcggtcctccgtgctctcaaggccatacaaaaggtcatcttgaggtcgttcagcgaacaggagtaagtaattgggcgtacgttcttttgggttaattgtttgagaggaaacaaattctcctttcttcttttttttccctctttctttttgggttgttatgtttgggggtattaatcaagtgatgataatgattcatgcatacagggctttcatggaggatctgatgaagagggcatccacacaaatacttcgagccggcggcttctacaacgccaataccacagttggcttcatcattgccgtcttgctgtgttttgccatcatcctgggggttttactcttcatgagtgtgctgtttgcagagtggagagccaagcaattcctgcacagtgaagagtgtgacaggctgacggatgggatgatggataaagctgagatgaagacccaggagtttctcaggaacaacaattttcatcagattgtcgagggctacgtgagcgaggggttggaattggcgactggggaggaggtgcgcgcgatccggaagcgcttcttgaaggaagctcttcaagataccggggagtacatcgtccacaagaccacatttggttctcagagggacaagattgccagctggtttcgccgcgacaagcagcaagaggcgccatcaccatcagcaacagcactgaccaaggacagcgagtccactgtgggcgtggtggagaaggtgaggatgagggatcgagtggctgcctggttccgccgcaacaaggagacgaagccagccgagccagcgccgagccagcagcagaagatcgccggcaccgaggggagcggcacgccgccgccgccgcagtgaccgaggtgatcattgctctacgtgatctccagtggtgaagaagaagaagaaaaagaagaagcgctgccgcaagatcgatcttctgtcatgtgatgaaattttgttttcgttcataagagagaaaaactctattagaaccgatgcaccttttgatctttgccatggctgtttgtgccgcaagatcgatcttctgtcatgtgatgaaattttattttcgttcaactgatgcaccttttgatctttgtcatggctgtttgtgacctgcagtgaacatcaaaatgctattggtggagatctaatgatttgactacaaaacaaattcgtggccaaaatattatttgaagaagtgaaagaaagaagtagcaaccgacaacacagcagatgtgacaagttgtcaaattgtgaaatgaattgttagattactatcataatataatgactatacatagtactgaatatccgatttgattttcttgctagagacaccaaatagtttggtagaaatgaatttagccaaaaaattggtaaaagatgaatattcagtttttactaaagcaaaatgcaagatgaaactgaatgcttatagtacatgtcagctgcatgcaatttcctgggcggttgttcatctaatcatcttagactctttcaagcaaattaaccgctctcacttttgactaaaccccgaaaatagataatagcagaaaggaaagaaaaggcataaaaattaatgtgtctacattaagcatttgtaacaaccacattctgaagtttggtgccactaaatgaacaaacctgaaggctgaagcttagactcatcacaagtctacaagcttgataaacatatcaaccattcaaacaacttcaattagaaacaacagggggaaatgaaggaatagggaggaattggatttttatcacctcgagcaccagcttcttactggacatttcgtcaaacatgtggcttgccctacattcccatcttccttggcccttgcatcaagagttggcaagaaaaattcaaaaaaaaaacaaaacaaaatagagagctgcatacggtgcggcaacggtgttggctagcagctgagtagaggcgggaggtgctggtgttggatgcagcagtggcggcgacaaggtcatggacgccgcgacggcctgggcggagcagagtcatggacggagcctgacttgcgctgcgatgcgcggaggtcgaggacggagacgcattgtgggcgtggacgacgatagggacagcatactccctccttcctaacggcctgtttggttggagggagtttttacaagggattgacggcttgtttggttggagggagtttttacaagcgattgggagttcagatggatgaggatattaagtgatttatttggttgggagacatgggaattttggtgggatggggatgaggaattgaggaagaaacttcctccttttcaatacctgggtaggggcaggtaattgggagggaattcctcctttactttgtctaagcaaatctcagccatccgtttctattaatgatctaatctccaactaaactccctatcaattttcatcacctctaccaaacaagatattgggattaaaaatcaaattcccagcttaatctcgtcatcaattccctcgtgtaaactctcaatcctcttccctcgagttaccaaacaagccgtaaatgtttgacgctattgatttttttaaacatgtttgaccgttcgtcttattcaaaaacttttatgaaatgtgtaaaactatatgtatacataaaagtatatttaacaataaatcaaatgataggaaattacttaatttttttttgaataagactaacggtcaaacatttttaaaaaagtcaatgatatcaaacattttgggatggagggagtagatggatgctagtatcgacggctccttcggtgacggggtatcggcggcgagctataatcaacggcgcagtggaaatagggggaaaccgggaggggaattggtgtaggtagaggtggaggcggagacgtggacgacggggtatcggcggcagcggttgtttgatttggaggtcgacggaaggcacggtggccgagctcctgcggacggcggcttctgtccgcctcgtcgcgtgaggaaggagctagactgaggggttggtgaggtaggggagaaatttgcactggcttagaatgccatcgttaaaatgggattagctcgaatgccatcctcaagctgtgagcattcactaccatgccattttcgctatttcttatacacttataaatcattttccatcaattttattttttctcggacctttttacccctggttgcatcttctttcttctcctctcatcctatcttctttcttctctctccttcacttgcaaggaaccgagagaggaggcgacgacggcaccggcacgagtgagggaagcgggcccaacggcacaagcgcgcggaaggagggagccagcgcggaaggaggaggcggaggcggtgacaggtgtgcagaaagagggaggcggcggcgccggccgctggtgccgccaaggggaaaggagccgctgccggcgcacggagcaaggaaggcggcagtcccggcagtggagctcgagcggcgacgaggagtggcggcggatccggtgggagatgggcatgcgagctgccggcgtcctctcaccttcctgccggcgccgccttgccctctctttgcccaggcacaaccttggctctcgccgccgtcacctcgccttctccctccgagaagagagaagatgtagccaggggcaaaaaggtccgaggaaaaattaaatggatggaaaatgatttacatgtgcaagatatagcgaaaatggcattgtagtgaatgcccacagcttgaggatggcattcgagagaatcccattttgaggatggcattctagcgaagccagtttttaaggatggcacatatgtaaatagggagaggatggtgacggttgagggaattcggcggccgccagcgtgatttagggtacaagtggcggcggtggcggcggaggaggaccgaggagagcgaggcgacaactgctgagggggaggcggtaagggagaggattggagtgtcggcgctcggtgtggaggagacgacgcgtgcgcgaaagagagattggagcgtgatccgtaggagtgcaggaggagggcgatctagcctggaggttggtggcgtggtaatgtggcggagttgggggtggcgcggaggagaccaatgaggcggcggttagagtgcggtgtcggaggtggcagagggggaacatgagggcatgagggggagagaaaccagggaatagggcccgtgcgaatgacggggatggatgcgggggcgtgcgacgcgatctgaggcattggattcggcgatcgaacgattcacattccatgggtctgtctgggtgagcattcaaagaccaccactacgtcttttttaagtagtagagatttcttatacgactcctaattttccaaaagcgaaaaaacttaaaaactgactcaagtgcggatatgtatttctaaaagcgaatgaacttaaaaaccaacttatacacgaatgacatacaaaagtatcgacaaaaacatctatagtttttataaagaaaaagtacgaattaccccctgaaccattgggtgagtatgaattacccccctaaacatgaaaaccggacgtttttaccctcaactatcgataccggatgaacccccccgagcagttttgaaagcggttttggtctacgtggcagtccaattagcaatccattatttttaaaatcagcgggccccacatgtcagtctcccgcactctctttttccctcacctctctctctccaaaatccgggccatggagcttgggacggcagcgggaagagcccgagatgacggtgggtggaggggacaggggcgggtggagctcggggtggtggagggggcgctcgtaaccgctggcgctcgggacgatggtgagtggaatcagcggtggaggggacagtggcgggcggagctcagggtcgtggagcaggtgctcgcaaccgccggcgctcggcaaatcggcgggggaagcttggggccgagggggcgtcggacctcaggacggtaggaggagaggacggcggagagcggagagggggtggtggagggggcgtttgcagccgcccgcgctcgggacgatggcggggggagcttggggtcgagggggcggcgggagctcggggtggcgagaggaggggatggcggagggcggcgaagggacgcccacagccgccggcgtgtggctcgtcgaggcaacggaggggatgctcgtagccagcggtgctcagggaggtggaggggcgcggcggagcgagccgaggatggcggtgggtggagctccagctgcggaggaagcgcccgcaaccaccgccgtgtggctcatcgaggcaatggagccgtccgttgccgtcggcgctcaagccgcaaccgccaggatttgagagagagaaggtgggggagagggaaagagatagagtggtaagatatatgacaggtaggccccttcgtttttttaattaaaaaaattgctgactagactgccacgtagaccaaaactacttcgaaagctgctcggggggttttcatccggtatcgatagttgagggtgaaaaacgtccgatttttgtgtttagggggtaattcatactcatccaatagttaggggggtaatttatactttttcttttttataataatagagatagagatagagatagagatttcgttatagtttagtatttttcagcactattatcaacagaacaacaagagataacacagggaggcgtattttttgtgcgtaaaggtggactcgaaactctccaaaatatcgcgccgtttcgatgggagggaggaggatgcggctcccttcattctccttctcgcggaagactcctcttttttttcgaagcttctcgccgaagatttcaaataccgctacttgtccaacccgagacccctaattccccgccgcgaaatccctaaaccctagccgccgccgccgcccccgccccggcatcggcgacgactccgacctccagaaggacctggacgagccgcgccgctcctgcatcctctccgggaacgaccccgacgccgcggtcgcgcaggtctccgccagcctcgccgccggcacatcaggggcggggggcggcgaagaatggctttgtccgatgatgacgaggaggaggaggacgatggctttggcgctcgtccgtagcatccgtgagaatctcctcaacaaggcctcttgccctcctcacccgatctgcgtctggccgccctccgacttggaggaggacgacgacaacgacctcgagacgctccgtgcgatacagcacccacttctcgcactaccattccggtgagtaaattctatctcaccctgtttgttcgtggcattgctgtaagataagcaatccgaatttatgggatagacttgcaaggtagtcgactcttgatcaaaacatgaactatccaatgcaaatcttctatacaatatgctattgcaccaggacacacttttctttttgaatgaaattctctagggtctatactgtttctgaattgttgaagctgtagtgagaaattttaaaaaggctgatgcaaatttaatttgaacattgaagctatggaatgcgctttactacatatggtggtaatcatcggaccttataattctatacgtgtgaatgaaacatgtttaaactactgtaattgttctttagaactgaaccaccaatataggtgaataaatgtgatgtgacaaaaccccagattctagggcatgcgtaacacaaaacaccagatattgtgatttgtttcaaggaacctcatgttttgaggcaaaatgtttcaaagaaccttaggttcagctttatattgtcgatttgactaatatatttgtgcctacttatacgcatacttataaaaggtagaatatgatatttttaaaatggaaaaagtatgaattaccacccgaactatcgcagtcgaccgaattaccccctgaatccaaaaaccagacattgctcaccctaaactttcaataccgaccgaattacccccctcgacccaattcagaatggtcttgtcctacgtggcgtacgcgtggcaatccaatcagcattttcttattaaaaaaactggtggggtccacatgttgtactctctcatctccctctttctcctcttccccacttcctatctctctctgtagcgctagccgtcgggagcggcgacaagtggccagcgacggccgtggaggggtcagcgagggcgcgcagcgcggcccacgatggaaactatggcgagcggcaacaacggcggcgactacggcgagcggcggcaatggtggtgagggcactcggtgaggcggcaactgcggcgaggtcctcctgcgcctctcccctgtcggcgctcgagcgacctctgccttcttcgccgggggaggccgaggatgcggcgcaccctagcggttgccgaggacgagctcggctcagcggggttggttgtttcgcgaggagatgcaggggcggccctcgtcggcgtcgtcgtccgctgctgttgctggataggcgtccctgcaagctcgctccactccctcccactccgtcgctccccgtgtcccctcccctcgccgccacccccactccaccgccctcgggatgatgagaagccgccagaagccagggtggcctctgccaaagcagggctcgatgttgatgccgccgctgcgcctgaggccctatatggcgcgggaccgtgtgttagtgaagagaaggaggtgatggcgatcggtttggacacgaaggaagcggagagtggaggagtggaggcgacggctcgccgcccgtccgcatctccgccgcgccgtgcgtgccgccatgagcgctgcaatccgcgccgaccgcccccgcctaccgcctgtccctgcgccgctggggctcaccatcgacgcgccgagggggttgctgctcgtcgtgtccgccgtggacgtggccgcccacaactccagctccctcccggagttcgctgccaccgcctctgcgtcctgcgccgctgcctctgcgtcccgccgtgctacccaccgcgcgccgaacgcctaccgccgctcgacctgggcgtgagagagaggaagagtgagagagggagagagagagagagagtgagagacaaaagagaaagaggaagtgtgagagataggaagaggagtatgacaggtgggacccactttttttataaataaaatgctgactggattgccacgcgtacgccacgtaggacagaaccgctctagattggggtcgaggatggtaatatgtctggtattaaaagctcagggtgagcaatgtctggttttgtggttcggggtgggggggcggggcgtaattcgtactttttccttttaacattacctgcattttcaacatgtgttagttatagatagtataacctcttttgtgtaaatgtaatcggttaatatgttattattagtgaagatcatgttgagcttttgctatgatgcagtacaatagaaaagaagaagataaattagactggtggtttgttcatcttgagcctacttatctgaatatgtatttaaaacataccatatataataacggaatgagtattttacataaatctagtgttccttgaaacattttgcctcaaagcatgggttgccttgaaaccaatcgtacttcctaagatgttgcgttacccatgccgcaaaatatgggggtttgtgaaattacatgtggagattagccataagatgttttctgtgtttgttctttttaagctgcacatatcaatagttcagtacataattgaaaataaagcatgtagagtcgttgtgtacttgatccagcaaaagagtgtcacattacaattaaatgagagcccttagtatgttgatttgcttaatgcaggtacctccagtgggtcagagacaaatacaaaaactgaggaaatctttttcgaaatagacttgatgaagaatttgatgtggataagcaaaataaagaggcaattaccccaattgggtttcctaaagctgcctgctgttagtggatgctcttaagaagaacagagcatgccagaagttcattagaaggtagattacaattcaagcgaaattgaagaaaataagaatcttaatcttaaggatcatgtaaaatgccttttggattatcagttaagccgcagaaaagaatttggcaaaattttgtgccaaaatgaggatcattatgttagattgttttcctctcaaaagccatgtgcacaatcagcgaaggtaattatcattttgtgtctacatctatttattggatgtttactaatgacatgttatacctgtggatacatatctgacatggaccttctattgcctgaaagtcaccaagtttcgagattgacatagcagaatcgattctcctacattcatttgtagttaattcacggagatagttgtagtttcctgtatgaacaaaagttaattagttttgcatcacatgaactaaattagatttgacgtgtaacagctaggatcatttggtgtttccctataaagttcattgttgtcaacttgtcaacttatagattttgtacagtgcatttatacaaattttgttccactaaggacacaattctaaggatctatgttgcccaccggaaaacattaaggggcgcaccctggggcgatggagggaggtgccacgtcggcgatttgctacagtcctacagtgctcggggtggtcgttttgcaaaaataaccctccggtttgctggtaattcgaagtaagtccctaataaacagtaattcctccgtttcacaatgtaagactttctagcattgcccacattcatttagatgttaatgaatctagacatatgtatgtgtttagattcattaacatctatatgtatgttggcaatgctagaaagtcttacattatgaaacggagggagtaccactgaagtgatattttatgtggaggccctt

SEQ ID NO: 42004 - DNA, 7919 bp, Oryza sativa
gtctgaaactcctgtgtgtccaatcaggataagcgtgttgttgccttgttggctgtgtgcatgattgtgtgtttgtagtggcgaattcatgtaaaatatgttcgcactcacttttacattttaatggataaataatagtcttgtatccaagtaatccaatacaatgagatgtggggtgctgttggacttcatatttatgtgctggaggcattggtgcaggtggattttgtatatctgttggcatggctgctcattgacattgtatgcaccctgttttaaacagctatagtaggcagctaggccacatacaaggaacagtcccttgttgttgtaaaattggctggtttggtcatataatcagttttagatggggtgattgaacaataataattgttcattgttcttaaaaatgagtgatgaatatgcatgccccaagagtgatagattcatacacaatttcacatgctttagagttacatcaaagcaatgccatttagacttggtgcagaagggcacaagctcacagcacaattatgacagttttgaatatttgcttatggaaggtcaaatgtcaattgaatagcttgaatatcatatagagttgatcatgccctctgcatatttgcatgtagttgttgcttttagttgcatgttacaccagccatttacctgttatattgtaagatactgtcgctaatgaattgatatttcaaaagatttgttttagacactctatttattttactgattcaggacagtctaggtgagataactcaacctgcacacatatataataatcccaatcatcaacaagcaactctgttgaggcatggaccttcccaatacggtatagaatacatggccctctagctagcttgtgtaatgatgtagcaccatgcatgacctgatcatatctgcaggatgcaactaggaacaattttcatcagtatgctcaagatccaaatgaccgaaatactggacagatgtaccatggatccaattatcatcagtatgccaaagttttgtttaagagatacttgtacgaattacagttattagctgtccaattaatctgtcatctgattgaaaagatccttcatctgatgtttaactacccttcctttcagggaaatagtagctgctacccctctaattattttgaagaaaataatggtcctagagaagtaagattacacgactcacagttctataggcaggataatcaagagtattcaactgatggtaaataaagagcaaatcaagcaactagaaaatattccacatcatattgattgaattttttgtatttattatctagatgatcctttgcctggtattgaggggtttcaaattgttggggagcctagatcatgatttacattaacagcatgtggttaccctaccaatggtactaccctttgtaatttccaggtttgttgtgttctgagttctgattccagattgcaattacttatcttctctattaattgttaacttctgcaaataaaacctctcattatgaaatgctgttgttttaatgggttagatatcttgagaatggcaccaggcagtcaattgaaagtaaatagagattattgctcattctatttgttgctgcttagaaataatttgattgtattgattagctctctatattttgcaattcaggtgctacgatgtatgactacgtggttactgctgatgatgttgacactcttttggctgtagactgcacgcctatggatgataatacctgtcaggttattcacttatctgctgtaaactgcagtacaatgtggttatttcatgtggtcaatcatataatagtggctaagtctaaagagtttggcaacattcattttgaaacttatctctttgctaattggagggagtgtaaacttttagacgtaaagctgggatcccagggaaggaaatccatcaactgacttgggagccatctctccttcagagggggttagaacttttttctgtgtctagctgttcaaattttggtcctgtgtcctgtacatggtattgcgtattaaccccattaactgctttagtctgaatgtgttcttttactgggagtgtgccatcctcaattttttgtgaggctttcagtggcttctcattattggtattctctagaggcttacatccattttgtctcttcaactacatgttaactatatggtttgaattattattttgggtattggaatcttcttggcattctgatagcctgatattgttctgttgcatcttttcatcctttactgcatcaattgggtagcttacagagtacaacccatttttggaagctatttctttattgcatcaaccagaaaaaaaagattaactgagtcataaataactgtccctttgtgtgtttgttggtattcgtttttatatatatctgatatatgtaataagcgtacataaaggttggcacatcggctttcctttttgagcaaagatgtgcttgtgcactgataacatgagtgtgcttgaaatctgttgttaattcatgggcctgaacttctaaacagaattatccacaccacagacacatgaatattttactatgtcagtaattacacctaggaactatgcatgttaatttgatgagccgctcttcttcattgtagggtgaattggttacagagtatactaacaatgggagcaagataacttgcggtgagtttatgatgcatgcgttgctggcttgctgccatttttgggccattaattgaatgaatttattatattggcagtccctgcttcaattttgtttatcaacatatgggaattgttatactttcagtggcacatttttttaaatttattaaacaatggttgtattttaatacaaagtagacaaaggcatcctgttggcaaaagggcaattgcaccttcacaagttgaatctttatgattttgtaggtttcactgattaacctttgacattatttaattgaaatttgaccatagtggaaatataattttttggggcatatttaccttctttgcggtaactttcttgatgtaaggcttgtcatgttgtagcaaaaagaacattttaatatataaaacatctggatttcttttttgcattgctcattttactttcaggactttatttgaaaaaacataaatgcttgtattattgtttcaagcacagtttgtggaaaaatacatgtttgcttacagcagtaaccttattgacactggactggagaacatgttaacctttgaaatctgaacctgggatgtgtgtgtgtggtggtggtggtcaggccaagaagaagatggtgaggctgatacagaggatcatctgggacaagagggcaaggagggccaccacgggacgccatcgacgttctcttcagagacaccagcgatgagctcaccgacgagctcatctccgacaccatgatcgacctcatgatacccgccggggactccgtcccggttctcatcacgctcaccgtcaagttcctcagcgagtgccttctcgcccttcaccaactggaagtaagcctgtaacctgaaacctcttacatgaaaatttttcagcttgatgacaacacaataagctgttactaactggatcaatagctgcataattagatgaatcctgaacagaaaaaaaaaacaaatcctaggaagcaattaaggatcctctgttgttgggcatgggcaggcagcaaaatgggtccagaactgaaaagaggttgattttctttctttttttgtctgacaggaacatgaccaactattcattctgtcagagccatgtgttgtgcatgataatactactaccactgtctactacacacaatggcagaggatctgtgtccccaaacaaaaactatatcataaaaaagcatacgaataagggagagatacgtaggtgggcagaagggatcagcagcacataaagggttgtgccaaccttggtccatacctttcttgttggcatcttagagctatcattattgtttgttatctatgtgccatctgaaaaaagatactactacttgtgtttggaccaatctttgcaagatgacatgcgttgcatcattgtcaatgtcaggtccatacatatcattggaacagagtcgccttctcacaaaagaaaaggcttactatcatgatgtatcatctacttagttttttttctacacgtgtgtaaggaatagttattttggttgaagtatagagggttttttatcaactggggaaaaagcaaggttacataatttgtctatttattcggtggagattagaaggcagcagtaatatttcctagctagcatgtcctgttacaccagtagcattgtgtcatatactagattccatttacatcactacagtgctaagaaattactcatgcgtcgaccgtgtttctgttttgatgccatgtgaacaacaaactcattgaaacctctgcatgtctgccacttttagagaacatgcatgcatattgcggctcaagataaaatccactcagtaattacttgttgtaacaatgatgaataataacaccaatcatattcttatgctaacaggaggagaacatgcagctcaaagaggcgaaaaaccagcatgggtgagaccttgcaatggacagacatgtcattgtcattcacacatgtaagtatagttcattaacactataacataaaatttctatagctctaaatctactggcaaaaatagcacttatccttatgatccatgtgattctttttcatgaccccgtttgatttggaacattggagtgtaggtgataacagagacgctgtggttgggcaacatcatcggtgggatcatgcacaaggcggtgcgcggcgtcgaggtgaatgggtacctcattcccaaggggtggtgtgatcggtccacctcgatgatatgctctacgatgagccctacaagttcaacccatgaaggtcgaaggtaagaaagagccccacatttggtagagatgttcgtcgaattgctagccctttaggcaactccagcatgataaggatttgatgagtggggtttcggtgggactcctaacatgtgggtttacttctatatcaataatctcatgatggatttgacattgccatgtactaacacttgtattgcagaaaataacagagattccctcaaagttgcattagtgatatatacacctaggcagaagtcagttgaatcccccaaaataaatggatttggtagttctttgatctggtaaattcagacaacataagcttaagctgtcaacgaaatgaatacacacctttttttccgttattgtatactttctgtaagctctgacaatgatatgcaaataattaatctaggcaaatgatggtgctgtactactgttgaggcatcctatcattattatttgatttgggaagtctaataatgtgctaattggtcaagaaatcaatcaatctcaacaggagaaggacatgagcaatggcagcttcactccatttggtggtgggcagaggctgtgcccaggcctggatctggccaggctggaagcttccatcttttttcaccacttggtcaccagcttcaggtatggatcaccacacctcaatcttggctattcttagcgcatccattgattccaactccttagctttgtttcgtgatcacttggcaacaatagcatttttttctctctctagataatggaataaaaactacaggctttacatcatttttcatgatcgctcagcaccgtcagcaattatttttctagataatggaataaaaatcacggcctctgcatcacataatgcacgcaatcgggcaccaatggcgtgcatctcatgtccctatcatttggcctaagatagcgctgtttgtgagtcacatccccatgatttcgccatgccctctttgcatgatttcagtttttactaatggtactattttacagggttataaaagaacaagttgggctaataacatgttatttaaacaattttgaaggatgtgtgaccttttcagtgaggctttgacatgctgccttttctgctgaaaaaacaagaaaaaaagattttgtagttaatagttcattagttagtatgttggtgctctcttcctgaataacatgagttgttttggagataatatcaagattgtattttcctgttatttgaatcacaatagagttgctgctgataaatattataaggttatcacattatttatcattccatttttcttaatatttttccaatgccaattaaattggatggagtgtgtactgaatggactgtgtatatatagctcattatacttcatactctttggcgcatataatatggcagctataccatttgatcaagctattgaataccctgtggatcagtcgttgccacttgacaccaattgttgtttttttttgtttgctatctgctgtttgttataggttagaacaaggtagcaaggactgaggctaatggtaagaggaggcagaagaggaaatgagctaggactgcggattccaaaaatgtaaagtttcttgaccttgttctgccttgttatctgtttattcattgcaaactctcgtggttgcagcggatgtatttatttaggacagatagtaactggcttttatatttccatgcatgtttcatctcatgggggttcatgttaatttaggatcatagtaataattagaatacacatgcattccaaaatcagtttaattgatttgacaacagaattctttttagagctttaatgaggaatgtaatgaatgtcccagcccttagtcatagaagagatgagttattttctgtttcccattttctaaggcctttgaatataatgatggatgcaaacctacaggcaagacattttagtttgtgacaaaagggaagtagagtttagttgggcactaggccaccaagatttgcggtataattggccatatggacatgtcacctaaattatagcagtttatttggatttattttattttatttattattattattatttgcatttggtgtatgtacatttttggagttacaaacaaatatggaattttggtacaagaatcctattactcttattcccaatagtatttctattgttggatcgcatgtgcacctgctgaacaccagactattccatgttccagtgattctgtggagtgaccaagttgcagctagagaacaagctccatacctcctcttccattgggtgcctcctcccccttgtctccctcctgtttgctgcctctatggcaatgcctaacggagtagtggctggtggacgagagaaaatggagttgggggcaagtgaggactgtgatggtatgaactattcctcatcatttttcaggtattgcctacttctctccaattgttaacttacatgtcattctttacatttagagtgtttcttatacatttatattaccttttccccttgggcaaatctttagcagcagaaaagggatcttttctttatattgtcgtttcatggtgaaataagacaactacttctaatttgcctaattcagccattgcttggttaaacaaaaaggcattaatgtgggagcatggcaaacagttataaagagaatatagatctttagaatctaaaataccatccattgttaatatttgaattgcttccttgcactgaaagtatgcatcgcatcaaggttagtagtctggctaatattgctcaattgataattcttgataattaatcgtgacgaccttatagaatcttgacttttgtttcagaatatggataaaacatcatgctgcaactttacctgctatttggaaacatagagactttggatatttcttcttattttaacaagaaagacatcaacttttttcccctgaattttttcatccagatctactcaaacctcaacattt

SEQ ID NO: 42005 - DNA, 1978 bp, Oryza sativa
ttttttttctttaaacattgtgaacaacgagatgctttatgggtctttctaccaagataaactgggaagagatgtttagagttcacttgtttgggaagcacataaacttagccctcatatgttctcttttgtgaatgactagaatgttgaagatgtacatgactagaaatctacagcagataaacacatttgagcaatgtacacaatttcaatattgaagaaagggatgctccacttgatgacttcttttttatgaaacgctagttggtgatattgccttacaacttgttgcagggttataccatccatctactgggaggtattatcagcaatttgtagacaagctctccattctggatcgcattatttggttaattggatctcgccgcagagaacgcaatgtaatacatctttgttgacatcattttttattgttgaaaaattccaatttaacttgaaaatacactggcaattgtatggtgtgacagattaaagaattagaggtgtgcggtatgccatgctactatcttttttgttgacattatttttgttattgaaaattttcaatttaacttaaaatgcactgtccattgtgctttgcaacaagtaagaaactggagacagcgttggcgtgccctggcaagcaaaattactgtttatgtttctattcttaaacactctaggtattatactgacttctacagtaattgttaattaacaataatttttgctaagcacaaacagagctcaattaaataactccccgtctggattcttgctggtttgcacaggcggtgcgctattggcgcgccgcgtcctctagtttatgtgaaatatcattttatgccatgcttaacatgcagagtagagataagaagacgcgtgcatcatttgtttcttttaagtggcattgttatttctttattttctgcaatgtgtgctatacctatgtggataatttatgattcttaaagagttcggctttccttgtctaggtggctaaagtgtgtcgatccattcattaatcataatatgtggactgctcgggaggagaagacgacttttaccaaccgtccaacaacaaggaatgtttaactggattaacattgcagttgcattgggtactcacaggacacctttccagtgcctcgctcgttatcagcaaagttttaatcattgtatattgagtaaggactgcgctaaagaagaagatcttcaacttaaagctgctgtcaacacctttggtatcaactggtaacttgtatcagctagtatggatggttgcactggcaatcagtgctctaataggtgaaaagtatttttgtgcctttacccttctcttgccgttgacttaattcatgtatcgttttgttctctgttattggttactttctgtggtcatgtcttacattttttttaaaatttttaatgtgctctctcatgcatgggttatagcaatcatgaatatggagtttttttttgcatccgctggaaacctaatggtggtggttgtgttgaatttgccatcccaccactaactcttgatttggtcaccatattttctgaatgaagttacatcatttgtgcaggtaggttgtaataaaactatttttatatgcaggtttagaacttattatatgtttatttgtaatccattacaatgcactgatttttagctagtattcacatgtctttacattgaaactctataggtggaggaaaactttaaaccctgatagctcaagagtgggtagatggtctctcgatgatgataaacgcctcatggttaagttgtttgggtctggaagctgaataaaattgctcagttcattcctggtcacgcacggagtcaatgcaatgaaggtaacttggtagttttaacatttctctccacagtttgggttggatggtaatgatagttatttggggacattaaacaagtatctgaatgttcttgatctgatatagatctttggga

SEQ ID NO: 42006 - DNA, 6378 bp, Oryza sativa
gtcaagataaattgccttcagttaaggcggctcaacaaataaagaaagccatttttcaatccaactttttgatagagaaacagagcgacctgctgaaccctaaaggcctaaatcctatatccagttacttaatgtcacttattcactccgaagttgatggaagtgatgagaacgctgtgaggcacagcttttatttagtttcatttttcaaatctatctaatagttgagtgtgtagcacaaaaaaaacgataatttatgttctgtttttcatcaatctcaatttatcagtgctcaagtcaggaagccccgaaaacattctagaatatactttttttttgacgagatagaatatactttctgaagatgccgaggcttctctaaacacaactacagcaaattcaaggataaaatcatctaggtatgattcataacattaaaactttacaaagtttggctctaatgaatgtgcatgttatgtttccaaatctcactagtttcttttgttgttttacagaacttgttttacagaagtagatctagcttcatcttatgacatcaacaacttttctgattgttctagtggagccaggaagagaaagcaatctgttcgttgtgcaaaagaaaaatgagggggcggggggtcaaaaacgatattgggaggggagagacgtccctccaaacattttgttaagaagaaattgtgagtgtgttggggattgaacacaggacctcggggttgaaaccacacacctcttgccactacattatgaagtgcatctttaaatatggggggtgtctaccactggtaataataaggccatcgtggagacaatgggttgttctatcagtgtctataatgaggtagccatgaaacagaagactggctctccctctgttggtgtagaaggcacggccaagaagagaatgaggggctctctctctctggtaatgagggagaagtcaacaagagaatgagggggaaggcacggccaagagaatgaggggctctctctctctggtaatgagggagaagtcaacaagagaatgaggggatctatctctggtgttcagaagggagcaaccaaacaacgaatgaggggttcagtcgctactgataactgcattgtacaagcaatacagagcaccatcaagcaatagcccttcgacttgggggatgaggatgtaaacctcgtgacgctccgcgtgatacagcgcgacgaggatgcaaacctcatgacgctccgcgtgatacagcgcctcttctcgcactaacactccagtgagttaatttctgtccatttgtttgtggcatgctcttgctcgaagataggtaccatgtggtgtactaatcaaattatatcttaggccgtgaatattggtatgatatgacctggcaatctgaattactggaataaacttccaaggcagttgatttttgatcaaaacataaattaccctattcaactcgtcttctatataatatgctaaggcatcgggatattgttctcatgacatctctagggtttactcttctgaattgtgtaggactagtgtagtaagaaattttaaaaagaccaacaacatggagtaaactatatttttggaatatgcataacatttgcgtaccttttgtatttagctaggatagtttatacatcatttcaacttctgtaaaagtgtgaaaagaaaggaacaaacgaggatcatagggctatctctcgcaacaaatttagcgacctcttgaccagtgcgcagctacactatgttggtgttctgattgagctccagagcacagcttcttccgcagcatcatgagctacttcacctaagcttattgacagattgttgaacaccctatttttcctccttccagatgtcccaagctgctaggatgaccaccgtgtcgaagccttctttgtccgccttgttgatggatttcctgctgtcgcaccaccaccagagaaagggctgcgggttggaagggaagcactatggctgcttgttgacgctgaggatgagccaccagatttggcatgattctgcgcaaccgactaggatgtggttgatcgtctcgtcttgctgatcacagaggacacatttcgctgggtttggctgaccctgttttcttaatctgtccgccatgcagcatctcctgtgagcaactagccataagaagtacctgcatttgggtggcacatggttcttccagatcagtgcatgtgggaaattgtacctcccaaggaacaggtgtggcataaactgattcaggtgagtactgccccgagtgctcccacttccagctgaaggtgttgtcccgttcttgctcaagaatgttgtcctgttcttgctcaagaacgattgagttcactcgagcccaaaggttgagatacttgagatacatcaggggagctctaggcgccccaattggcaattatgtagcgcctctgcgtcagttctctttcgtgtgcacttcggcacagggcacatgctcccacatggcaggagccagctcctggatgtttgcaccatgcagccatttatcctcccagaacagcatcgtctttccatcacccaaatggcagattgttgaagccacgacaaggttgcagacctgcttggagacagccagacaggtatgtccaggccattccatgggcggtgcggatatgctcgattatatcatatgctacggaatgtgcttccctacatatgctgttatcatgagaccttagttctaacacgtgaataaaacctgtacaaagtacaaactactatacttgttcgaatacaatatttgtcgcattcctgatccagcaaaagagtgttgaattattatactcaattgagcccttagtattttgatttgcttaatacaggtacctctggttatcactttatacttaaacaagccttcaacctgaaagccaccaaagtacgagattgacatagcagaagtgattctcctacttcacgaaggtatttgtatactcctatatgaacaagttagtgagcttggaattagagcaacatgtgataacaaggctcgttttggtgtttgctggtggtgcaggtactattttgtcctataaatctgtaacatagttagaatttaccctataattgaaatgtttgatatgttcactgttgtcatggaaatgtttttagatattgttataggttccccattcatgtgaaatagcattttatggcatgcctacatggaagtaatgtagagaagaatttattaataaaaatggagcaaagttatatgttttggccccacaaaaagggtcttgtaaattcgacgagctgaaagagagcatatctttgttcaagccactttaatgacaatatatgcccttcatctgttttaatctcccttgatcatcagtttcacttagttctatatgaatcgaaacttgtatcagtatacttgttatggtggatctctggtctttaggaagtacactttccagtttacatagtgagttgtattagaaacttgtggaatttcaattttaagatcgacagtcctcttagttaatagttatgttaactaattgctttagatattttccctgtcaagaagcatatgtacttacaaagaagcaacctttggtgcagaataaaaataagaagtccctgcattatttcttggccttgccaataaccctcatgtttcaaagtacaaaaatgtactgaagcaattacccttgtattccccatgttacttcagaagcaacagtggtcagatgatgagaaagacaaactagcctaaaggaataaagcaacaataccaagaagcaatgattctggactcgatgaggaaggtgatgttgagttgcttaattgtttgcactgttggggtatttctcattagttttggttgatattttattttgataattagtttcttaattagtgttccttatcctttattagttgctagtaaatatttttgttgatgatattgacaactttatatgctttaaggatgtgaaaatataaccaaagattgtaatgcttctgtgtcccaatgacgtggcctgtaaaatcaatgtttggtgtttgctctgatgggcatctggctaaattatccatccactacctgaaactgtatctttcgtgacggccaaaaaccatcagggatattgggacagccgacagggaaatagtccttgacagggacctgactgggaatacccgacaggccagtagaataatacggagtatcatttacaaatttgcacatttttgcttctgtctatatgtgctatcggagtatttcacatgtctttaggtagttctaacgtacagaattttagctagtatttcacatgtcatcaaacttggtaggtggagagaaaccttgaatcctgaaagttcaaaagtggggagttggtctctcgatgaggacaaacgcctcatggtacctgtgaagttgtttgggtctggcagctggaataagattttgctcagttcattcctggtcgcacagagtcaatgcaatgaaaggtaaattagtaattttaatattttactacacagtttagggttggatgataatggtagttgtttgttatcgttaaacaggtggcctagtgttcgtgatccagatatagatcttggggaatccagatatagatcttgaggaatttaacgttgttcaagtgagaaagccccaaaaaacgttctagaataccatgtggggacaatatattgcctagtgacattaaattcttcagcttctatgaatctctctttctgaatctattgatggtgagactagttaacacagccacaacaagttcaaggaggaaatcgtctaggtatgactgacattacaacgttacattgcttggctctaatgaatttttttcattttccttatacatgtcctgttctcatatctcacgagtttcttttgtgcttgttttacagaagtggatctaaaaagcaaagtgatgaaagtctagctgtatcagatgatgtcaacaactcttctaactgttcttgtggagtcaggaagagaaagagatctagtactgacaaactcaagttgcagaaaagaaaatgagggggtctatctctgatgaccatgaggttgtcatagagaatgcctctatctcagttggtgaaggcacggccaagaagagaaggaggggcactatctctctctggtaaagagggagaagtcaatgagacaatgaggggctctttctcacgtgcttatgagggagcaaccaaacagtgaatgagaggctgagtctattgataatcatggtgttgtactggaaagcaagagagcaccatcaatgtactcttttttttggcgtgtcttttccaatggagcttaagtgatataattaggatatgtttccccaagagtttaagttataccaataagcattattttctcttctctacatgaaatgagccaaagagaactcaacagcagacagcatggctaatgcggcctttgagttggagcttcaaaccatggcttctgaagaaagagatgctgatatgagaaatgtgagcaattggtgacacaagtcaacgccaaggtatttaactctttcctggtataattaatttttttgagggcatgtgaatgtcgactaaggatggttgttaagggtcaactgagctttggactgattttcttgatctctttctagacattctgtggacaaaatgttccacatccacacatcttgccgattgcatgtccttcgctccaataaatgcatccagcaggcttgcaaggcactatatgtgtgaggtatggcaatttttctttcaaaaatgctacacacacgacctgtagtgtctgatttttggacgactatgaagtgcacggcgtcaacaagaagtagaacgtcatatgaagcctcacgccattctgttgtacgccggtcggatggaacagtcgtacgtatagcattgttctttttctttttgtcatattactagaacctagtagcttattttttttggtctgtttcagtgtcaagctgttaagcaacatggtccaaacaaatgggaacttctgatgatgggtcagctattgccgttccttctggagcagatcccatttctgttgagaatagcaacacttcttaaacttctgatgaatatcaggtctgaactttggatacggtatgctttcttgtggtgataatatggtaccgacaactttccttgatttcagtgcagaaagcaatcctctaaacctctgaagggagcttcgtgtgtgtatggtattttcctattgccattgataggcacaacttctggaagtggaaggaaggaatatacatgtgtactgtatatatatacgcgctgtgtggtgccttacaatgaccagcgcatct

SEQ ID NO: 42007 - DNA, 4812 bp, Oryza sativa
ggtcctaaaggaaatagttttgacagatggaactcaaaatttgtcaaatgaaatgaaatgatatatatttgacaaatattaggatggaacttaaaatttgacaaatatcaggatggaactcaaaatttgacaagtatgaagcaaaaatctgcatggaaccgaaatgtttcacatatagcagcatagtagcaatttgacaagtatgaagcaaaagtctggcaataagcacataaatatgtctgacaggggttcatacaggttcctaaatggaagccaaacaatacaaaagacagagtacttgatacatggccaaacatcacagccaaacagcacataaggttgcataacatctggactaaacaatagtactactggatacaagggctgcatgccctgcaacacacatgttgcataacatcacaaggttacaatcttcatcaaagtttgtcagactcccatggcaatagcagcaaggcaccgcttgtcttcctccttgatttggcatatgcaggttcctcagctgacacgcagatagaagcactccctgaagtgactctcactgatgcactggtagaactctgtgaataaggaacaattgcttgtagatcaatcctagctgaaccaccatgttgggcagaaaccttggccttggcattcaccctcaccttgttctaggaatccataggagtctgcaaaaaaaccagtacaacacatattgaagtaagacagtatgacacacagcagcagtaatggtatttttcatgcatatggaagtaaaatcagtgcaacacaattacctttgtcttagcttttttgggcatggtttgaaggcttgaactctgtccacttagtgcaactgacttcctcttctactttgagcatagctttgagttgtgttagacagaaccaggttctgattctaaatggatggtggctgattctgagttgttggtggcttagaacctcctgtgctaggacccgtcccactattttgtttcccacagcgggacttattgtgcccaactaatttgcatttgctgcatctcagccttgtgccaaacctggacatttttgtgggctttgctggctcatgcatctctctccttctctctatctttggctttccaagcattctgatatacccatgagcagtaaggggctccctatcatcctcaggccaggcagacatcccttctactggctctaggcaatgtgcatatgtggctttgaatgattccacagagtagctagtggcaatgtaatcatctaggttgtttgttctgtagtagatgcatgcaatcgcatgaaggcatggcaacctagccaactgccaatatctacaagaacagtctctcatgtctagttggactgtgaatctattgtcatgatgtttgatctcaaatttattgtcaccattgcagattgcatgacagaaagcagactcaatgatgtacacattcagtttttttagtatgcctggacaaatcacagtggtccatctagttagcttcttcctctgatcatttatcctaaccattactttccttctaatggtttctagcattgtgattatggggaaaaaaaccttgcttccaatatccatttgttaaatgattcacacatattattgtcaacagaatcacaattggaacctaacctgaaccaggctcggctccagtgctgtggatgggtgttgaggatggcctgggctccagcctgtgtaacttgaactagcttggctcttgcaagattgaaaagcattctacatggggcctttgcacatctccagaacttcttctggtactgcttatcagggaaatgtctcttccagtttgcatagatatgcctagcacaattcctatgctcagcttcaggggcacatttctcaatagcatttagaattccctacataaacataaaagttagtccaatagaaaacaccactgtgctcccagggttacttcttaacaactcaagctggtagttgaacagcttctgatactgtccttttgtggcatccatctgtttcttcatcacaatagactttgctctcttcagcttggaaatagaggcctcagcaaacatctcttcttgtactgtggccttcatgtgtgacaagttccatgaagggatggcagctatgaattccagtatttctcagctatcctgccagttgtgacaattttattatccctccttggtggaccatgcatgcaaactctcataagtcacaatctgccaactatctgaccttgagttcttggacaataaacacacccatggatagctatcccagtcacatgtgaccctaaccctcttgtgatcatctttcataaaattaaccaccttcttttcagcaaggacataccttgtcatggctttcttaaattgcttcttgccattgaacttcatgcctagttcaaatacaagcaccccttctctcttcttgtacctagggtgctttgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggagcttcagctccactccacaggcaaaactcaactggggtctgagccttggtcctctaactccatcttcagctcagaagcactacacttctgaaaagggggaaataatagcaagactgagtacaaccaccgtactcagcaagccacaccaacgatgcagatgtgcaaggggatacaaggatggtttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacaatgtattgggtcgatttattaagatgggactaatcacggtgaatctggttgaccgcccataaccgcgggctcggctattcgaatagttttactctgatcagaggtgtacaactgtacccataagacacagccccacgacacgtttccgtgcgccgacatgccaccacgacataccggaaagaggccgtgacaggacccttcgcataaccccctctagccaagcacaccacacctcaggtttcacccccatccccagcgggcaacgggcagtcccctctcgtgcctaggtgaatccggaagcgacagaggccgtcgcagggcccgccccactccattacgcccacccttgcctggatgcgtcgactagaggaaagctacactacaagcccagccgttgcccacgctggcttgtggtaagtatgataagttctccagggcatcccgcgaaccggtccttaactgccatgggtgcgaccagcaaaaccatgcacccacagcccaccattcagtcgcattttagttggataattacgaccatgaagcatggccagatgtctcgagcacgcagctcatttagatactaaaaggtctaatacgataattaccccatcaactgagctagtggtaattaagcatggctaagcatatagttctagctaggtcacataagtaacatgagctagtcgatttattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcaaacaatcttccgaactcttatccttgcgaccgtgatcttccgaaacgacggattctacacgcaggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcggcacaagggcgccggtccaccgtggaccgggaccaccgaggcagtccaccaccggtccacgggaaccgacggtccggatcggcccaagccgatcgggcggccaggggcggcgcggctggggcacagcacggcacaaagccggcctagctgagccatggcgcggcggtagcgcggtctccggcgacggcgccgacgggcggcgcgggagaggtggcacgcatgggcggcggcggcgcacgagatcgacgcggtgcgacaaggggggtccgggcggcccagacgagcggggcggcggtgcacggccaggtggtcgccggcggcagccaccggcgcggcagcgcgcacgggagacagaggagggaggcaaggagggagaggaggagctcaccaaggacgcggcgacgaggggcggggaaaggcagggagctcggcgtcggcgctcctcgggacgagggcggaacggcggcccggcggcgttccgcgagcgggaaccggcggacggcggctggaaggaccggcgcgaggggaaccgtgtcccggcgggatcctgccgtgaaaagcggcggccgaggtgctcctcggcgctgcgaagcgagcggcggtggcgg

SEQ ID NO: 42008 - DNA, 1505 bp, Oryza sativa
gtgcatttttataggccccggagggggagatcgtggccgtggcaggcggcaacggccgacggatggagctccggcgacgtgggcgagtggggctcgaacggcgccgatttttgggggggaaatggggaagaaagtggaggaaggggaggacgtggggtggaccacgtctgcacgcgcgcgggagcgtggaggcgcgcggaggaagcggcgtcgtggggtggctcaagcggccatggcggcagttggagctggaggaaagggatgacaggtggggtccacgggtcccacctgtcggagagagagggagggagaggccggctggggacgcagaacggacttgagggagagagagagccgagcgggccgagggaggaggccggcccgagagggagagaaagggggcgcgcgggccgcgggagagaaaggagggattgggccgaaaggggcccaaagagaggaaggaggattttatttgttttctttttattttaattgatgcaatgatctttgtgctattaaaactatttctcgagctccgaaaattcacggaaaatttcggagtacattagggcacaaagaaaattacagaatattcccggccaataatttttaaaggaaatttttaattccctcaataattcacttgattaagttgatttaacttttatttaatttctagaaaatgtattaattgatttttattcccgaacgaaaatcggggcgttacagtgcttgtctctccttatcctaacctctccatcactgccaatttcttcaattgagtcatcatattgactgtcaacataaggggtttcatccccctcatctgcagctggtctgtcactagggttggacctctctaccacaaagaacacatcatccaagatgtctaactgtgctgtcttaaccttcttcttcacctctttaaaatgcttctctatttcaactgtttcttcatcatcatcagagggcagtcatctcctgggatgtaatcactgtcagtttcactttcagagggtggcacactagcaagggggcagaatcagggtgataaaccacaagcatcctctcatcttcatcacattcttgcacagctttaccctttagtgcacttgtatcaccctgagcttcttgggttactgtttattgcacacaattgccttttatttgctctggctcaacatctgcagcaatttcttcacaatcctcttccttttcaccgtccacctccatgtcagcttcataatcactatccttgtctgaatcatcacataagtccactatttcaggctcctcaacgtacacttatgcaacccctccctcacaaatgcagtctgatatgaattggcacaccttgtcactcagtagagcacgcatcccagtttggatatctttccctaaaaaaagccagtgcaaaagtgtgccctctaacaccctgcagtgctcacgcaaatgtgcaaaaatcccactcaatgtcaccttctacctagctacataaaacaatg

SEQ ID NO: 42009 - DNA, 5354 bp, Oryza sativa
atttgtcagctgccccatgtcggccgaggttatgcaccgccgtgccctgcaccgatgcctccgcaccgcccctagcctagccggcatccgccgtgccctgcgagcgggcctcggccgcgccctgcgccggagccggtggcgtgctcccctcgagccctccgccgccgccagctcgcccttcgccgagcccaatgtcgtgccccccgtcgagccctccgccgccgccagctcgccctcgaggtcgcccgccggttcgcttaagctcgatctagggttttcgactgaggagaatgggagaagtgataatacacgcgcccttttttccgtctcatttaaccccacaccaactgtcgctcccagtcagcgtgccacgtcagacggtcaatgtgccagctcagctaaaaccgccctccatactgctataggacgagaattgactggttttcgtaagttggaggatgggtcatacccggttttgcggtcaaaggacgaaaatcggagtgggcaacaaatagagggacccgagggacccaaagtgaacttattccaatcttaaaaacgtcaacgttgcaggcttcaaaagcaaattttctccaatcaacttgcatagactggctggtggggccacggtctatagaccgggcttagctaataagtactcggtttgttgattggttcgtgcgcgacagcaaggggaaggattaggaaggagaagacgaaggggaaaggaggagaggagcgaaaccctagggccaggcaggcatctccctcccgggatctcgacgcccagcaaccggaagccatcggcatggctatggcgctgcgctctctcgccgggaagctcaggccgccggtggcagccaccctccgccgggcgccggcgtcgagctccttccaccccgaggtgttcttcgtcttccctccccttctccccctccctcctcctccgtaattatcttcatcttcccgattcaatcaccgcacgctgttcaattagtccccgattcgcgagcttttagtttcgagggaaaaaaaagtccagccttttttttttcaaaaatgtttaatttgtcttgagaatgattataatcaaccactgaaaatagacacatcggttggcgcgacgggctattttatttttatagtacgtgtttacagactttcagaacgtatctatgttagttttcaagtttttatataacattttggacctctaacatagaggctgacatgtaatatctaataacaaatattattttctacatattctacataatgatcatctaagatggttttggggttttgtggtttacttttaggacgtcataaacagggcagtaatattcttaatttattttttcattttatcttttctaacacatgaaaatttgcatgcatatgcttcctgtgttctgtttagaacgtaatatttttcacaatttttacgcagcacatagtttaattctcataatatttattcacttttttaattccctatttaacttctagaagatcaacagatttctaattatcttattatagaaatttattttggtagaatcggatattttcttttctcctctgcataatttttactcgggatgtgtaaaaatcacataatttacctaatagaggtgcatacacatttgatttagcacaatttagtttgatatatgcacatgaattacatagaaagttttactttgatgcccacaaacctcatgacatagcaaaatttagtacttgataaaattagttgcgggtgacctatcaagcagaaggcaaccctcttgctgttttttgttctttcctcggttcattttatttctttttggttcacatttttaatcttatttttagctttccttcgctttgatctctaagtatagaggctgtgcatagatggaaaatttggtttttcttcttcgagggtgaatctttattttctctcttttttctacaacattctaatagttggcactaaagaagactatttttatgcaaaggaaataatagatctatttcaatcccaccagaatgggaagctctggaagttgttaatgtacttgctttttttttttgccttttttaccttgcttccagattgtggaatataatagagggaatagacacatgtcaacatattattgcacaccaaatcaaccaatcagcttgcagtgtttctgccagcgtttgatagatagatagatagattgattgattcaatgtgactgtagtgcatacgtatacctgtagagttatttatgcatcctgcgaaaaagaatatatcttttaatttgctaaaaaaaattatgaactttttaaattcacggtgaaatactaacaggcaatttgattttgtttcttactttgatggtattgtaggagaagctgagcagcatgacatcttctaagactaaaactcctgttgatgacaactgttttgaattgcttggggacaagtattttgaagagcggtctcggatttttgcccaattggttaaggaagatgcacggtactatataacaggcaacctaattccttatactttcgtgtgcgatatactcccaactagtggcatccatgtgctaactaacacctattcacatcttctttttgcaaggcgcacggaggagcagatcgctgcatacaagaagctgaagagggcaatggttgcttctagcttgggcgcagcgattggaatttttgcccttctcatcagatatacgagtagtatatctgatactgttgtctagtactagtctcttgagttttagatgatcaccagctggcctagtgcctttatctattttagagcactctgtttatctgattatgcagttaattttggtgttgcacactggtactgctatatcgctgtcccagaatattggaggaacttaattaagagccctctttgcttgtgtatcattgaacatggtaagtatccctgtcatgtattttcttcttcaagacaaatttcatcctttgtatgctactgtcgttcatgcgtgcctatgcaacagttatgagcgtgatttatacaatgtttagttgcatcactgtatgattcactgtaccagcgtatcacttataagcttgatccttcatatccactgtattaggggacgtgactagagctccgatgtccaatcggatttctgacgttggacacaacgccagtccatagatcagcgtaaggcggtccatctcgttctttgaatttccctttttaaaaaaaatagaaatatattctttgatattaatagagtgacaaagtttgctatgtgacactagcatttgctgaaagataatgaaaaatgtggctttgttacatatgagtgacgctcttattatgtccatgtacattataaattagacactccaggcagtaggcaccagaatatgatagactacaacaaggtgacgaaaaaaacagcatgagatgtcctttttagctccctctacctctgtctcccatcttcttttgggtttttctttttgatttcatgtcattctcccggatgatgtattctcaaatatcactctctcggaaaactctgatttttcaccattgaagattgggtatttcttatgccatcgttaagcatgcaaggtgtcatgttaccacatctaaggggaaatgaccatcgtgtccttcctctaactcggggacatctctcttcctcacctccctttctgatgacaagtaagtgatgccaccaccacaaacattgagtcatcaagctgatcggtcgtcgagagaggaggacgacgaggaggccagggctacgtgggggcgattaggtgtggggacactggctaaccatgggttcccgccgccaaaggccaagatgcggcggggttatggcttttcgctccttgccctcgattccatacggtgtggtgaggacgagagaggagatagtgttggtccacactacaacgcatgcgatcttctcttgacgaatttctcgtgccatgaaagttatttgttactacctccatcccagaatgtttgacgccattgacttttttaaaaatgtttgatcgttcgtcttatttaaaaaatttaagtaattgttaattcttattctttttctatcatttgatttattgttaaatatatttttatgtatacatatagttttacacatatcacaaaagcttttgaataaaacgaacggtcaaacatgtttaaaaaagtcaacggtgtcaaacatttagggaaggagggagtattatgttatttagttttacgacggttggtagggagcgatgtggcgcttagtgatgaaaatgaggtgtccgtcactgaaactaaggacaaatcgtcataagctagtttaacattgtatcgtgatgaatgttattttgtttcatcataaatatcttttttttcattgaaaacactatcatatctttttttttcattgaaacacaatagtctgaatttgcaagaattttaaaattacataatatgtttggagttctatagtaatgtgtaaatcaattaagtttaatgaagtaaacaagggaataaaatcttcttaataaatcaaggtgtgagttttttttctaaatactccatgaactaaaataggtttcagagctacattactaatgttaataaaacaaggattgtttcagcaattactactttaaaaacataaaaggaaagaaaatctctcaatcagtattgggctaatttcagtccttctcaaggagtgggaagaaaaggaaaaagtacaccgaaggtccctcaacctgtcatcgaattacaaaatcgtcccacaaccacaaaaccagatatatgacgtcccttaacttacaaaaccgttcgttttacatccttcggtggttttgaccccggttttgtcctacatggcgggtgagtcagcgtgggatccacgtgggccccacatgtcaggacgccacgtcatcatctctcttcccccccccctcccttcctcctctctctctctctctctcactcatctccctctgggcaagccggccggcggtggggaggtcaccgggacaaggaggtcggacggccggccagcgatgcggcggcggcgacatgggagaaggggagggaggtggcggcaggagcatgaggtgctaaagcagcctccattaaaatcgatcagacgaagccgaggcggatttcgcatgagctagcgcaagcgtcggccatagaggaggtcgtcgtcggcaaggagcgcaagctcctgcgctgcgcgctcgtcggcgttggcgtcggcggccacggcggcgcgcgtggcgggcgagccgggtggcgcgcgcagcggcgggcgagaaggacaagcacagcaaagtggtgacgtca

SEQ ID NO: 42010 - DNA, 13756 bp, Oryza sativa
  unsure (1)..(13756): unsure at all n locations
cttcgacggagcaggcgcgcacgaggaaggctacaatggcggcgtcgcctaggaagtcgggggagaagaggcggaagacgaggtcaaggtgcgcggcacggagggcggagcgcatcgcgaagttgagggcacggagggaggggtggatgccgaggcgcgaggcgagcacctcggcggcgtcgggcggccaaagctggatcaggaagccgtcgacgccgaggagcggcggcttgtgctccggcacgggagaaggagaggaaggtggcggcaggagcatgggggagataaaagaggacgagctcaagcatggcggcgagaggagtggggcgacggcgggcggagaaggccggcaaggcggtggcgcggagcgaggtggtggcggacgacgatgatggcagctcgcgcgcgcagctcctcccccgcacactcgccggctcccatctcctctaccgccacccagttcttccgtgctgccgctgcccagctcctcccccgccgcggacgccgcccagttcctcccccgccgccggcacctcgccgcctcgaccatcgctcgagctcgcttgcacctttgccacccccaccctcgattgagagacgccggtcgctggggcactggacgacgaggcgccccgcggccggcggcggcggcggtggtgtggtgccggcggtgttcttcgcagtgctggagaaaagtgaagagagagagaggagagtgagtgatgacgtggcatgctgatagatgggtcccacgctgactcagccgccacgtagaccaaaaccggagtcaaaaccactaaaggacctcgggtgaccggttttatatagttaagggaccccatatatctggttttgcggtttgaggacgttttcgtatctcggtgacaagttcagggacctccggtgtactttttccggaagaaaacagtccacccatctgatctctagtcttgggcttattttggcccatttcattatcccccaaatctctttagggagggagggagatacaggaggaaaagtaatgggctgaaatcggcccaacactgatacagtgattttttttccatttaaattaccgaatttgctatatatacggcgagaagttagccggtgtagccgccgcaggacaacgccgctgaagaccacgacgcaattctgccctgcagccactgtcgacctcctgcattgctgctacctccttttatcacctttaagatccaatcacactcgatatcagagaaatcttttgctttcagcatattataaacacatggtcattttgttatatgccttttcaaagttaatttttgggaaaatagctactttagtccctaaagtttgtctataggatcagtttagtccctaatcttttaaatggtcgaaagaaatccttaacctttgtcataagacctagaatagtccttgggtccaccaaaattatcatatgaatatgccatgtcatcattcatgtaaaatctatgatgagctgtccaatttacccttacatatatcatagaaaaataaatataatggtgaattagacataaccataggaaaaaaatacttttttttcacccttttgaggtatatttttgctcttacatataccatatatttttttaaatttttccttttgttttttattttcctatgcgtaagggtaaattggacaaatcatatagattttgcataggaaggtgacatggcatgtccatgtggcgattttggtgagaccaaggactatgttagcctacatgacaaatttaaaggacttatttgaataatataaaagattaagaaataaaatgatccaggagcgaaactttagggaccatattagctattctccattaattttttaagattgcttcttccggtacattgcgtttaatgtttcatgcagaatcaacaccccctccattatataaatcttttttcaataaaagctatctgattgacaccttctatttacttctcgtagtctccccattagacagatgagcctgaaaatctgaatcattttttgcatattttcgtttgggctactactaagtcacgcaatatatatctagctcaaaattgaaatgtcagataacactgtcaaggtaactaatgacaactacagaattttagctgcctttgtttctatagtattgaaatacttatcacaaataaagaattatagtatatatactagcagtaaagaacaccggagcatcgctctagttaattaccggtgagctttacgccactggttatcatgctcgccggaagacgcgttgtcgccggcgctgctggccggcgacgggcatccgtaaccctggtactcgctgctgtagtactccgggctggccggcgacgccgccgtccgcctgacccgctccatctgcgccgtgtacgatcccgaccccgagctggagtcgccgctgctggacgacatggcgctctgcccgggccgcgcgccgtcgccgagctcctccggcgacacgtccccctcgagcaccttcaccacctggctcatcttggggcgcctcctgccggcgtggcggacgcaggcgacggcgcaggcggcgacgcgcgccgcctccgcccggtcgtactcgccgcgcagccgcgggtcgacgatgtcgtcgtagccgccgccgccgccggcggccatcgcgcggggcagcgcctggcgcgcccagtcgacgaggcagtcggcgccgtaggagctccggtcggcggggcggcggccggtgagaagctccagcagcatgacgccgtaggagaacacgtcggacttgtccgtcagcttcccgctcgacgcgtactccggcgccaggtacccgaacgtccccatcaccctcgtcgacacgtgcgtcacgttctcgctcgtcagcttcgccatcccaaaatccgcaacctaaacacgatgatccaaattggtctcagagtcagcgatccatcgagacaatgttgcagaacacagcatatgatcgattgattgatcgatgatttgatttaccagtggctcgaagttgttgtccaggagaatgtttgccgacttgatgtcacggtgaatgatccgaggattaccttcaacagaaaaaaaaaaaggagattatcacagactgaaccaaagccaccattgatcgatgaactgatcaaaattcggagttcaacttacattcctcgtgcaggtaggcgagcccctttgctgatccgaccgcgatgcgcaacctcgtcgtccacttcatcaccggtaaccccttttctgtacacgttgaagtataaatgaattgtccgtcttttatcatgttcatagtggagtaagtaactatgtaccgtgttataatgttaaggtataagtgaattgtccatcttttatcatgttcacgatgaagtaagtaaccatgtacggtattgaagtataagtgaattacccgtcttttatcatgttaactatttaccatggaggtggtgttcgagagtgcggttggggacgaagtcgtagacgaggaggcgttgcgcgccagcgatgcagtagccgacgagggggacgaggtggcggtggtgcacgcggctgatcatgtccacctccgcctggaactcccgctccccctgcccgcccccggcgctgagctgcttcaccgccacctccttcccgtcgccgagcacgccgcggtacacgtacccgaacccgccctgccccagcatgttcccctccgagaacccgcccgtcgccgccgccagctcgtcgtacccgaacgcgttctcgtccaggcccgccggaacaggcggcggcgggggcggcacgagcggcggccgcacgacgacgtgcgggccggtcatgttcgtcgggtgcatcatcatgttcggcggcgtcgacggggcgccggtcttggtcgccgcccactgcggcctcgcgccgccggtgtggtggtagtagtacgccgtggtgttgcctgcgtcgtcgtcgcgccgtcgacgtcgccatggtcaggaacacgacgagcaatggcaagtcacagcaatggcgtgcgcgacgtgtgcctcaccttggtacccgaaggcggcggcgtggtgattctgccaccgctgcgtcgccgacctcctcctgcagcaccaggagcagcaggcgcaggcggcgaacaggaggacgaggagcagcgccgccgcgacggcggcgatgacgagctccgacgtcacgtcgagcccgccggcaaatgtgatcgacgtcgacagccgtctcgaggcgtgcgacggcgagtagaaatccgccatcgacgtcgacggcgaatcggtgcccctcggcgacgacggcgagggatcggaagacatgatcatgaattggacgcgcggccagaggattcacgatagaacatcacaaatttttttttgaagattgttgacccaattttgtttgattccaattccaaacttcaacacgaatcaatcgatctgaaaaaccaaagaggaagcacattttcatgcatgtccgatgcaagaacgatcgagcaaaattaattgcgaaattaatgcgaactgtaacctacatgcaaaattttggcaacaacatctaggagaggacgcactggatcgatcgacccaaacgcgcaactaattaattgaacaaatttgatcaagaggggggtaattaattaatcaaagatcgagcagttagttaattacccccaatgtaatgtacctgaggcgaaaggccatggcgcgagatgtgccattttggcgcgcttgctattcttgcacgatctgtactgcaatctgttcggtttggaagttgcctgcagcgagcggcagtttgcatgtcaaaaagctgacgtggaggaggaggagaattaaagggcggttacacttctgtgtgcgtgatacggggacacctagcgtcagttttctgaccggccgtgctactactcctcaggtcattacgcaggccattttactggaaggccctttgatttgtatagatattacctagagatttttttttaagtttcttgtgttttttttagagaagtagagatattacctagagatttttttttaagtttcttgtgttttttttagagaagggtattttttacccggcctctacatacaaccggatatatacggccattgaaatagggaacttagccccgcaaacaactcaatctaaaattcgctccataggagatttgaactcagaaccttggtgtactactcaggtcactgtaaccactaggctacatgccctttcgtaagtttcttgtgtatgcaggcaagtatggtttacgccctctctatttctttaaatctgttatgtgcagctgctgaaactgaaaaggtaataaattatgctttcacccacgatctctttgagtcctcttgagttagcattccaaaaatcatgtgtcctgaaacaaaatggatgataatggaaagcatgaaagctcgagagttcattacatgatcacatatggaatttgaaagcatcgagtctcataatattgtatgtctatatattgtctagggaagtaggttaatgggttgcacatttgcgattattagcttgtaatgatactatctgatcatgcaaggacatccttgaaaaaatctaaactgtcaacgacggtgcgccataaaaaaatatttcaaatgttggtcgcctacagtcagttagtacttcctagttcacttgttgcttgctagctttaatctatcgcaatggattaggtttttcattcacatgtgcatatatcaagcattaacatggtttgaaaaatcgaacttagtgggccaacacatcgtgagaggtttgaaaaatcgaactcagtgggccaacacatcatgagattttaaactaacacatattaggcgagatgccatagttggattggatctgggcctgggcctaagcggatgaattgccaacccctaaaacatgctaaagtagctaggggtttctcatgggccaactatacattcacacgcggccgcttaaagcggttggaccgtctaatgtgtttggcgctactctttatccatatctaaatctacgcattaatgagtcatcctaacatacatataaatctacacacgatacatatctcaaagatagacatcattaaagctacaaataaatgttacaaacaacccaacgtatccgtgaaaatatatcgatatgggagatggaccgatataaaaagttacacagaggagttaggaattcatctcccatcttgaacatttgtaaaggataattctacaaaagtaaggggcttaggcgaaaaagagcccctcctcgaggaaacgcggcacgctgtgcgtgcggctggcttttttatccgggcttgaggcaacagactcttccccttcgctcgctcgcctcctctttccttcctctcgctcacaaacctcccaactagggttttccccgccgccgccgccgccgccatggccgccactccggaccgcgccaatgccgacctccgccgccgcctcgccgtcgacgcccctccaccaccgccgcagatcgccaaaggtccctccccaactcagccccccgccgtctcccctcccctccctctcgatccgttcccccgggccggaaccctagctgttccgtggttgctcgggccggtccgatttggttccagttcggtcgttcgatccgccccgccgttcccggagttttggggtttttgggcggttgggaaatggtggttgtcccccccccccctcccctcacttggacttggtggtgaggcaggtgttgggggcgtgttaagggcgggtaccttgggtggttgagtgaaatcggtttgggatttgggtggattatatgcaatggtcctagtttaacctccgtctgatttgtggggttttgtgcggttgatttggctgggatggattctcttccctgcattttattactttgatttctgctgtgtatgcttgcagatttatatttttttctatgtgcatatgctgttgttggtaacttatgctttgatgttgttagcatgtgccatgtcatgtcacacccgttgttgtgtgagaaatttggatttgatgtagctatgtgtagaggatgacagcttgtttcactgattactcaacatgtggaaaaaacctacgtgttgttgtagaaacccgtttgatttaaatttgcatcctgtgccaattggcctgttcggcaagcaagggctgcagccgctgctgtcttcgtgcttgcgggactgttccagttggctacggtttgcgtcgcagccctggcagccgaacaggcccaatattgtggtaaaaagttgtagaactaatgtccaaaaccctgatctagttgtgttgatttgaggtatattattctagcctttcattttatcaagtcaaccattggtcctttatttggttaattatttgtttgttacaaacatatgagaggaatggttgtgttggtaatatcacatattaatggcgcaatctgtgttctatacattttctttgtcagcagaacatgttccatgcctcattcatgatactattttttttttgcagacaagcaaggactggatactgagatgcctctttctcctcaatggcttatgaaggtgggagaaaacaaggttagacattgagaagctaggttaataactagacttagggaactggtcatgctaatactatacatgatggttgtaacagtaggataccttttaagtgtataataacctctcttattagttattttttgcttgtctatactgaagatcgttgattgcttgtggcaggaacccagtttactgggtgttcgttcagatggttcaaagataccaggaaatgatgaggacacaagcttcagtgtgaaaagaaaggatgttttcagggcctctgtgcttgatggtgaaactgggtgtcgtgaacgctggcgtgatgatgaaagagaaccaaattcagcccctcggtggaatcgctggagggagacagacaaggaacatggtgatacacgcaaactggaaaggtggtcagatgactcctccaagtactctgtggatggtcgtcgtcctccacaggaacgttggagtgactccggtaacaaggagggaaactatgatcaacgccgtgataacaaatggagtgctcgtaggggccctaatgataaggagtctgagaattggcgtgacagatggggtgattcaggcaaagatggtgatgctgcccgtgaaaaaggtttctctcactacatagctcatggaaaagacggcaacagtcatgagaaggatgctgaaagagatgataatatttctagatcatggaaatctagttatcctgtgggccgtggacggggagattcatctcatcatccctcacagaatacacaaaaatcatctgcaacatatggatatggtagagggaagccagacaatgaaattgcaagttttccaggttctcgtggaaaatttacatctggaagtacaaacacagccagttcaggtcatcacgtccattccatcttggcctactttctgacaggcctggtggtacatcaggagatcgcacagcatttagatatagtagaatgaaactgcttgacatatacagaacttctcatgttactgacttcaagatgccccttggtggctgtgaggaactctctgcatttatgcaagaagaaactttggaacctttagcattgtctgctcctactactgatgaagcggtaattttatgctataattttctcaagtgggatgatctcattattgcagtacagtttcttatctcacagttctatttatgtttttaggccatcttaaaagcaattgataaaggggatatcataaacagtggcgtccatcaggcttccaaagatggcccggttggaaaaagtaatcctgaatttccccattaaaacaaccaaaatcatgttttcagcagtttgtttatgttgttgtgtactactaacatatgaaaatatttttttatcttactgattgaattctcactctttaattagatggtagagaagatcaacaaggaggcatggaagatgtcaagggagaaacagctgcaagtctcaggggtaccttgtttatttctgtctttacaattttgttgtacactgcattgcatttatttgaataggcatcaagtgattaactgattacacagagatgatagtgtattcactcatccttgaacattattttttgaagtaaatttcacaaaaccacatgatttatgggtaagttgcataaaaccctagatattttgattggtggcaaataaacctcaggtattatggttataaagtttcacaaaaccccagccctatgaatgttgagtatggttttacttaaaattttaaaacatagcatgtatgcaaaatttttaattattgacttcttgattaaggttgatagtttaactcttcagtcttcactactctgaaaaatattgttttagatcgagatttgaataaaggttgggtatgtgccacaagtcatattacatgtggttttccgcaaccttgaccataaaacatggggttttctgaaatttactctcttattttttttagtcaccaccaactctctgatgactaggggactttccaggtttttgttagtataattttgttttcttaaatatgtggagttgtgtacattgaccttgtttacaatcagtcaatttgacatgcgctttgaagcatttccttttctattttagtgcctctacatttaaccaaattttatatttgctgtagatgttatagcaagtttcctgtttgctcctgtatgtaaatttggttggacaagacaaagtttgcagctgcaagcattctatgtttttcttttggacaggaaaacgtttttaacttcttgtagacattcaataaaactatgctataaggtttgcaaactaatccatcaatatgatctctttgttttaaattcgtaggccatgttgaagtccttactgttttttgtattttttaaaagatatgttggaaggctgtcaaaccagctcactttgtgctgttattattctactactattctttcgtaagttcttgcagtgtctgttaaatcattttcccatgctaaaggttgccactgttggtttataataggttttcctggtaatactgatttgccggccagagcggattccttgcggccagaaacatctgcttatgttgttccacaaagatctaggctcattggagaacataggcctggaccaactgctgactatatacagcaaatgccctttgcattagatcaggaaagtaaagtcgctgttattacaggtgttgatggatttgccactccaacttatcctaatccagaaagcttatctttatattacaaagatccacaaggtcaggttcaaggccctttttctggagctgacatcattggctggttcgaggctggttactttggtatcgatttgttagttcgtgttgcaaatgcaccccctgatgcgcctttcttattgcttggggatgttatgcctcatctacgagcaaaggcaagaccacctccagggttcgctgcaacaaaacccagtgacatgctaatgccagaaactctatcaactgggaattttgtcagctcgagtaacacacatgcaggatcagccagtgttggagcatttgacagtgggctaagcaggaaagatggtgcagttgaagctcaaaatcgctttttggagtcgcttatgtctaatagtgttcgtgatccttcagctgaaatgcttgctatgactgcaggtttgttttcttagcaagaatagcggccgtttcattccatttattgttttttataaccataattctaatcttgcatgcatcctggtttaacataaaatccttttttcctttaattaggtatgactgaatatggcagcagtggcattggtaacattactgtgtctggaggagagactgggaacagcatgacttaccttttggtacagaaaagattgttggagaggcaaaaatctttgcaaaatcctggttcattttggtcaggagacagtattccagctgcacaagtgcaaaacaaagatatagaagcatctgctctacacactaaattgcaccctcccatggctgatccacctcgccaagctttgcaatctcagaatgttgatttgcttgcgatgctgcattctgcagagaaacctcaagcacctgcttctaattctggattgccagcatggtcaaactaccctgaagctaagaatcttgatcctcgtgggcatggtgtggatctcactcaagggtcacttaacatgcatggtgcaagtgtgcagagttcccaacaagccactactgctattcaacagcaaaacttcatgccactgaacatgtcacaaatagctcatttgggacctgagaagttacgtgctgaaatatcccaagacccacagcttttaactaggttgcagcaccagtatctactgtcacagctacaattgcaaccacagctacctgtgacgcctcagcctcaacctcaacctcaactctctatgttggacaagatgatgttgctcaaacagcagcagcagcagcaaatgcaacaacagatgcaacagcaacaacaaatgcaacaacaaatgcaacaacaacagaagcaacgattgcaactgctgcaacttgagcagcagcagcagcagcagctgttgttgcagcaacagcacctgctttctcaagttatacctcatgggcattccagtcagcaacctgatgatctttatgggtcacaacgtacttcattgccaactggtgattcttcgaatcttggccttcagaaaatgaaagaggttcttgaggcagaccgcgttttgactgcccatggtacacaggaggggcagcaacctagtgatccaagtattatgaataagaagggtatggagggtgtaggtccatctcaaagctctgtaccttctttattgccccatgaaatttttggtggtgtaccttcaaaagatcgctactctcacccccagaagttggaagataaggtcaatgtcaatacacaattaaaagccagtatagtgaacccgatgctaacagaagttgcaaataggcgtgaagatgattctgatcaacaggaggttagatctcatgaaaggggcattggaataggaaaaacaggaatcatgtctgaaaatattttgggctctggatcttctgaggtcataggggcagctccaagtgcacctaaggagtttcctgaggcaccgtttgatccaaaacctgaaacattgtcatctcatatttccaatcaggtgcaagatttgaaaatatcttcagaaaatatcctcggtggtagtgaaccaactgtggcaactgaagttaaagcctctgatacacaggacacaaaaaaatcagaaaagaaaaagaagcagaagaagaaacaggcaggtgcggatgtagccaaaggagctacaaagacggttacttctcaacagccaaggcaggaaactctagttggttcagatcagggtggagctaagcatgacttgcaagatgatgcagaggagctattttggggttcccccatccaagtggaaagttcttctaaatctgctgacccaccgctaggattggaatcatctctggttctacctgcgaaaagtttttccgaggattatgatactaacaaaggtgaatgggaacctaatgctgccgcagtaaaccagcgtgggtggaaacctactcagggacctagacctaaatcacttctggaaattcaagctgaggaacagcttagagcacagaggggattagcaatggagaatgctaagccagctgtttctgcagcttcagtgccatcaattccttggaatggcatgctgaccacttcggaccagcagttgatggctgtaagtaaatcagtggatggcctggaaagtgttggcgactcaaggaataggagaagccagttgcatgatttattagcagaagaagttttagcaaggtccagtaacacagataatgaggacatgggcaatactaatgatatggcttttccacctctctcttctgctgttgttcagcctgatgctcctgcttttgatgatactgacttcattgaggccaaggactctaagaagagcaagaaaaaggcgacaaaagcaaaaggatctgcagtcaaagccccagcacctgttgtttcctttgattcatcgactgtatctgtacctactgaaaagggaaagccttcaaagcaatcacatcaagagaaagaaatactaccggctccaccaagtggtccgtcttttggagattttgttccctggaagagtgatcaggcaagtgcagtacctgctccagcatggtctagtgagtcagcaaaggtgcaaaggcctctgtctttgagagatatccaaagagagcaagaaagaagatctgctgttgcccagcagcaaccaccctcgccaaccccagcaaaggtatctatcaaccaaaggaatcatgcaaatgttccttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42011 - DNA, 7721 bp, Oryza sativa
aaacgatcacgtttcgagccgtcggccatcgtcacagtgccctcctctgcagtggtagtgcatcctctctgttctccttcctcgctccatctcctccccttagactcgggtagtagcacgagtagaccccccgtagctagctgggccgccccaagccttgtcgccgctcgctgtgtgctcgtcgccgtcgccgcccgtgttcggtagccgcctctcgtcgccggcctctcccgtagcgtttccgatcaatccggcgcaaggaatggattcctgaggttccctagatgctctagcccctttgaatccaaccctagccgtctcgtcgccgtttccctcttctctcgccgccagttgcccccgccgcaatccaccgccgtcgatcatcccccggcgaatccgagccgttggctcgtcccctctcaacccgtgctacctcccggtgtgctcgctttcgcttgtatcgccgtggttcgccccgccgttcgcagccgccgtccgccgtccgtttcggccgatgccttcttcaacctcccgccggcctgcatggcagccacgtaggcaccacgtcggtgccacctcggccgcgaccgggtcaagctgaccccggtccgccgctcccctccgccccgctcgggcgcgtggtccaccgcgagccgtgaggctgcgcgtgggcctaccacattcgcacccaccgcgagccgcgcgcgtgcaccgcgtccctcccccaaaccctagcgcgccgccgcgtgctccctctgcacgatgaatcgtgtcaccgacaagcgggtcccactcggggccacgcgaggtgagcccggtccaccggctccctctctcctcccccgcgccctaatgggccgtgtcctctcgggctggccggcccatttagctcggccgagccgccctcttctctcgagccgcgccctagccgcccgagggaagtcaaatctccctccctccttcttttctttttcaaaagggtttaattaaatcctttttcctttagaccaaaaatccaataatcttagaaattcaataacttctcaaccgtacgtccgtttgactccgttcaacttccaaaaatcgtcaaatctcgagatctatctaatggcacacttagaggtcaataatagggctttattttcgccgtttgttgagttgtaccgtttcacgtgtagtttcggagcccgaagacccgcagtgcgaggatttcgaggatcaagctcaagatctcgagcaaggcaagtcacctttgatcatcttgcacctataatttaaatctaagtatttcttttctgcaaatattgcatgaataggattaacacgagtaattcggccacggcttgcgagatagcctgtcggccccaatcctaattgctgcaattaccctccttgaattattgaacacttaaacctcctttgtcaactgttgtgcttcgatgcacgggccttcggacacgcgcatcggaacacctcccctcaaatttaaaatatccaacggtgggtaaaacttggggttttacaaaagacttggaaaaaccctacacttgggtcggtgcttgcgaactaaaatgaatttccaaaaccgcggaccggggaacgtaccgggagtacgatttcccgctcttgcacttaaggaccgtttccttggaatttcattcaaacataaggcaagtgcgaccacatgggtagaatgggacacccctggctgagtaattagctaatcgggggaaccatgatgccaagagacatgtggattcaacggggtggtgccggggagaaccccccaggtttcctggcacagtatggtctgggacctaacctggtgttggtctaggacccctctcgttggcatatggtgaacctgtgtcggctgtcgaaatgccttgtcatgaaagtctcaaggtctccagacgtggccgttctgcacgggctgggtgatccgggttagtaatgtcgtgtgggtaaagtgtaccccctctgcagaggttattaaactgttcgaacaaccgtgcccacggtcatgggcggatgtgaggtgattcctagcgtagttttgtttgactactgcttgtgaaattactattgtggaatgagttcgatgtttggaaaatctgcggctgataggatcagccaggcccgggtggccgtttgaaagatgttggccgggtgccaaccttgaatcaaatcaaagactgatatattgcacatactccgaccggacgagacgcactgtctcatccgtgtcgttgagaagcactcacttagttgtttcaaaaaggagtttaaataaaatcaattgcaaagacaacagcctttcctttgaagcccgcattaaacacttaattcccatgacttgctgagtactcctgtactcacccttgctctatataaataatccccccagttgctgaagaagatgaagtagatcccgctgatgaggagttcttccaggagcaagtcgactacgatgagttttagggtttcggcctagttcccaagtcacgcctgtgatgattggtccaagtcttggcttccgctttcccttttgtaatgcagttgtgagctcgggatctgtccgcagcccaacatgaatgtactcctactctgtaataaagagacctctgttgttgtgatattctgtcttcctgtgataccagcactgtttcctaggactggtatcgattaacaggttaatttggagcgtcatgggctagtaccgttcggggctagttcggggcgtgacaattatatgaagttatagaagaatatattttgctattgagacttaacaattacacttgatataattgtgttttatgatgaattgttgactgctgaacttgagaattggacttgacaaaagtttgaagctcagtttgaggggtttctgtatttcgataaattttcgttaccgtatccgtgccagttcattttcgctccattttcggtttcgataatattcgttttcggggtttccgattccgattttggaataaatatgaaaacgaaaacgataaaggttgtttccgtccatttccgtaccattttcacccctaaatataacggtatccctgggagtatgtacgagcatgtgtgaagatcgacatgaaatcatgctaacatgtcctaggaatcgtgttgtgtagtacgaagaatcatatgatctgggcaacgacgtacatgatatccacatggactcggcgagtttcattcacttggtatccacatcaaacagagtctctttcgtagttcactctcgagtcgtgacttcgcaaagaatattatgcatgacgggaatcggatacggatgacgtaccatagttttgacaaaacatcttcaatttttaaatcgcgggcgagggcgatgcagtcccaagcgaacatgcggcaagggcaaatcacacgcgcgagggcgtcgcgggcccaatcgagcatgtggaaaaatcgcgtgcgcgaggacgttgcaggcctaattgcggcggcacgcaaatgcgcatgtggaaaacggactcaggcgcgggcctgattgctgcgtgcggcaaggggtgcgtgaaaatgtgcgggcccaattaattcgagcgtgtcttagataaggacactctagcgtaagaaaaagaaaagaatttgacagaaatataaaaatgaaaccaattcaaacatggatggcataccaaaattctagcggaaacatttttaatttttataatagtagagattatgagaaaatataaatatagaaagagtagagaagaattttatttttaaatcaccaagagaagagaatatggttgccattgtttttcgtcgcttttcatgctacgtttcttgagctgaggctgatctgacagcaaaatacatgcaagaaattatttatttggttagcttcttgtgcacttatttgttcttcaccttcttgagatcttttaggagctctgcactctaaaccaaaattttggttagcttcttatggggttatttgttcgttcttcaccaattgagatcttttaggagctctgcactctaaaccaaaattgcgctaaacttcactgcattttcatatgctgtttgttgacttcatcccttatgttgatactgatatagttctgcagaaggtactgaaagtagaatttgtttctacctgaatctctggatggatgggaaattttgtgtttttgtattgatatgattatgtcagtatcaaatcaggatttctcaagatataatatatccatctaaaatgtgttagtctaacaagatcgatgttgagggccgaaagtcactgagatcagtgcatgtactaaaactcttggctgtttgtgcaagggagagagcaatctagcatatctcggagacgaccgcacaggttacagtgggatcgcgctattgcgaattggtacacgaggggtgattatagacgaataacaccacaacgcaaaaatagcatatgacggatgaaggaacgaacaaatacgacaccgatcaagatgtgatggagacggatgccataaacgttatgaatcttttaagtaggtaaagatttggggaacttaaattaacaagtgtatgcaatttattgtcataaagttttttgagtcgtaaaaggacatatatgtattctataaactcgtttatttatgagtaaagtgaaaggtcggtccctaaacttgttagcctttctagatttccataattttaaaatgcagatttaggtcacaaaatttaaagtatgtcattttggttaggtctgtaaaaagctcgaggcttgcgagctactcgagctcgacttgtcctaggctcgattcgagcttaacaatatatgtgtttttttaatcttttatataataggttagttgggtccatgccgatataaatctcatcgttttgaaatctaccaatactattcgcataatgagaaccatgtctcaaaaaaacatccaaaatcagatccatgccacccgcctgatacgtgtgaaacacattttgaggccctcacagatcttgacgagcgcggtaaagcaaatcgggcgagtcaggcgacgagcttgatcgaccacaccgagatcatcatcaagggcgtcaacatctacagcaccttcggcaccgtccattgcgatgtctatgaaagccacgccgccctccatgtctatgaagtcgatggccgagcagatccacgctgcccttcgtcctccaccaccaagatcttggcctcttcccacatcagtccggggagttgtggccaagcccattggaagacaaccacccgtgctccccctcgccatcttcctctctttgccatccgaagcctctctagctcgcctcgccacgctgtcatcgccttgtggagctcagcctccccgaccacaccggtgagcttgcatcctccgccacgtcgtgccatacccagccccacaatggagaggcggtgatggccttttcaccaagagcccaagagagagagaaagaggggagtgaaggaaggataattacatgtgggccctattaattttaatgttttatctctgagcttgcatgtggatcccacctatatttaaagtttaagttttattttcttcattatggaatgtcatgtaagcaccacatatgcaacataccatattaaaaaaaaactactcgtttcatattataagtcgttttgactttttaatgtttgtctaactttatagaaaaatatatcaatatttttaacacaaaacaaacatattatcaaaatatattcaatgaagctaatttggtgttgtataagttgctgaaattttttttataactttggtcaaaaacaacttataatatgaaatagagggagtaagagacatacacgctctcgcgccgctctcatgcaggtggctcaggagcgaaaccctagccgccagcgccaccccctcccaacgcctccagctgcctcgccgtcgccggaaaccgtgcggctggccgggaaggcggcggtggggaaaacgcgccagcggcggagcatcccctcggcgtgggaggcagcgtgacgcacgcaaggtggaaggcggcggccagagcggccggcggggcggatccggcctccccggtggaggatctggccccctggcggccagatcgggagaagtgcagcggcggcgctccgagacggaggacggcctcgagctcgcgccgatggtggcgcggcaagacggcgggcggcctcacgctcgcggtgacggcggcgggacctcgagcttgcggcagcggcggcgcgcctcggtgggacagctcgcgacggcagcggccacgacggcacggcatcacggctcggaggagcagctcggccggcacgcagcgaaggctgaccggctggacggcaattggcgatgatggcgcggacgtgcctgccgtggtgctcgtggcagttggcggcggcgtcagctgacaacagcggcggaggacatggcggcggcgtcgggctggctgcttggtggtggagggcgacggtgcagcggtttgcggaggcggaggctagcgtcggtggcagcggcgactgcggccgtggctgtggaggcggtggcgatgccggcggatgcgggttgctagcgacaacaactggaggcggggaaggagtcgggtgcgagatgaggatggcggtggcgaggtgaccgtgtctgggtcagcggaggcatggcggactcggatggctagccgagggcgtggcagacgactgcttctggccggcgcgacatcgtttggtggaggggtcggagaccagcttggcgcagagaggcgcagccgatggcagcggaggccagctcagcgcgagaggctcaggcggcgaagatagaggccggcttggtgcgagaggcgtggccgatggaggaagaccggaatggcacgagaggcgcgtccggtggaggaggccagcttggcgcgagaggcgcggccaacggtggaggaggcgacctaggtgtgaggaggagttgccggtgggtgtggcgcagtcttcggcgcacgaaggctagccggcgggggacgccggtgtaggggttccacatgtcagcggagcttgtgtggtggtagagcatcggtgcgtcagccgtggattcgcaggtggtgagcggcgggtgaaaatctagtctggcctcggccggaccgacaacgattccccttcctgagggcgttgtcgtgctgtctcacccctcaagggtggttgccgggcaaaagcccagtcttggctcctttgagccccgacggacggcggcggcggtttttcggtcgcttgtcttcttgaagacatcgtttggcatcccctaggggagcgatctcgtctgtgtccctttgttggtttagtggcggtcggttacgcttagcggcggtcggtccggtgccagccttctcctgggcttgtgtgttggcgatgtcggtgtgtggttggtggaatttttttcctttttcctggttacgaccctccaaggttgtaatcttgtatttttttttcttgcgctatcaacagaacttcgtatcgtcttgtgcgagtcgttcaaaaaaaatagagggagtagattaaagtgacacatagaacgaaaccactatcaaaaacatcgagggagtaaaatgtatctctttttttttaacggttgagggagcctttacctttacccaattttacaccctgttttgcagtggagggacacgaatcaaacgtgcctatagtcgagggagtctagatggactttttccta

SEQ ID NO: 42012 - DNA, 1772 bp, Oryza sativa
ttcctgcagcccggcagaaggcaacgcgaaaccctaatccccaaattcgctatctcttggctctgccatcgaaattcgaaacccgcatagctttggagcaagccgaatctgcaaccaatccatcagattggagggcgaggcgcagggaaggcgatcgatcgaccgaagccatgcccaccaccgcagaggatcagaaacagtggaaggtggtggaagtccagcggatcaatgcggagtcccatccccctcctcggcgtgacgataggtgtgacgacctccgcaacgacgaggagttccagcgtgtcatggacaacgtcgtcttcggccggggttatgatcccacaagtacgtgatccgatcctcgatgtccctttcctgcacagtgagatcaagtcttccgatctggctgatcctcggtatgttttgtgcaggagatgacctcaggatcagcactgaccctactgcgatggtcgagctcatagagtactaccacaagatgggtctgatagaaggtaattgaaccctcttctcgtcttcctcttttgtttttcattcccggaggtcaatatggatcctttcttcttgtttctttttgttcgctcaggtgaatgggtggcttagagcttcttggagggggtggatggggtggaattggaggataagacggcgatggatgagaagccagtgatagaggaggatgatccactggtagagaaagggtttttcctcccggttagtaaccccctatacttccggttttgcaatcgggagtagcaatccgggactaaagatactcatctttagtcccgggtgaaataaccgggactaaaaatgtatctttagtcccggttcgtatcaccaaccaggattaaaaatggcgatggcagcgccagtcccggttagcaactgggattaaagatggcgatggcagcgccagtcctggttagccactgttttttttcattattttttcccaaatcgagttggaactacacaaatctcttcccaaatcaagttgctccctttatccccaaatcaaaatcaaagtatcatcacaaacatagattcacatcataaattctcaagaaaaaatacatcaagaagagttggaactgcacaaatctcttcccaaatcaagttgctccctgtatccccaaatcaaaatcaaaaatatcatcacaaacatagattcacatcacaaattctcaagaaaaaatacatcaagaaatacatcatgtttgtacatcacataatgaatcacaacttctaaaaattctcagatccaatgaatcacaacttctaaaaaattctcagatccatcacaaattcttaaaaaaaaaatcaagttgctgccggccggcagccgcgcgccacgctgctgcccgccacccgctagcgcggccacgccgcctccctcccatccgccgccgcccgcccaccctccgcgcggcccgccgtgccagccgccaccgcccggactcggccgcctggagaggatgaggtagggaggggtaggagaggtgaagggggaggaagaaggagagagatgggagacttctgagatggagatctctagagaggccggctgttaatttaatgcaaagaggggagaggaagggagagggggataagatcaatgacgacgactgtggactgatacagaggcgggcggctcggggtgaagtttagtcccggttagtataaacaaccgggatttttagtcccagttatttataccaaccgggactaaagataattggggccctgactcg

SEQ ID NO: 42013 - DNA, 26134 bp, Oryza sativa
ctggtttccttgtgtgctaaaattttttcaattcacttgcccatgttccagactaactgactgacccataatttgtagcacttttttttagatatcggattaaaccggcctctggcacacagccaaataatttatagctaaaattattgggttattgttctactaaactgatttttggctagctattttgaagcttaatttgaagcctaacttaatttgaagattgtgaggatgactaaaaccaagaggcttggagggaatcttctacttgtttaaagttgtcgagtcgagtagatgaccaattacaatgtagaagagatgggcaattttctgaaggaaaacctttgcatgctatctggtcttagtcttatggcttactggccctctattcagtagtacactattagctaaaaattacaaaccacgaagatgattgtattgtttgactacattttcatgctgaattaaatttagtgcaatgatcaagttgtggctggtacctctagctagctttatcgctagtttttgggtaagtcaagatttaggtagcaatggtttgtcgctttttatgatacttttcttaagctgagtctgacaacaaaatacagataagaaattattactttgtttagctctttgtgcaaaatctgctgaacttcactgcatttacatcagctgtttgttgactttgatttgtgttgatatcctgcagaagttgctcaaagaggactggcaattggcacctgaatctccagatggatgtgaaatttggtaatgtctatatcaaaccgtgactcctcgagtctatcgtattagcataaaaatatatatatgtagagtatatatatcttgtctgggatgctaattgagatcgatgttgagaaccatgtataatcaatcattataaaaatatatgtatgtgctgttgaatgtattttgccaaggcagagtgagcctgagacgtaaaactagacagccacgaaaactgttatcaaacaaacgggagtgaattctaatattccctcgtataccttttttttctaaattcaatgcaaatagttgtgaaaaattctgaaaaaaattgacaatgtacagtataatgatacctactagtccaccaaaattcaagttcaaatttaatctacacatcgagaaacaaaaaagacaattttagatataaacagtacgctactattcgtacgcttaatttgtcttttttatatctcgacgtgtgagttgattttggatttaagattttgtggagttgtatatatgtgttgtatgaatgttgtcaaatttttccagaatttttcgtagccgtttaaatagtttttaagcaaacgaggaaacatcccctcgagggattagaatagtttccctcaaacatttcacaagataccactactggtgcagttagcccattttggtgcctgtaggcagtagtaaaaatccttcggatgcccatatatcttcttccctgtcattttttcatttgcgcaattcaactacttgtaacaatcagaaacaggttccctcttaccctcctggttttacccatgctcacaaagcttcattaactagcagacaacacgggatagaaatcacctgaactatttcaggcctaattaagcggaatacatgacactggtccatgaattgaactattttgggactatacagattgggggctccggaggcaggttgttgatcctagcgtagtttcttcaccagctcatgctgtctgcaatcaacagcctagtagccgcgaaagtctttctagcacctaggtgctgcggcacctagactagaaatcacacgatggtttaaagattcgtgcgtcagatagtatacggagatgttaggatcgtatttcttttttttgagcgcacgctcgaaatacagcgctggcccaccagaagattcatatgggagggggggaccaatacgtgtgtacgacgcctcctattctcgtccacataatgttcgatacatccccagagtcatcgggaccgaatcgccacccgccgccgccgctgttcgccggccgccggccgccgccagccggccgcatccctgttgcatgttcctttggcggaagcggtgctccatccagtctcaccgagcctccggccgaggacttccatcaggtatgctctaggaatcccctcttccccaacccccgctgcccccatcccccgtcccctcctccatatcaccctcgttgagtcatcgtcctggactccgacgagcttccatcgccgcacatggaggccctgttggctgcggcggctgcgtgaagcctcccgtatcaagagttgcctccgctcacagacaccggcgagctatcacgggccagcaaacaagttataccgccccattcgccattcttgagcttcttgaagtgcagtttttcatccatgccgtgagcggacgccggcgagccgagacaaagaaacagcacgtgcttcgtgagcggacaccggcgagacgacacgagctgagccgaggcaacaatacgttaaggtcagcaaaacaatcgatgttttcttctcccctgccgcacaagcacgcattctttcgtcgccgccgccacagaataactccagggctttcaattcttcttagcaaacggcgaacgattttgtccatggttgttttttttccctacatttttctggaggaaagaaagaaaccacaccaaatctttttttttcacattttgatctactgaaaatgatttttcaatttcttttgcatgttttatattctcattacatgttttgtggggagattggcaggtctttgagaagagtggtttacaccaacggatccatgcaactgtgctagcagaagctgagtagcccataggccatggcggcgacgaagactgttttttttttttgtcatggaaaaactcacaccccttttctattcttttttataaaaattaatgattataattaagaccaaaagagccaatttttgggatgaggaaaattggttcaaacttaaaggaggtcttgttttatctgagctctgggcttcgcggagtacatctgtacctgctttctctgctagcaaaggaggatagcaagatgaagttggtagaggagacttcaaaccaaatacctcttgcttctttttggatgtaacttcatctaagttttccgatatttttcctctctcgaatacttttaatagcaagaatgtatagaaaagctgaataagatacaaaaatttggggacactatggacacactgcagaaagttgcaaactttgtcatttgactagcttttgttcaggtaggaggaactaggatgtactgatgattgaacaagcagctgcaatagctactccaatggtatgggatgttaagctcgaccatttgaggtgtcagcctagcatgttttttttgtaaagtgtattggcacactatggctgttgtatagtatgcacttatctgaaaaagtgacatttttggagtacattagaacaacaatggggcagcgcacagatgtaagctgttcgaaattcacaatcttacgtttcatggattaatgtcaatgttccagtgccaatcttttttgtggcagtggatgttggaattttagtctttctttattacaagcgattgatgttgtctggggtaaacaatagtatgaagaaaaagtccaatgatccgatctttgctttgatcaattacacacggaagaagatggatccaataactgaccaataaatagtctgtttgctcatctagttaaagcaaacaaaaagaatccaaatacaaacagataatagaacacctctgttatctctcaaccgatcatgaacagaagatctctctccttctccctccctctctctgtcgtctctctctctcccccggtcccccctctcttaggcttttggcagatcatgaacagagaagaagcacttgcattggcaaagcgaatcagaaagaaatcatggaaattacatgtgctccacttctatgttggtcaaatctacattttatgaattgtacttcctccgtcctataatataagagattttaagtttttcttacaacgtttgatcactcgtcttattcaaaaaattttgaaattattaattattttatttgtgacttactttattatatacagtactttaagcacaacttttcgttttttatatttgcaaaaaaaaattgaataagacgagtggtgaaacgttataagtaaaaactgaaaatcccttatattatgggacggagggagtatacttctaaatcaccttgtattacctctaggccaagtgagaagagcaagtagcactgtgtagcagagcaacagcaaagaagcgactacactagcaacagcaaagaagcgactacatacgctcacagtaattaattagatatttagatgaaacacatcctaatatatttcgatccaaaaattaattattttgctttgagattaatgagcaatacactaaaacatgaagagaaatttaaaaaattgatgataaatacttgagctggaacatgcagaacaagatcagcaacaataacactagcaaaggttaatggaaatctctaacagctcggtatatagacgtcctctgcccgaaggtgtcgatggatttcctcgggacggcgccgcccggcgaatccacccgcctgttctccgacgacgagctctcggccgcgacgacgacgctgccccctgcagtggatgccaccgaccacgtgctcatcgatagcgccaggctctgcccatgcgagctcgccgtgcccccggcgccgccgccgccgccgttgcagctccccaccagcacgtcggagcacgcgtagctgctcgcgctcgcatcggtgctcatgtcctgatcagcgtgctgcggcggcgatggctgcggctgcgggtggttgctccagagccacgtcttaatcatggacagttctatggttccgccgccgcatccgccgttactgtaaccaccggcgccgttgacagtgcttccggagtagaggtatccgctggcggcttggccgtgcacgtcggagaataagttgccgtcgaggaagttctccagcttcggcgcctcgccaccgccgtcgcccaccgtcctcctcccgccgccgctcgagccgacgagcatcgagaggtcggaggagccaccgccgtagtccaaacccctcagcgcccaatctgcaaagcacgccagggagatcaccatgcacgactcccccaaaattcgctgcttgcggctgcaaaatccccatcaaatagctatacgggtattctcccctgccaacaattaataaaacagttttctctgctcaccaccaagaacggagattgcgaaacgaaagaaaatacaagaaccaccaaaaaagaaacacagctcgctggctaatacggagactcattcgaacagcacggggaagagaacacttacgagatttccaccatgggagatccggtggacgagccgcagctgaggatgagatctgtgtaggacatcgagctcgtaaggtggtgtgcagctgtgcgcgggcaagtggttggacacaccaatcacatccgccgccgtgtttccatcgcggatgggatcttggggaacagacggcttccagttagactgccgattgcacgccatggccgccgcgtcggcgagcggggcgggtggtgggtggggggagaaagtggccattgagctcgcacgatcttgttgcgcgagcatgttgttggtcaccacacccccatccaccgtcgtgcatacctcgccggtgggatgttggagaacagccggcgtgcaccccatcgccgcaggagcggcgaggcggcgtggttggggcgggggtgaaagggggaaacagccggcactgcgcgtcgtcgaacacaccggcgagatttgtgttcggcaataattgggaggggccaatagtactctctctccaacgtgacgcgctggcccacggagcgtaaaagtagtactttgtatacccaatacatacggtcagcgcaatatatagattgaaatacgtcccgaccactttacaaccggcaccaatcgcgggatgcatctgacggctcccagcctactcctctttcagtttcacctgctgctcctcctctttcaccggctcctccattttcatcttcatcttcctccattttcattttcatcttcatctcacattccaactccaacccctccacacatccactcccttgtagtcgtagtagatgtcataaatcttccattcactttgggattttttttttaaaagactcaagtatatatgaacctcggcaacacggtttatcctctccggcggcggccatggcctttgatcgatcgatcgcctcccctgcgcctcgccctcgaatccgattgatgtattgtcgatgcggcttgctggatcgaatgctattggatttggggattagggtttggaagccgcgctgcattctgcagttttgccaccacggctcaatctaaagacaatccaacgggtactatacattggacttccgaattccgatcggacgacggacgagataaacctattgacttagtcaaacgcgcatctcttgatctcttctcccgccttcccccgtctccgacgtggacatcgaagtacggaatacggatcagaaacgacttgaagcgcctcctcctcctcctcctcttttaagcaaaccggctagcgaccgagcgagctctgacctctgaaatcatcgcgtaatcaagtgcaactacttcctaataaaccctataacgatccgatcccctagcgggagcaagaacacgtgaaccctagggcgatccgatcccctagcgcgagcaagaagacgtgaggacgatgagcatagccgtagtgatgaacaaaacgagcacggtagccatggaggatcgccgctcttatgcgatccaccgcactccggcgttgccacgcattgtcagcaattcatcctctgtcgcgacggcagaggacgcccacagaggaggtaattacaagcagcggccgatatgccggggggacgagcggttgccgatgccgccgctacacagcaagcgccgccgcgacgaacaccaccgccgggactaccactacgacgacgacgactacgcctatcgtgcgagcaagaagaagaagcagcaggcggccgctgaacaggcggcgcgcatgccgaacaacaggacgaccagaccgacgacgcggcgcgcgtcgtcgtcgcgctcgcgcaccaaggaagagagccatgcccgcggtggcggcgccgcgccgcgacgcgagaacaaggatcgcaaggacggcgccggcgggcgccgctcgcagcggcgcgcaccgacgatcagcggaccgcgcgtcccgccaccggcgacgccgcctccggcggcgctaccggactcgttgacggcgcaagacgcgctgagcgcggccgcggcgagagcgagggagatctcgctgatgcgggaggaggcacggcgggagctggccaagatggtcaggaccgtcgagttcaacgatccgtacatctcacccatggacgcgctcaagccctgaccatggcgtacgtacgcctgacaatttgttttagctcttcttaggttgtgtttggtacgaggggtgcacgtaaaacagaactactcatcaccgatgattaattaagtattagctggaatatttaaaattagattaatattatttttataacattttttatatattttttaataaacgtaccatttagtaatttagaaaatgaatgggtagtgctgaattcagccttactgttggacacgcgtatatgttaattcagcatatcaatttgtttagccaatggcaaaatttagaagtcctatgttgaacagctgtactatttttgtgaactgaacgattggtctgatctatctttgaaaaataagtgccgatttatttttgtgaagcttaattaggttgatcgattggtcagaactcgggtgtaattcagcgtagagttgaagtaggtgatcatcagcatcactagttcagtacttaacaccacgcacatggcacatgctcctcgaataaaaacctgcatgaaaattaaagcacatcaatggtggggattaaaagtggattaaccgagcttccgatcgaacggacgagatcaaatcaaccaacggaaacttggcaaacgcgctacccccctcatccaattctcccgcgcgcgcgagacagcgagaccgactccgactcgaagcgccgcctcctcttaagtcttaacccaactggtttgagatctgcaccatccttcccttcgcttcccatccactgcccaactccctcttcctaaaccctggagagctcgcgatcctccactactccgatcccctagcgctagcaagaagcagccatgaagatgatgagcatggcgcagatcatgaggaagacgagcgtggtcgtcctgcaggaggaggaggatctcacctcctctgcgacccgccgtgctccagctccgccgcctcgcgaggtagtacgcgtccgcctccgcctcacccccgcccctgtcgccacggcggaggacgccgccaggggaggcaagatgccgccgccgccgccgctccccacctcgtgcgagcaagaagaagcatgtgttgagcaagaaggaagaggcggcccttgcccgttgctcctccgccgcggcgcgacgcccgatgatcaagaactgcagcggcggcggcgagcgctcgcaggagagcgcgccggcgccgtcaccgtcgccggcgaggctgggctcctcgacggcgcaagacacgctgagcgcggccatcgccgtggcccgttcggtcatggacaagcggagggaggtctcgctgtggagggaggaggcccacggcgggagctggccaagatggtcaggaccgtggaattcaacgacccgtacatctcacccatggacgtcctcaaaccctgatcgaacatggtggtgccaagaattttctttcttaagctcttgttggggttcgagatatgaaattattagccatgtgtttattgtagtgtttaatgtcgaaatcattggcaattttgttgtgagccagtggtttaacctagaattcttttgtacattgaaacagacaaatgctctgctgttagtagtaattatgaactgcatgtaatatcagatgtacttaacaaacattatctattctgaactgaagagtactactaagttttttttttcacgattgcaacaaaattctgtcgcgatgcggattaccactcattatgagctttgaattagttgggccaaaacacttagttcgtgggcctctcagcctacaaaggcaggcacaagctgcccagaaccagaaccagaaggcccagtggctagccacgcacaacccctaaacccggagggcctctcctctccgacggcggtagcgcggcgtgggcggcgcgcgcgctccggcggccaaggctacggcgccgggtgcagcggcgcgggaggatctggaagggtgcagcgcgggaggagcacagccgccgagcccttgctgcgggctgcggcgcggcggcggcgaggcggcgagccgcagggcaggccggcaggcggcaggcggcaggcagcggctgagcggcggccagcgtcggcgtgtgcggcggcgactcggcgtcgacgcggcttggcggctgcagcaggcgcgggcgcggcttggtcgcttggaggcttggccgccatctcgccatctccgtcgaccgtcggccacctcggcacctccttgaattgtaagatttcttcccaatttattattttctatcattttggtatttcatatgttggcactttgatatgtttaccaattagtatttctacatatttaccaattctatcaatgtgtgaacttatgatcaattttatgttatatacgctaaatattgtaattattagtgtgttatactccctccttctctaaatgtttgacgccgttgatttttttaaacatgtttgaccgttcgtcttattcaaaaacttttgtgaaatatgtaaaattatatgtatacattaaagtatatttaacaatgaatcaaatgataggaaaagaattaataattacttaaatttttttgaataagacgaatggtcaaacatgtttaaaaaagttaacggcatcaaatattttggaatggagggagtactatacaagctaatttttaggctattaggtgtatgaacaaattttttttacccccttgtcattttgaatacacaagttcaaaaagctaggcccacagctgaggaggagccggcaagccttcggtggtccagccgtccagcccgctagggcgcggcagcgtgggagaggggtgggggggggggcgccaggtatcaactcctagctgctagggcgcgggcgctgcggcgtggccacggctcggagcccaggacggacctacggccgaggaccatctgattgttgtgagagttctgaggtgagtggatgaaatccgtgaatcccccccattctccaattgaaaatttgaaaaaaatgtgtagtccctgaatgaatgttacggttgttcatcaatccatctatctcctgtgataattttcatgtcattgtggactgaaattttgatcggtggtgttgattgtcaaattgtgcaattttaggatgatgacatcatttctagattacaatgcatgacaaaacacaaagttaaacggtactctctccgtgaattcacaatgtaagactttctaacattttctacattcataaagatgttaatggatctagatgttcatatgtgtctagattcattaatatctatatgaatgtggataatgctagaaagtcttacattgtaaaacggagaaagtaggtttcttaattattttgtagtttgttaatattagttgagattccactgatacaaactgtttgtattttgatgtatgatactgtgaacttttcatattgaataataccttgttacttcgaatacccagccgtgcaattctacatccactactggctgttgagaaacttggtagcaatcacaagaaagagcatcaagaggcagttgctggcactgaaagtgaaaagtaagttctgaaaatcaattcggtttttcttactagtttgttttggaaaaatgtggaggacagaggacagagtttaaagttgaattgaatcacttgttaccatatcatactcacaattgagcctctcactctgcacgaacagtaggtagcacacgaagctgacaactgggccttgccttcaagttttctcaccggatgcttgccacccccacccactgcctgagctgacactccggttgcagaacctcgacctgctcttctgattgcagtcagctctcatcggagccacagcaactgctacataatgtctcttgctgcggttgcttctccacatttcccaccgtcatgggcctatcagatccgtatggctgcttcccagggccaatttctccacgccatctctctcttcctacaaatgcgtgcctctgttgcgccccgatcatctgttccggcctccctccctgctgcactcaagtcctgcgccggccttggcctctgcactcttgctgcatctctccatgctctcgccatccgctccggttccttcgctgaccgctttaccgccaatgccctcctcaacctctgcatcaagctcccaggttttcatcacccctttgggacaaatgggcctctggggaaggaggcctggaatcagctgcatatgagagcatgcggaaagtgtttgatgaaatgctcgagagggatgccgtgtcttggaacactttgatattgggatgtgcagagcacaagaggcaccaagaagctctgagcatggttagggagatgtggagggatggatttatgcctgacacgtttacactgtcaactgtgctgccaatctttgcggagtgcgctgatatcaagagaggcatggtggtccatgggtatgctatcaagaatggatttgacaatgatgtttttgttggaagtagcttgattgatatgtatgctaactgcactcaaatggattactctatgaaggtgttcgacagcttctcagactgtgatgcagttctgtggaactcaatgcttgcaggttatgcacaaaatgggtcagttgaggaggctcttggaatattccgtcggatgctgcaagctggagtgaggcccgtgcctgtgactttctcaagcctaatacctgcctttggcaatttgtcattgttgcgtcttgggaagcagctgcatgcctatttgatccgtgccagatttaatgataacatatttatatctagctcccttattgacatgtattgcaagtgtgggaatgttgacatagctcgtcgcgtttttaatgggatacaatcacctgacatcgtatcatggactgcgatgatcatgggttatgcattgcacggtccaacaacagaggcttttgtgctgtttgagagaatggagttgggaaatgtgaagcctaatcatataacttttctagcagttttgactgcatgtagtcatgctgggttggtggacaatggatggaagtattttaacagtatgtctaaccagtatggatttgttccatcccttgagcattgtgctgcacttgcagacacccttggtcgtgcaggagatttagatgaagcatataatttcatctctgaaatgaaaataaaaccaacttcaagcgtctggtccaccttgttaagggcttgcagggtccataaaaacactgttttagctgaggaagtggccaagaagatctttgagcttgaacctaaaagcatgggatctcatgtaattttgtcaaacatgtattcggcttctgggagatggaatgaagcagcacagctgcggaaatctatgagaatcaaaggtatgaagaaggaaccagcttgcagttggattgaagtgaagaacaaattgcatgtgttcatagctcatgataagtcccatccctggtacgataggattattgatgcactgaatgtttactcagagcagatgattcgtcaaggatatgtgcccaatatggaggatgttttacaggacattgaagaagagcagaagagagaggtgttatgtggccatagtgagaaacttgcaatagtatttggtattattagcacgccacctggaacaacaatacgtgtgatgaagaacctccgagtttgtgttgactgccatatagcaacaaaatttatttcaaagatagttgcaagggagattgttgtccgtgatgtaaacagattccaccgatttaaggatgggaattgttcatgcggagatttttggtgattcaggatgtcttcaaaagattgagtgcatgcttatggtcgatatcatgcttgagcacccctctccagggcattatggtcgatatcatggttgtgttgggtcttcttcagtcaccatctagtgctacatgtactactctgcagctcccatttgccataggcacatgtttgcaagtgatctgaatgccattgccataagcaggggcagccgccactcgacgcctctgccatctacaattcttctctccgccacttcgaaatcaggtaaatcttttctttatgcacgcaagatgatcagctaaattaccaactgacatgcacaggaatctaactgactctgattcttatttcccttgacctctcccagtgattccaagttccccttgcattctataagcctgtcttatgacaacttggcatggatgttggcgctggtggagatcagcgctgatctttggtcaatacgatcggcactccaagggacggaagagattggctgccttgtttatttcccttgtgtgatcaagctttttgttttggaggaatgagactgtgggggtgaagttggagatcagttcatgtacacttgtccatggcgctatcacctgtactgtctaaatttggtaagagtatttgcaatccactgcatcacctcctgtgtaatcttctaattttcttctgttagattgaaaattttgcgcgacacttgcatctgttgtacgcatagaattcatttagttgagcttatatagtagtataaatgttcttatatagtcaaatttgttgagtttgattcatttcaaatagatctcatgaaacaccggcagtggtttcagtgattgggtttattgtgccctttttcatatgaaatttctcttactgtttaacttgattcttcaaacacatggatgtacaaccaaacaaatttgaagcctacattccttctgtgtttctcccatttcaaattccaacaaatgccgattttattcatagtcttgacgaaaagatgccaagatgccgttgaatttatcagaacggtatttctcccgctttcccctgctcttctccgcctccccggcgaccggcgacgctgtcagccgtgtctccgcggcattccgtcccgtgcttaacgacaaccatgcacggcctggatgaggtaccagatacctcgtgtggcatatatgatcagaacaatttttttgatcatgaacaggaaaatgaaggaattcctatattttgatcaccatctgtaggcacgagcacatgatcatctgaatttttttttctttggtaagatactaattgcgttcagacaaaacaggacagaagtgaactaatgctcaagcttgtcagaacaaagcagactttagagttttcttttaaggggtgtgggggtaaagttttagcgtgtcacatggggtgttcagatactaataaaaaaactaattacagaatccgtcagtaaacaactagacgaatttattaaacctaattaatttgtcattagtaaatgtttactgtagcaccacattgtcaaatcatggagcaattagacttaaaagatctgtctcgcaaattagtcgtaatatgtacaattagttattttttagcctatatttaatacttcatgcatgtgttcaaacgttcgatgtgccagggcgtaaaatttaggatgggatctaaacagaccctaaatttcatatattcttcgtagctcattttctttgacgtgtatttttgtgtcttacatgtaaggtcgtagctcaattcacaatccatgttttcttctctcttcagaccggtggtttgttactcaaaaaatatgcagtgctaacttggcaacgcttccatagttccatccggaaatggaaagcggcaaagcgccgacttgaagcatcaaacgtctccttcccttgtatataggcaaaggcgcaggggtggcagccatctctacatccatcagttcgcgtgagcttcctaaaccctcgagaaaacccagagatcaagaagcgaggagcaaaaagccttggctaagagagacacgagcatggccgcgccggcgccgccggcgccgccacctcggccgccgttcaaggtgcgcatccgcatcaaacccgcccgcgccgcgagggcggaggaggacgccggcaaacaggaggagcggcttccgatggatcacccgctctccaccaccaccaccaccaagcgccgccccgagggcgaggagagctccggcgcggcgagccagccggcgccggagcgcgtgaatcccaccgggacaaccacgccggcggcgcgggcggcggcgtcgtgctgcgtgaatgaagaggccctggccagcagctcccacgccggcggccgcgacgacggcgcgagcgcgatcaagaaatgcaaggacggcgaggggaggcaagaggacgccaagaacgcgcaagaaagctcggggatgacaagcccggccgtgcattccgccagggccacctcaccggcgccgccgccgtcgcgcacgaagaaagagaccccggtccgcgcccatgccgccgtccgcgacgacgacgcgacgccgccacgcgcgatcaagagctgcaagaacggcgagcgggggcaagagaaggacgccgagagcgcgcaaggatgcgcgaggacgagaagcccgccggtgcgttccgccagggccaccacaccggcggcttcgccgtcgcgctcgaagaaagagaccccggtccgcgcccacgccgccgtccgcggcgacgacgcgacgccgccacgcgcgatcaagaagtgcaagagcgacgagcggaggcaagagaaggacggcgagagcgcgggacaatgcgcgacgacgagcagcccgcgcgtacagccctcaccgacgccgtcgccggcgccggcggcgcggccggatcccagtgcggcggagaactcgctgcgcgaggccattgagagggcccgcccacacatgcggagggacatcgcgcggcagagggaggcggcgcgacgggagatcgccagcatggtcaggaccgtcgagttcaacgacccgttcatctcaccggaggacgtgaacaagccatgatcatggcgtcctcctaacaaggtcttttgtagctcgttttagggttcgtgatctctagttgttaaccatgtgttagggttgacgccattggcaatcggctgtttttgttgtaaaccaatgcctcagttcatgattcttttgtcgaaccgagcaaattgctctgctgtacattgcctattctgtactgagtgacgtaatttcaaaagatgaatgtcactatttccgttgagattgattgttcaaatcagtagacatcgtgaacattaactgattaacaggagtgtttcgtccgaccagttaatacagtatctacaaacaaattttgcatgcgctgaattcggtgaagtatcatgaacatgtgggctagagtttagggcttcagaactgcctgaggggagcaatgggccaaaccaaactgcacatattcaggtccatagtcctctatgaatatatattgaacttattgtatgtttgatcaaagttgtcattacaatacgcagacaaaatcaattcatattcagaatacagatacattgcgtaacaaaatcacttgatcgaaaaatttctcagctttggtgaagcattatctaaaaaagtgttgttcagggaagagaggttgactgtcaacgcaaagcagaaaccaatcagctcaattatatcctcgccaatgctgcaggactgattggaatgatgccagaggatgagaccagagcatcaataggaacatctgttgagttgactgggatgatgccttcctccaaaatttgcaccgagtatgaaagcgcgacttcaaaatagaaaatcaggccattagtctatcatttagcaataatagtgctagatcggatttcatcatttaaatgtaactatgaactgcaacgcacaaaagtgtgcccactaggtatacgtatttcatgggcatgtagaagtaaatgaaatgcaattacaagctttggttcagttaaattataatgtaacttctagttgacttgttaattcactacgtgattaaggaactagtcaccacaatttagtttctggttggaccaagaatccctgatacccttcataaaagaatctgaaagcttgttgggatctgattatgaaatttggttcagtattgcgggccaaacaaaataatcattgtagtagaaaatacaaaatagcatgttacatcaaggaaccaacagaacatattaggctaccaacaggttggcccctctgttcatggtgttggtgctacttcaaaacagctcactttggtcctgtttttgacattaagggaccaatagtaaactttccgtaactataatcaactaaaatgacataacatgtcaacgatgtgtaataacaaacaaaaagagtctaaagtaaacaaaaacaactgaacttctggaaatctgcacatcatacctagaagaggctgatcccaccctttctctttagcaagttcttgatatctcatcaagaatgtgtcatagtaccttcgatgaacaaacatacaaatatataatttagatgaaggaaaaatttcaggctttggtctaaacaatactaagtcaaactggcataaatgaactattggtgacaggatggcattaaaaagatttgaagttcatgtgccccttgccattatatgcattttagatgcacttgacgaattgtggaccattaagcagattgtgttaaatcaaatgagatacagccaaagcacaaaactaatatgcagagacatcatatactttctccctaacagaggaaataaaatgcacatcatagagctgtggaggctataaaatctaaaaaagaaagcaaaggccgcacccacacgaatagcctgagttcttcaaactaacagcgaataaagcacagaaagtaagttatgaatctaattgtcaagatgccaacccagattccacgacttatgtttacacagtttagtttctaaatccacacgctacactgcaaccattcaactaccagctcttacatttcttagatgttctgcagatgttgtgacaggtatttgatttgtgctgctagaccaagaactttcatccatgtggatcaccctacaacaagtttctgcatctataaagtatgtttaatttccactgtggtaggtaacttttctctattacttgggctgctaatacactagagcatccttggacttcattttggaatgcttgcatgccaaatattcagagttagcaaaatcatgacatgaataagttgttgaataggacccaaagttagcaattgaaccactgcatagatattggatgaagatgacactaacagtatttggcaacttcaatacaggcagttattaaagtgaaagatagaataatgtgtagacctaccctccaccacgtcctaatcttcgtccagtcctatcaaaagcttgtcctacatgaataacaatcattattcaattgaatgttcagtgatggatgcagtgtattaagagattgaagggcttaccaggcaatagaaaaagatcaacaggggaagaggttgacaacactgtaagcattaaaagaggatcagtgtaatgcatataaatcatattagctacccagtgatgcactaacttaatcaaccgaggaaaagtttcattgtatcacctagataaacttcataccttcttcacgagcattcccactagcatcaagtggtgatggttctagaatgttcattgaatttttaactaaatcatccatggtagtgattttgagcatccgcatattgcgattcttatcttccactcgaggaacataaagatcctttgcatgtccatgttctgaaacaaatcaaattgttagaagcaggagaaatcaagggggcatatctgtatatagtactcaccagaatttggggataaaacttctgacagtacttttgatgtatcaacttcccgcaattgtgcacagcttatataagcacataaccgcttgctttctttgaaccaagaagagttcaaaattgcattttgaatagcctggtctggaaatataagaaaaaacacatccataaacttcgcaaatcaacacaaacaacacctgttgtgttccagcaacagaagcataagtagcactgacgtccgcattacacttcaggtctttgaagagaaaaattaacaaaacaaaaatctacttcgttgcagttacagaagatggggggggggggggtgtggaaacaacacaaccaaatatagttggtccagctacagaagcaaaggtagcaacccttttgtcttggtgtccttctgtgattttctcatgacaggcagttcgattcaattgttaaacgacgcctgccatcaggttggaatgtccctaatgtgatccttctaatgctagctactgatgagagattgaagtgtatcgccaagttaaattttgcttgcctaatgcttattcagacatgattttatcatccttttctgtgagcgccaatactaatagccagcacagtaaaagcagcagcccttgtcggcaaatcgacgagcagctggtggccaacggctcaatcgatttacatcagggacagcggaatcagatgcttgggccatatgagcgagaagggggatcaccttcgctggcgcgctgctcgggggtgagggccctgagcgccctccgcacctcggaccgcagcgcgcgcttctggtcggcgacctcctgcgccgccgcggcactcgacatggcggcggcggcggcgggcgccggcactcgtagccggagcgaggggaggagggcaaggtggtggcggcggcgggggtaggtgggggcggatgcggcgcggggcaggtggaggaggcgcaccatcagcgaggccgcgccatttttaatcattgccagtgtgtgtgcgcctctgccttgctgccgtgtgtgtctctcaccgcgcggtcatctctgccgccgcagcgggtggagtcggagtgggccgggccgaaggtaaggcccagctacgctcgacgaaacctgattagaatggaaaaagtacaccgaaggtccctcaacttgtcatcgagttacgaaatcgtccttgaactgcaaaaccatatacaacacatcccccaacttacaaaaccagtgcaaacaatatcccacggtagttttgactccggttttatcctatgtgatggctaaatcagcgtaggatctacgtggaccccacatgtcagggtggccatgtcatcatcttccctctttcctcccttctctctatgcctctctatgattttcgatgaatgaccctatggtaatgcttttatctctattctatggaccagtcaacttcactaatgaaaacggattacatctttcaaaatattatttagtactacctctatctaaaattctttatattattggataaatggagtataagattaggtgataaacatgaatagtattttatgtgtgactaatttttattttttttataaattttttaaataaaacggatggtcaaatgttggacacgatacccacgacgacacttattttgggacggaggtagtaatagtaggcttgttctattagggcaagtactataagcccctacatactgctcctaaatttgctacataagattagatgatgaggtggaggagagaagttaggagagagagaatgagccacgcctcatgtaaggagtaacctctacacaatctccaagaaaagtgcaagatgatgtgagagtagactaatattggagtttgtgtattatatgtgatatgttgtatgtgttacctcttaattaataagaatatgacatggtctaaattagatgtgacatccacctccactataaaacttgccctaagctcaacgatccccacaacggatcacactcctatgacataaagtcatagggacgtgggtcactgacgtgtgggcccaacccttatgggtcccacatgtcagtgacaatgtccctctgactttacatcagaggagactcatcccacaacaacatggactggggtgtggaaattccatttggattactttactactagggccttgtttagttctcaactttttttttcaaacttctaacttttctgtcacatcaaactttcctacatacacaaactttcaacttttccgtcacatcgttccactttctttaaactttcaattttagcgtgaaactaaaaacaggctgtgtttgcaaccccttgttcccaacccctctccctcgttttccgcgcacacactttttaaactgctaaacggtttgttttttaaaaataaattaatacttaattaatcatgcgttaagagcaagtttaatagtagtatagctaattactagctacaattcatctatagccaatctaataactcattcatacaatagttacatactacattattaatacctagtcccacctgtcatatacacactgtgtcttggaatccatgctacagctggctataaatctgtagctcgctacttttctttcttcttatttatctctttaaaatatattttgtagctagtttatagtctgctattgcactcgctctgatgaaccgctcagttttgttcgcaacgattcatggcgaacacacccacagcctagttcagaagttgattgcgaagcttccaggagaagcctgaggctaacctctgttctttttctaacagctggcacgaaaaagtaaggcgcggtgggggtggatggcatgcatacgtcaccggactccagactcgatggcccacatgcagtgaaacaggggtaggattgttgggtgtaaaggttctaaatcgaactgtgcgtggccgttttgatccgacggtcacaatcaactggaagctaatcggacggcccatacgatcgtgtggcacagcgctcgaggatacaaatcacgccttcaggtctcacggaccacgcctctcctcttctctcctcgcaaactcctctgcactactgctttaccctctcccagtctcccctcccccaactccggcgatggccatggcggcaccggcgcgcgacgacgaggagccccaggacggctactactccatcgtctacgagttgcatgctccgggggacgacgagtggctgctccggcacctgtggagggaggcgcacccgatggcgcaggcaggcggggaggccggggccccggttctcgggaggatgatggcggcgatgaggaggtggtggtggcgcgcggatccgcagctacatctcgggagggcccgtctgcttctccgcaggtggagggcgggctccgcctccgcgcgccgcctcgcgaggtggaggagggagggcggcgtcacgccgcgggtgctcctgcagtctgcagaggtggtggcggcgcgtccatccacaggtcgtgctcaggggcttgacggccttgggggtcgccaccatggtcttgacgttcctcatcctcaaggacatcgaaggctacttcgacttcctcagcatccgttacccatttggtaaatccatggcttcaagtgttcaactaggtcgtagctaagcactaatctctggctggatcgctaactaattagctacaatctgtgtgcagcgctgccatctttcttcctccgctacgagcgggtgatgcacgacttcgttgtggcgggcgggatcaccgtactcaccccgttcatctggggcgccctcgtcgccatcatggttggtctgggcgctgacatgggcccgcttctggagttagatgttcttggtattaccgatcgattttgctatatctcactcgaaagatttttccttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattacggtgtttcttaattgctttttctttttattatatctatcggattttaatccaaagattaaaaatctgtgggatacgatcataaaaatctttcgaaagatgtataggtactcccattaccgatggtctgcagctagatggccgccctgtggtgccggagccggagcagcaagtccatcagccggatccggatgagcccgagcacgtgtaccgcgtcgtcctgcacggcgaggagttcacgttcctcaccaacattccgagagccaagttctatctcctgatagctgctgtttttgtcgtcgttttcttgttccaccccttcagcgctgagacctgagagcggtatgatcctaatttcttattactatacattgaattcgtgttactctgttgcatttcaatttcgtcgccgacttcaaagcatgtgcctgtgtattgttcgattgcttgtacagatttgttggttggcgatgagtgatagtgcttccaattttagatgctctgatgttcagttatgctgtgattgcatggttagcaagcagtccatatgtcatttgatcaactgttgctttctttcaggagtacagtaaccacaccaattttttgtgaaatttgatttcgttcctagacatgccatttcgattgtaaagctatgttaagaatgcaagtgttccttaccaatattgtgtgcaactgcactaatttgctgtgcatgcttgttcagtagtcaggttttaagccacctcttgcttttttttaagcccttgaagttacaatgcatttcttttgttatggttagctatatgaccattggtcactgctgcatgttaacttgttaaattgctagtgtccctaccaaatataccaactgcatcatcgagtgctgttgtgattctaatccctgtgcagctgtgcaatgatatgttggggcatgcttgtacaaccatataggttcctgtggcttataatttcatttcttgttgtgatgcttatctgtgcagttataacccatagcttagtgattcgatttctggatcaatatccactgcagttatagtacatttcttttgttatggttagctatatgaacattggtcactgctatactagttgcaactgtgcctaccagaatttcttttgtgttgtagtgattttaagtcctctgtgcaattatactgatctgttgggcatccttttgtgcaacaatataatacaagtccctgtggcttaatggttttgtttctagttcaatgcccatcagcccattaccattagtgtgcgtctttaattttgatctattttgtggcttctgtgattttaaacccatgcctaactgaacaattgatgtgattatcagtttgttcatgtctcaggggcgggcgcttctaacaaagttggggctctctcaaatcggcgtcatgtctttggtttcggtttcaatctttagagtacttctcctcggctacggttgtgttactttggctagctgttcgcatgttctgatacgctaacgttctggtcttttactcttttgcaacaacccttgatggaacattacataggaagtagctgctggagtagtattaagaggcacttagtaccatctgagatctgagaccaccttagttggaacactattaggaagtacctgtcgtagttattacactattactcctagtaccatctgataactgcgatatgtgactttacctgttttgatgcttgtcaaaactagtagtagtactctatcatatatgtgctgagatgaaccattgcaccatatatggtgcaagctaaacagaacattggagtgcagtctgctttttcttatgcatttttgtcaagctgaaatgatgcatgttctcccagttgtccacaccgctcaatgtacttgctgttgtcgcttgtgtaatcagatattaccatgttctcccttgaaattaaggaattagtcggccatatcatttatgttggttcaaatgttgagagggattgaagcggtaacactttgtttggttttgtcactatccacaaactaatcgggggctcggggcatgtttggtttgtactatatgttgtgttacaaaatctgttattctttaggggaaaattctattgaattgctctgtggtgtttagtacacgaactatgtttataccggtccaagctctaggtgggcctatgaaaaacctggtttgttttgggctaaaatccgtgtctgaagtaaccaggaataaaggtgtcgcgtacaaatgctgtactaaagtagagaaaactaaatcatttctttaaaaaaacacagtataaatcgttcccaaacgcccgtgtgtttatcctataaacatatactctatccctatgagcacctctagaatattggactgttatattttgagattgatgaagttgctgcaagcgtctcatttggactcatttggatatgtttgggcagatcctagtttatttttctctgttttagggtgggtattaagccttacataggatatgttgaaaagaaaagaagaataacaaacgaaaaatagttcagaaaacgggtcatcgttgcgatcgaactcatgaccccttttcgcatgtataaaggtacgatcatacgataaattcgtatgttatatatcacattaaaatattagtactgataaattctacaggtcttttaaatactcatgaaaaatctacagttagacttaaatcctattgccctacaaacgaagcaaaaggtaccacaaatatcgggtctccgctcggtaaaaagatattt

SEQ ID NO: 42014 - DNA, 5886 bp, Oryza sativa
ttgatagtcaaagtttaaacaccttaatagttcgcgaaacgatactttttaagaggaagtatatatgggatccggctaacaaagaactactccctcattcctattcaaattcgtggtactaaaaatgttacacccgatcaaaattattataatatgcaaaaaaaaaatattaaaaaaatatttgatctaaccatgcaactaataggtgtgacataacatagtaaatgcatatttgatcaaaccttataatctgatagtatgtttttacaaactaatgattaagtttttatttcgacgatacagtacttgaaaaaacaaaacaagtagatggcttgccacagaagcaaacaaccgaaattttcatttgtagtaatattcttttccaaaattaattaaatagtaattctaaatagggattttgagaaataggaaggacgccagttagaagagcgtccacatgcggacgcttgggaggatagcgtccagttcgggacgtagtttgtaacagcgtccagctgtttgggccaaacacagcatgggcctgcgtccatgtgcatgggagcacacagtaaacacttatataaaccaaatctttgaacatccacgtggtgtttactgtttagcttatagtccatataatttgtttagaacaatcttatactaacagatattgaacaaatttagtacttcctctgtttcacaatttaagtcattctagcattttccacatttatattgatgctaataaatctagatagatttatatgtctagattcattagcatcaatatgaatgtagaaaatactagaatgacttacattgtgaaacggagggagtagttaatttcagtagtatgcatattggcttcggtcctttaataacgcagtagtctaataaatccatggatagtttgtagccgttttcaaccaatagataatgtcaacgagctagctatcaagaaattccaccagcaacaccacatgacaacaatagtataaataaaaaacccagggtttttcctcaattgcattagcatgcatttcattgaattgtggtggattatctttttttttcgaacggtcaggccgttgccgacgttttatataaagaagaaggtgtctcattttaaggagaaaatgagaccaaaccttacaatgcatggttaattagggaaactgggtgaaaacctcaacactcaaacctaagctaccaacaccgcgaaaaaagaaaaaatggcggagcccaaaacagccatcgataaagagcttgttgaaagcgacacaaaggcttcgacttcgcgaggcaagtgttatcgttgccgagcttgtcgcctagcgacacaacagcttcgactccagagctatcacatcatcgttgccaaaggcatcgaagaaaacgagcaagacaccgaatgtccactttgaacatcagcccaagccacttgagcactactacttgtagatagctaacaccaacctccctcgaaaactgcaacgtgttatcgttgccaagcttcatcgcatcccaataaagcagcttcgacttcaccttgaagaaaacgaagaaagttggatgcttgccacatccaagagcagcacccaggagacgaaggcctcgccgaatagctaggcttatagagctttgacatgggggtccattgtaaaatcaaaggtgtttttgattattattctgtgatgaacaattggcatcggaggttattggttttgttatttggaatttattcacgaagtggttttggagatgattggattttacaggtgaatggctcctggctctcctcaagctaaatacctgccaaactctttttttttaccaaactcttaattacagtacaaagtagcacacaagagttaaggatgtgtttggttgggcggacgcgcgcggcggtggatgcgagcggtggcggcggcggacgcactgcggcgtgcggcggcagatgcgggcggtggggtgaggaggagcggcggcggatgcgcgcggcggcggcggcaaacgcaggcggcggggtgaggaggagcggcggcgacgacgaagtggggaggagaaggagcgacgcccgtgggaaaaaaagaagcgcgaaccgttttttgtgtaatggcagaggtgggtaatttttcccccaaaagcagggggtagaggtgattttgatttgtactaccttaaaagctggctttgggcaaaagcagctgtagcttttgggcgctttggttggcttttggctttttcaaaaccaaaagcaggttgaaaagcccaaccaaacacaccctaagggtgcattacgaattgattctcggattggctactccctcacctatcataagcacattatccgaactgctaaaggatatattttttcaaaatagcattttatataaaattacttaaaaattaaataaatctattttgtttgtactagttaagtttcgggtgtcattgaaaatatgatccgaaaactccaggatttttgactctgcgctctcttttatctcaatgattctggagttcattctcttagagggtcatctgtggtctttagctagggttgccacttttgggaatttcttgggagcgtagcgtggctctgcccctttctattgttatgagttgcgtttagccgcctgttaacgccaaaatttggtaagcccgaagtcatcatcggtttagagtcagtatcgactttagagtactgaaatcagccgatgggagtcgtcaagtcgccagcagtcgtgttcttgatggagtcggatcaattaaaggaagcttatttaagaagagtccgagttcaaggaggatgcggcatggcaagttatctattaattaggaatagtttattagttttcttttatctttaagaaagtgtgtttagtgtccgataaggactttatgttttccttttatctttaggaaagttttttttattgtcctgcaaggactagtatctacccatgggtataaatatgtacacccggggttattgtaataaatctctcgatcaatactactctcagcgcatcgccaccctctttaccgaggtttttacttatcttccagcggaatatggcacctgacgcggggctgcatcggttcagttcgatctccggtgaaggggtaagtcctacgttccactggccctggtgaatctatcggctacattagtgttgttcaaggctgcattgcttcgatctcttagatcgctctggtttggttgatatatttgtctacctaatatctcaattctatttctagttgcattgtgtttagagacgcatcgacttagttgtgactgtctcggttaggtccgatcttctgtcttagccgatatatctctacaatcacaatgttgttgtaaatagatttgttatatccatcacattagacaaatctattggctcatcgagtattagattattatatacaatttcgtgctgcatcggttaggttcgacctactagattgttgttgataatataaatcttgttaagccgataggtgcatactagtgttttatcggagtgctagccgataagttatccggacgttgcatcggtttataaggatcgcatgtacatataatatataagttggatttagccgatgacaacaaaggtttcattgatctatctaatcttgtggatttaataacatcggacctccagccgatgtatgctttaaccttcggatcgatgctcatctatagtatatcacattgttagccgattggtttctaccggattatattattgttatattgcatcatcatcagccgactgtctttatattattggacatattgctgatagctcaaaaccctatctctatcggctgacatcggcatcggctggaattactccatcggcttgtcagccgatcggttgtttgatctgttgtttacatatcttgtcagttgcaggatcaaactgactggcacgcccgcatctcatcaaggtcttggacctgcactggagctaagcagatctcccaggccagtgtctgattttcgcatcaacaccgccatagtagttttttcctaagcttcagtttctgttttgttttttctcccttcccttggcataagctggtatggctgattgtgttgtgtaacaaaaactccttttcttttaatatattgacgtgcaatctttttgtgcgttcgcgaaaaaaatatgatccgacatgcatatttaaacgagaaatttgcatatataccacggttaaaaaccggcttcactataataccatcgctcaaatgggattcacccaaacgccattctcaagatgtgggcgttctctacaatgccattttcaccatttgttgcatttccaaaccattttccaccaaaataatattttggctgaccgttttgaccctggaactggttgaaccgaaccacacacacgagggacgccgctgccgctgcccagatgtgccgctcgcctctcaacacgatgatgcggcctcctcccccgccatccgcgccgccgccttccccgcctcgcgccgtcttcccctcagctcgctgctgccttccctcacctcaccgcttccttccctcaactcgccggaagcggctagtgacggtggccaagctggcgttcccggccgagttgaaggcgcacacattgcatctcgtcgacaacggcggcgagctcatgctcgtgcaccactgcttcgggacgacgcgccgaggtgcgggcggcggcggcttcaacctattcaacgatcgtcttacgagtttctactacacgcaccgagtagatctggacgcgaagaggaggagagcgctacgcgtcggacgtacagcacgagacgaaaaatcggacacatccacgagcagtccgatccgcgcgcacgccatccgccatccaacatcatcaagcatgcatgcatgcaaaactattttaacctaccttttctcttaaattatttattcaaattatgatccgattgtaccattaaattcgatgcaattaaatctttaaaacaagaccacatatgaatatattccggtgaaaaaatattagcttattattgaattatttttaaatgttgcacgctgttcaccaagtatatcagaattgtttcactagtagatcgaatcatcgaaaatgtttcaatcgtttaaatcggacgttgtttcaccttatataaaaacattgtttcagcaaatagcgaaagaatgtttcaagtcattgcaacatttgatctatataaagtgaaatattttttgtggaacaaaaaataaaacgaattctcttaatagatttccataatatgtgggtgatttattgcaaaagaattttttaattcacggcaacattagatctatacataaacattgtgagtacattaggtgaaacatttttagtggaacattgtgagcacactagtggatacttgttgaaacacttaaccaacatatatatgtaacatttacgaataaaccagtgaaacacaataaactacttactaaaacatacaaatagtaccatgagatacattaaggaaagatatatacatcgcgacactaaataaatatgtgcagcataataaaatttcagctaaaacatctaattttcatatgtgaaacattaagtttaattggttgaaacatatgtgtgtttttttattataatatagtcatgtgagatcttgttgtaaagatttaattgtaacgaatacaatggtataatcggatcgtaaattggatgagtaatttagaagaaaatcatttttcaagtttgctaaaagggtgttatgtacatgcaagtaaccttgtatcatctctctcacgcatattaatacctagaaagaaagcacatgtaagagagagaggacctgacaaaagctgcatgcagcaaagtcaa

SEQ ID NO: 42015 - DNA, 7620 bp, Oryza sativa
tgggctggaagcctggaagtggaagggaaggccgaggggagctcgggctgttaattccaagtatcatgggctggaatgggccatgtaatagctaaacaataggtccagtaatgtgagagaaagagtggttatcacatccccgatccggcaccaccgtacaacaacagcaggatgcaccacaggataagggtgtgaaccgtcacttgcgaaacagcaataccaatccctgtttcagggtatcagcccaaacgtcctgcttagccttttgtagctaaaacttccataatgcgtcagttgaacaccaaagtgaaagcaagaaaattattgcatgtccaattatatactcctaggttggagacttgagcatataaccactctgaacctgaagtgtgacttgaaacttgtaccaatactaatgccatctgtgcagtgtacatgttattttaagttctacaagtgccatatgccacaagctagtcttctgatgtgttcctactgctgtcagtaaatggccagcatactactagtcttggtcaaattttagtcacgtggttgaggttcacatttgttttagtacaaccaaaacaaaaatgatacttcaggtttattcaagaaattctgccattggctgatgctgataactagtgcctagtggctcggcagtattatattttcctgatgttaactaagagttcagcataaagagcatatggtataccttttgcaagcaacacacaatcgaaataatatccaaccaaacgtattctagtttttcttgtactgattgtgatacatgcaagtataatcatgatatgactgaacagatcagtttgctgttcgtgcagatttggcgaatccaaggcaggaatttcttacacctacacaatgccctttccttaataaattctaattgtagagattttgttcagatcatgataagatttgcaagtgccactctgtccgttgatcttttctatatagtttatgatcaagaccatttcagatgtggtatttggcatctagattgacagaatttatgggattgactgtgtttctgactggtctaacagtggagtggataaatgtttatgcttggatctattgcatgacagtgatatctaggcagcaatgcttccaagttccaactgtctcagaaaagaagacaagtcaaagtctgaaacccagtctaaagaagcaaaggagccacaagaaaagatgctccagcaataatgccccatcccagcagtcaatactcaatagagtggaaaacttgaggaattcttgacaagaactaatacaggtatcgaggaacaactccaaaaatgatatttttcagctgtagtatatagattgtctgaaataactagacaaaaggtgaaaactgttaagtcttttgtccattctgaaaagcacagacttttctcttagcacgttttctagaagtatgaaaaggatgaagggctgcatccacatagtactccttttctcttccttgaggtgcatgaacttctatattgggcatggctcagacttaagatgctgtagaaacttttatacgtgtgttttagcaatacaattgccaatgctgaaaaataaaatagaaaatgtaggatcgaatcacaagaactaagccaaccagagggggggtgaatgattggtatacccaaaaaccgaaaacttttagcggaaataaaagttacccttgaaatcgacggatcgcggtctgaccgaagttgtcctgccggtctgaccgcctggttgccgtcggtctgaccgcggttatatctccggtccgaccgccgagatcagctgatgctcgctgtcgccgccgccggtctgaccgccgtgctcccgctggtctgaccgccgaaacccagtaaacacaaatcgaagaactcttaaagtagatgatgactttattgattctctctgtgtttacaaagtgcaccaacagcactccttacaaaaatttcgactaaactcgaaaccctaactcaaaactcaactcaattgctctcaaaagcgataccgggaagcctcacgctccccctctatttatacatgaggtaggcagcctaaagccacgaaccaaactcatactaagagtcctaaacaccttaggaaaccctctagtacaagaaagaaactttacataatcaatcgtaccaaatttggactccttccaaattcgactccgcatcccatacgcacacaataactccatcgtatgccatatggaatctccatcaaccacgtgcatcaactctagcctaagtatctcgcatgatctctgaccaccacggacgtcgtcttatccccaagccgactcccggtccatcaccgcaaatactctcccgagacatcgagtcacctacacatggaacaaacaaagaaaccatattccgagaccaagctatctccaacttgactcattagcagcaaacaatagtattacatacgtatagtatccatctagaagtcataatcatgaaataaactcggatatccaaataaacaacccgaaaccgaaaccgacacagtgtcggccggtcagaccgcgggctgcgccagtctgaccgcgcattacatgccggtctgaccggctaccagagctcggtctgaccagtcacatgaaataatgaatcctgcgatcacctgtgaattcaatcatctccaaaaccacttcgtgaataaatttcaaatgacaaaaccaataatctccaatgcccaattgttcatcacagaataataatcaaaaacacctttgattttacagaaaacatcaaaatcaactttaaaattaacttttaaaatttaaattttggatacggctgatagaaaagatggaactgacgatgcaattgccgttcttgcctctatccctatataagtgcatttttaacactctagttttttgtcaaaataagtcacttctaatgtactacatatcctatcaatcacttcttatttaaatttctcttcatttacccccaaccaaccaacactaacatcccttatttaattaaggggcatataagtcatttattttatctattccctccgtctcagaatatagcaatttagaaccggatgcaggggcggaggtagagtatggaagggggggcacccaggaacccggttaagaaaattttttagttataactcaccgattttcaccatgtgtgcaccccctcaatataaacttagatacacgcatcaacttaaacttgatctaaagtagagtaaattaaataagaggcactatcctctatttcgttctagctccgcgccctttggatgtgaccaaacaacgttgaagattcagacttgcatgctgacatttgcctcatgacatcacattacccggttcaatccatcacgtggtgatcctcactgtcaccaatgatatgcaagcatctagtaatcattttcttctcaatcgagtagaaatggtaccaatcaacctcctaaatcctgccctgtgcatgcatacccccaaccaccagtaagtactaattgtgaataaaaatacttctgaataaaaccattttcaatatggcaagactaactcaaagaaaacagcataaacattacattattgcctgaagattacatacatgattgtgaaatccagccatatccaacagcaatatcattcatttctgtcctcctaaccaaactagcattactaagtctttggagtggtcaagttcatgaatgtgaggtacgggctgcattattaattgagaggcccttaattgagacgatatagtaacagtagagatttttctgatagaccagacaaatgaacaatcaaaagctactagggaagagaaaaggtaggaaaaggggaatcaaagcagaacaaaagcttgaaaagatagtcgagtcatggtgcacgaggagcaacaattattttccatccttcgttaatcctcacgcagaataatcgtgtaagaaaagaccaaggcgtagaacaccagaatggctcttcacctcgttgttgaaactctaaaacattttttgatagtgttcaaaccatttgagaggaacaggtcgatcaaacctatatgacagcactaaaaaaacacttattttctcgccggaccacaaaattttacttttattactaccttttcagccatgtttcagtatcatgtagggaaatcaaagattatgagatgaaacaaaaacagtttcgtctgacaggtagataggcacagcgttgttgaccatggactgctgatttgtcacaactcacaacccagcggagagccttgctctatgcaatgaactggacacagagcgatcaacaattaacaaaagaatctaaggcaaaaaaaaagacgaagcatcaaaacttgaggaatcccaaagccaaaatggacacaaacaagagcagaatccagagcgcagaaaattatcgtgttcacaaccctgttgcatttattttttggaataagaacaaccctgttgtattatccatgtactaaatgttttatctaacatcgtagtctcggttaactgacaggcattgacctgcagtttaagggttcagagtgaatgcatgagctttggccggtcaaagcctgtcagtgtcagatcattgcataccaggttgtcatggctggacgctactttgccatccggtgtgaatacgcatcatccatccatcatcacatcagtagaaatggccgccccttcctcctctccatcctctatataaaggcatgtatgtgactgcagattgcagaagcacagaagaagatactactactacatagtagtacatagcactagtatcttcagagagcaggaagaacatagtagatagagacatagagtgcgccatgtatatctgcagtctgcagagatgagggaggatgtgcgttcttgtggggggtttgggccctgtgatcaggagagatgacaccgacatcgccggaattcgttcttggtcttgtgccatgatgaattgatggtccgtttgatgcaggtgtcatctcccctgaacataggactgactgaccctgaatggatgtgtacctcgatgattcttcggtttcttctgttctgttctgttcttgatttgcttttacaaggtaatgcctgatgctagtatgcaaatgtcagcttgtctcctcgattggtttctctttccatgattatctgcaggtgataagagttgattatccaagctctgacatagacgtgtgagaaggacataggttgcggagtcaaccacaaggtttgccatccactcttgccagggcagacagtaatttaggcgtcacttagctgtaaaaacgggaataccattaactactgcccagaaaaactcggtgtcttcattgacaacacatggtgcattctttgtttgctgcgtggtcaaattttttgtgttacctcatacggtttatcccatcttaggtaacttcatatccctcaagaacatggcgctctatctatttcgtgtaggttgtctgttaaattctgatttggttttgcacttctggttgcagggaagaacagaatcggagaatccgcaggcgagaccgcaccaacccgagcgctgcttcggtttgggccgaaacgattgagcggccaccgttcagctgcggcctgcgggccttcgggccacacggcgaggccgaggcccagcacacgcgttctgaagacttctcacgggctgtggcctgtggaggaagcaaactgaatgccgcaccgcactttgtactgttagcgctgattaatggtgtgtcatggataagtgaatattttgtaaaaagagatttttctgcgaattcaaaaatcgtactgtaccacgttatgtttgttaagtgcagagtgcacctaaaatctttaaaacatatggtagaacaacatgaatgaaactactgaattcagtggaaaaccataaacgtcaaatccgccgtgcccgatggcctgattaacgggttcttatttgtttcagaatagtgaatcagtttgaatgtaagaaaaacattttttttaaccccgcaaaaaaaacatttttttttaaaaaaaagagtggtgaacagaagttagctgccaacatttagaattcccattgataattcattaattcatctcccacaagtatattattcttcatctctcacgacagatcaacccatcaacatttcatcagttagttccacatgaacaccacagggctcctgacctgatgcttccgattctcccacgagatgtgcccgaaatcccagctctggttgacgtgtcctcccgccacgctcgtgaactccaccgtgtagctcttctcctcgttcttctccttgaactccagcgtcgccggcctcacggtcaccttcacgccggccggcgccgacacggccacgctgtacgtctccggcttctcgtacaccttggtcaccgtccgcgttagcgtgcggacgcgtgtgctgccgttgaacgcgacgacgaacgacgggtagttgaggttggccgggccgccgccggggagcgccggcgcgcacccggccgtgtccgggacgaacacccgcagctgctcgacggtgtagttgaggctgcagaggaagtcgacgtagtcctccacgccggcgtcgtagacgagccccgggtccacggcgagctgcgggcggacgtgccccgcgccggccgccagcggcgtcgcgctcgtgaaggtggcgttggcggcctcctggacgccctcgtcggtgatgtcgcggccggtgttgtcgagcgtcgccgcggtcgtcatcatcgcggagcgtatcatggccggcgtccagtcgccgtgcctcttcttgatcagcgccgcgacgccggcggcgtgcgggcacgccatggatgtccccgagaggatgttgaattcggatctcctcgtgtccatgttcaacatcgacaccgggatgtcgcgcggccaggccgcgaggatgttcagccccggcgcgagaacgtcgggcttgaggagctcggggacgacgcggttggggcccctcgacgagaagcccaccgccgtcggcgcacggttctcgccggtgaccgtctcgcaggcgaagctgaacgacgccaccgggctcgccgccgactcgaagtagtccatgagcttctcggccttggagtagctgagagtgagagccgggagggtgaaggcgtcggctaccactccgtcgccgtgccattcctcaccttgcatggagactagcccggcgccaccggcgttctgcagcagcatgccctcgtagacgccggcgaggcacacgacgatcttgcccatgacgacgtcgggcgagagactccactcgtcacaggagtccagcaacaccagcggcgccatggtggtgcccgtggccatcttggtgtacagggactggccgacgagcacctcaccgttgccgagcgtgaggttagccgggaacagccggtccacggcgccggcgccgacggtggtcatccacggcgccacgttggtcacggtgtacggccgagggccgctgttgccgccggcgagggcgacgaacacgccctcccgctgggcgccgaacgtggcgatcgcgaggctgtcctcgtagaacgggatcgggaaaccgccgagggagatggagatgatgtcca

SEQ ID NO: 42016 - DNA, 1575 bp, Oryza sativa
ggcggcgagcccgctgtcgttgaagctcgggttctccggccagatgccggagtcgatgacgccgatgatgacgccgtcgccgaactccgtgtcgcgccacaggccgtactccgggtcgaggccgatgaaccccggcgacctcgtggtctgcgggtagtacatcctggcctggtgcaccgcggtcacgccgggggcgccgcgggacaagctccgggcctcgtcggcggcgaggcgcacggcgaagccgtgcatgacggtgtcgtaggtgtacaggatgcggccggccaccgcggcggcggcggcggtggcgttggtggcggcgcgaggggagtgcgtggccaccatggagatgtaccagtgctcgagggtggcgaagcgggacggcttgaggaggtggttggcatggacgatgtaggtgttcgacagctgatcaggcttgtgctcggtgcggttcttgggcttggggatgaaggctgagtgggcgagctgcgcgaggaggaggaacaatgccaagcactgcaagggtttggaggtcgtggacgccattgttgatgggtgtgtgagcgagcttgtggtgaaggaatgcatgcgtagtaatggcttttatagaggcgggatgaaaatcatttagggcttcttgccaagtgccaaactgtcactaatcactgtcacacatccctcagaaaaagggaaaagaggacacttgaaaattgaaaaatagtgtgtttgtttcactgaaactgcatgtcagtatgtcaccaatacttctccatgcatatgcatgtgaaacaactgagatatactattatcaaggggttaaatgatttttaattagagcatttaatcatctaagtgagagctgagacaaattaaaaggcacctagcgttgaagtatctacttcatgagagaaactaatcagatctatattgtttgaaggtttttcagacaaaattaagggacctaatgttcaactgtcattcttctgaaacaacctaaaataaacttttgaagttaaacacccagaaaatttgaagttaagcattcataaattgagattgtggaagttaaacttctaagtatttattgcatgtttgttgtcttgtcaactgcaggcaaaatttgaattttataacttgatttttaaattaatttaggttttttcatcatagactattttcgaacatggcttttaagccactaatgacatagatataaaagctatccataaattattttatttgctctgtgctgttaatatacttgctggatgaattggaggaggaagcaacggtgaacgctctgggctgtgaaacaaattcagttggaactaactaccacactttggcagggaacagggcaacagaaaaccaggccatgcttggcagatcataaacatttagatagctctaaaaaactccaacaatttcgattatatcatggtgactaggccacatgaagcaaaacttctgtcattttccgtttcctcctgggatagatagaaataagcttgtgaatagcaacttctgctccattattcaggacgaaacgggctctccattgttcagaatgaaacg

SEQ ID NO: 42017 - DNA, 1272 bp, Oryza sativa
ctgtgcaaactgactttctgttgagatacaggtaatcttcaaacagccagcaatagcacctcaaagctgtttcaggtgctatttaccacaagaaaaaaattaattggattctattcgtatctacattctacagagtctaagaccatagttatgtaagtctcatagtgatgttgcagtcttccaaaatcaaaaccccaagtgaaatgcgaagcaataaaaagaccaattcattattttagtaaaaatagctaaatggtaattcaattacatccaaagcgaataaatataaaattagcatacaagctatgtattcttgtgaacaatgcggctaggctacatttgtaaggggattttggattaacttacacaggattgtactcccatgctacttttggtacatactcaactcgttgctgagtacctttcactgtgtcatctataacttaattcagaatttcagaccaagtcaaaatgaattgacaatgtccgagtttctttcctttcgagtcgtataactgtactgttgttaatagctccagcctccagcagtggagtcattggccgttggacatatatacagttgcaatggaagtgctaccagcagagttatgcgagaagaggttcaactaaaggtcttcgccgagtgtcaggtaggtccatcgtataagctattatggctgagagcagtgaacaggcagctgggactaaccccaaacaagtcttgtaactgaataaccaaatgccaactctaggttctgtctggtattggtacttcctgccatgcaaagtttcaaactctcagcatactgtaaaagtaccatcccaaatttttttgatgtatcagtgccatgataatagtaacagtcattaccttgataggactcaagaatatacagagctagtccgcatgacactttgtcaacaaaacttaatgagccatacacaaaagcacaaccatttagatcttcacctactaaaattccttccatgctgatacttgttacctagtatcaagagaaacagtgaaaagatgtgaacgatgagaagagaactcccaggcataacatgattatgtatggcatatggaaatttggacaaatttaatcacaaatttacatgataacacgctacttaaaatcaagcagctgaaatgcttcccaataagctaaccaaatgcagatgatagacatacagctttgcaaggttaaaaactacacgatggaaaatacttctaagctatattataggctaaaaatttgccatagaaatgtt

SEQ ID NO: 42018 - DNA, 9798 bp, Oryza sativa
cgacgatggtccctatggcggcgatggttaagggccatcatccggctgacggtgcgtcggcggcgccgccggtatgtggaggcggggaaggggtctggcggcggggaaggaggagtccgggtgcgggagccccgtcgacgccgggaacaactgtgggcggtggccttggccgaatcgctgaagggacaatgttgttgaccgacgacgatccttcttgtgcggattggtggtgtgggtttggacagggaatcgcgggcgaaagccttgccgagccatttggctggctgacaaccgcaacgccgtttggcgtcattcccctccttggaggcgttgttttagcatacccctttcctttccctaccatattctccaggtgaaaaccttgcttcggttccgaacgagcggtggcggcgatccacgtcgcatcctccttgggggcaccgctttggagaaacctcttcgtgcaaggatattgtcattggtctatgcattggcttcgaacttcagtcctaggccttgacgaggccttctagctccacattttgttttgcttttctcagtttgggtcctctcttctcttgtttggtgtgttcaacttgtcttgaactacactctcttctggagtggatctttgtaataattggttgtagttctttttgagcaaaggccgggatattatattccattatctaaaaaaaaacttgttgtacaattgcatgcgaacaaccatcccaatgacatattcaacaccagcgctagtgtaatacatgagataaattaaataaaacaacatttacaaagcaaatatatgaaaaagaaccttaccaatgctttggatgattgtggcatttccaaatcatttatgacgtagaaagcaagaagtgcctgaccaaatacagaaacgttatagttgatgtgtcctctagctattagttcaaagcataaacaagagcattgtagtttaaacctagtgaaaaaggtaatacgtcaatatacacaaatactgcacaaataatcaaacaaaattcccattatccagtaaacatattagaaacagaaaaatgctaatgcatcgtgagaatgtgcttctatagtatgtctcaaaattagtatgttagtagagaatttcacagaaaaaagaatctaggaaaaaaagaaatatataaagttcatatataatatccaccaccatatttaagcatgaactagtcaatatttcatcccaaaacatacaaagtttttgctgcataataacctatgcgtgaatttggaattacatgcaaaagaatttactatgttccaccatgccatggtccatggaacacagttaacaaggtaaactattttggagtacaatacattaatctctacgagatatcctttgtcatacagaataaccatatgcagggacgaagccaggatttgagattaggggggtgtggggtgaagataaaccatgagaccgaataactagtcctttaagaatagtcaccgtcaataacaagcaatgcgtaaactagtcctttaagaaaaacttaaattttagctctttaataatatcattggaaatttaaaactagtctttattgctaaattcttttaatataaactattaaataatctcacaaataagtatcatctattttactttgaaaaatatgagaaatcacaaactaattttgtagatcatgtctcttgctaacatttttagacttgctaactaattaaattgataatactttcaagctacacaaaataaattagataaatacttatcttagctaacttaatatagagtaaaatacatgagggtgtagtggtggtagtgtttggataggggggtgttggcaccctttggcaccccccttaccttcgccactgaccatatgcttgaaaataaacaagtgatacaaggccattatatacatggaactaaaaatgcattatatttttatcaaaggaaagaagatttcagtcccataagaaaaataggaaaagattatagatacctgtgaaacattggtaaccaatctagtaaacatgtatactagagcaacttggtagtacaatactttcttgaaccagtgggtccatgaaatcctggaaagtctcttattctggcaatgctgatttaacctaaaaaattaaaagtcattcaaatactgcaaaaatgaggaaaacctagtggaagaaaaaccatcaaaattatatggcctttaaactatgaactccacaagtgttttttatcttaccctggctcttccgttccaatcaagaacacaacgacgaaacaagatccaagggcaatggacacatatgctatccatcgatactgaaataggattccaaaatttaagataaatccaaaagatcaggcaaatagtaaaatattatcttaaaacaagagagtacctgaactatcacgctcactgactgacgtagactaaatatcaacaaagcaatgccatacaggctaagatttgcgatctagcacgagcacagaaaaggatcatcagattcagctcttttgtaatacctgagttaagaataattagattaaattaatgttctaaccattgtgaaggcattacggcagcttactaatgcaacccgacttgttgggtttgatgtcatgcagttcaccattgaccttagaaaatacgcagatgatgtacacaagtcaaatgcaggaatcacaagaaaagaaaatggagataaacaatgaaaggaagaggcattacatatgagagacctgagtaactgcccagccaacattgaaaatagcagcgaatgtgctatatccaacagtctccattgtagatgaaatagttcccgtaagtttgcaaggcaaacagctaccaaaaacagatgagaaggaaattgctactaaaatggatcctcctgcatgccacagtttaaaatgtccaaagcgatcaatctggataaaaaaaaaagaagatagaatttacatatctagtttggaactatacacaataaacacaggaaaactagtagcgaacgtctaagagaagataagccatgagaatatgatgtcacagctttataacaatgctttagtaaacaatcatgttctttcttaggtcgtaccagttctccaacgaagattgttgcgaagccatctgccaattgaccagaaagcatgacaacagcagcatcactgaaaaggtgaataaaaggtaaaatgtctaaaagaatcctgaagcagcacgtaatcctttcaaacttccaatgtttctcgtagaaaatttctttcagcatctctgatagaacatttctcgagatacgaatacaagtataatgttctgatgatctggtccaacaattccatactgtatgcagtctctacggcatgtctttgatcataaatgagccaataatttccaaaaaaaaaaaagtcaaagttgctaactttgctatagccgcaacagttgcttggacatcatgaagttgtggctagtcttaactcttaagtggcacaataccaataatgatgcaaaaaattcatccgaaaaaagatgaccaatcgttacattcatttgcaggatatcccggtgaaatatctattgcaccacatttaggacatcctgactttaaatatgaacctatgtttttgtacaattcctcatcaagcagagtggattaagtgtttgaaaacaactaaaaaaagtgcactaatggcttcattcaatatgatttagaaatatgtgtaaataacatgatacaaaaattaacagaacaaatggacaacaaaatctatccctcaaaggcacataccttggactaagcccaatatctgtcaagaaaaccagcaaataagtaaaccaacatgaagaagtgatgtcatttagcatatgcccagaaccatatgaaagtattggaactctccctaatggttcatccagttcttcaatcgatgactgattatccattatcttaaccatattttatgtttgccagactaaaggtatcacctacacaaaaaaggaatacatgttgatttcagtatgtaactagcaatctcaatcccaactttgaataaacaaaacaataataaaatgccattttgccaaaagttaaaagttttgaaaaataaaaaatgcctacggtcctgcacactattttagaggcttgaaaatgaagttgcttagcttacaacgagtgtaataagtcaaaccgacagactttttattcagaaacatcaactgaagttatataagaagatagttggtacgtcatgactggcagcataacagttgcttttgtagtgcttataacaaggcttcaagctatgtcagatggatttgagttttattccttaactagaaaaaatgtctgtgcgttgcaacgggtgaaaactattttaatcatgagctgcaattaggagtctgatcgtatcaagttagcatgcgagttttttaaagagatatctatacggctccttctgtatttacaaaagcgaacgaacttaaaaaccgactcatacacggatgatgtaccaaagtaccggcaaaaacatcttcaatttttataatagtagagatgtatgactggtttttactgactgctgtaaaacacattacatggaccatcttaaagcagcaattgatatgactactgtacttgctaacttccaggaaaaaagttcaagttgtattagttcttacatatatgagaatcatgaaatgaatcaaatgccaatctaaaggggggcacaagaagataaggagataaactgaaggttccttttgttgttgtaaagttttttaaaaaaaaaaaacagcaagcaaatttcaatcgcaatggtaatagatcagcaccttcagaaggttgggatgatatggatatgatcaagaatccccaaaggcattattgtagcatatataccagttgactaaaaagttcagatttgaggtaaaagcaactactctgcacacaacatcaacagccacccaaatcaacgtgttatcgctgggtcccaactcgaatcatcaacgaggagtatcgcaagtgcccgaaagctaaagataaaaatgcaatggcctacaaaagaaatattcgcatttccactaactttacgagacatcaacctgatccccctttcctctctgcctttccttccaaaaattgatcctaatcgaacacaacgcaggagcccacacatactctctgcctgctccccccacccaacgtagcaactgacattcgaaccgtaaccaaacaaagttaaaatttaccaaatgaagaaaacccaattttcgcggagccccatgcccgtcggaactccctccaaactctgctacacccaccccaaaacaacacagagcagcacttccatggctggccccaactccatggcgagcaacctctgtgccttaagcccgcaacagactctacccatccaataaccccggaacaatccagtcaaacagatgccgcacatgctcacctcgctgctgctgctacggcgaggaaccggagcgaaacacctccctccgcaagagcaggacgtacggggaagggcaaggcggaggaagaacgaaggcgacgctcggtggtgtcgcgtggacggcagcaggaggaggagaggagaggaggaggagtgggcagggagcgagccgtgcgggaggaggagacgcaacgcaaacacggaggaggaggaggagagaggaggaaccgagggaaatggaaggagactgggcgagcgaaaggcgtggctgacgcgggcccccaccaccgatcccatggaatggagtctggactttggagagacgagagcgacggagatttgatttattctaatccttctgtttagtttattagtggcgtcgcgcgcgcgtcaattcctccgttttcgtggccgccgccaacacgcgggacggcgggacggggacgttttgctctcggctcgtgttctcctctgctccctccatcccacgaaaaaatccatttctaacattccaaaatagaattagtagagaataagactaactaaaatatttttaattattaaaaaacataataagactaatatgtagataaatggtattgaagtaaaaaccttctcgttttacgttgatgatagataagatagtagaagttggtttttctaaaataaaatttaaactctataagttgagtttttttacgatggaggaagtaaagctgaagaggtggccgtgaccgtgagttgccttgattaaaaaaaagtctatctatacggctattagtatgcgtctcgagtaattagtactccataaactaagtcatggctgcgtctcgatggtgttttcttccgaataattttgtgtggtgatcatgttttcttctgtctgcaagaacatggggtgggatgggagaaacgtaacgtacgtagtgacctgtagggcttgctttgtcaacaagtgagttgttagtcttgtcctattcttaaacaatgaattttcacaagtgcaaagcacatgaattttcttaggacatgtacaatggaagacacccatagagtaccctcactaactgaaggcactcacgtgtaggggtgggcagatttagaccgaaccgaagaatcgaaccgaaaaaaccgagaccgagaaattcggttagttgttcggtcccagccatcaaaagactaaatttatttcggtcattttggttattaggctcggttaaccgaattgaccgaaattttggctcaatagatctaggaagcacgataaatataaatatatatatatatatatttgtgtgtgtgtgtgtgaaaaaatgtctcaaaagaggggaagtgctgttaaaattttcattccaaacttactcctgaaaaatttcagtcggaccaagaccgagaccgaaaagactgaaattgaatttgccagccctgtgtttttttaggatgaaattcagtcctaagttttcaaatactgaaatgaccgaaagaccataaaccaagactgaatttttcagtctaaccgaacgtccaccccctgctcacgtggacactcgtctcccaattaaggccacaactaagtgggttcttcaaaacccgaaacaactggatcaaggtactctatcccacagtagatatcccaatcaaaaagccacggatattaatttcctctcctacccctgccggcaacacgtctctctgctccctctcgttcttttcgctgctctctccatccctcaacttgctctctgctctctccctctctctcaacaaagcagacggcaagccgtgcggatcgccgtagcggatggccccgccccaccctgccgtcggcattgaagcggcggcatcgacggcgcgttggtctcggatagtattgtagcgtattgccataggttaagagtaatattttactaaatccttttagaaagcggcttttacacgaaacctacatgtgacagtagatttctggacagtgtgagacactgacgcaaatcattgattcaaatatttgctgcacaaatttgatagataacgggtgtaatatttcgttatttcactatcattgcaaaagaatgaaagtgctcacataatacttgattgattctagggataaaatggttttctgaaagacttaactaaggtccatggataagaacattgatatcttgtagaacttgcgtttaaacttattttcatctatgagacaaatatttgcattaccacatgcacaccttcgcacacgccggacgccctgcctgctctaacatctctaaccttctcaaaattgagcacatcagcacacacacccatatccccccaaaaaagaaaattacaaagacccatattcactggaactccctccaaaggtcaaactctacagcctctgctcaagtcacccttaataccgacccatgcactatccatgctaagcaatccaacagccattagacatttaattgattattaattatcacaaacttgaaaaatgactttatttgtctatttagaaaactctgtataaaacattacatcgtttgataattcaaaaagcgtgttaatgagaaatgcccaggggtcttctggctagctccacaaggtggtgggctagacgacctgggttcaaagcctcacccctcctaattatttgatattaggtccttccctaatattctagtttttcaaaaagcgtgttaatagaaaatgaaaaaaatgccacccctaaactcactatcgaaggggtggattctcccaaaatctccatgccccctaaacaatccatattcttagattttgtagttatagaatatagaaaataaattcttacacagtcataattcttaaaattttaagcttccctaatatagccttagtaatatgtatagaatcacggatttctaattgaaacaaaacacatccgtagagccgtaaagtagggcagggaagagcaaggtcgaaggtggaaggcacggcaggaggagaggaggtagaagacacgcatagtagtaggacatggattttcattcctccacgacatgatatttcctcgttgtttacctatcatttaaatagtcataaaattttttaaaaaacttaacaatatagattaatacgaaatatagcaccccacaaacacaagaccaaattcgacttctacatgttgtaacaaacagaacaaattaaactgaaaatagctatatatcgtacattcgcatatatatttattattattttacaactagtagaagttaaattttaacttatatgtttgtggagtgatatactttatattaatctatcttaccaaattgtttcaatttttttttgataattatttaagtgaaattactttcccatagtagcaaagcaaagcggaggaggaaacggaggaaacagggggctagcgcgcgcgaaaggcgtggctgatgcgggtcctcccgtcttgggtcaggtgtggatggagattttgtttattggtggagtagtggcgtcgcgcgtcagctcgatcggcaggctcgtccggtcgtcccttcgtggccaccaacacacgctgccgggacggcaggcaggacggggacgttccttccaattccttcgcttgtcttttagccgggagaggtagcggggaagtgttcgctacgagtatgcgtgctcggtgtgtacggcgttcaaatggtctatccaacgtatggttgtaccgtgtttagttctaaataattctttaaacttctaactttttcatcacatcaaaattttcctatacacataaacttttaactttttcatcacatcattttaattttaaccaaacttttaattttaatgtgaactaaacgcacgcttgatcgtccgcaagaattgaggaatacgggtggagtatgtgagaaaaggtagcagtgtgtagagcttgcttcgtcaacgagtgcttgtctacttggccactgtttgttgtcactatccatcgaggatgtcttttaacaaatacacagatactttcttacgcctagttaggagagtttagccatggtagtagtttcatattagaatctttagctcccaaacagcgtgtattctcactcactcaaattataagaatatatagttacatagtctaaaaagtaaactgaaatcagctactcacagaattttaaacaccccccccacccccaaaaaaaaacacccaacaggaccttacttattagtagctgaagatactagactattagtacattgatgcaaggttattatattcctacaacaaaatgaaagtgttgtgtttactcggatgggagaaaagagaagaaatataaaggaggatgagaattgttgttgaggag

SEQ ID NO: 42019 - DNA, 2664 bp, Oryza sativa
ggtggcccatgcttccgggccgccagggcgtggcgctgtggcagcgtggccattgcccattggctgttccccctatggcctggaagcgggagaacactttgccgagagtaggaaagccgtgtccgtgagctactcggatacgagccgcggcagaaggcaacgcggcttcgaagccctaaccccccaaattcgctgtcttgactctgctatcgaaacccgcgcagctttcggattcgagggcgaggcgcgcgcagggaacgcgatcgatcgtagccatggccgccgccggagaggagaaaccgttgccggcggaggaaatccaggggatcaacgacgaggcggagccgcatcccccgaggcgtaagcgtaacgacgacttactccacgacgaggagttccagcgtgtggtgcgcgacatcgtcatcggcccggataacgttcccggcggaggtacgtgattgccccctcctctttgccatgtgagaactatatatcatccggccattccggccggtccgcgtaattggcgaattagtctggctaatcctttgcgaatccggccggtcttgtgcaggacatgcgttgaggattatcagagaccctgctactgcgttcgaagagctcctagagtgctaccgcaaggccggcctgctagaaggtcaagtctggaagcgttgtaacatcttcaaggggttggaggggttggataacttgcaggatgaggtgaagatggaggagacagtgaaagaggaggaggaggaggcgacaggttgccgatgcagatacgcgagccctgatcgtcccgatgagctggcgaagaaacgacgcttggatgggccttgagctggattatggatgcaacctgccatttgagctgagctgtatttagtaacactgtcaatttttacaacagtagagagattcattcagtaactagtgattgttctgcgtgataacgaccgcagttaccatccctagataatactagtatagctagcaatactggtgagccacaatcagcagtaacccatgttccaaattgacccttaatttgtaacttcgttttctgaagactgaggtttagttgaatagttgatgtcatagctggtcttgtggcctatcgaaccttgtgtgtgttttgttttctttaatgaaagcgggagcggtgtggccttctctttggaaaaaaaaagggtcttgtggctcactagctctctagtattctagtagttacaaatttataaatcaggatgatgagcacagcacattgctgcataggtttcatcctatttgaattactttggagtattggggatggttggttcacttgagaacagggatattccaggtaataggctacaatttgtgtctattgcgtgacataaattttcatgttgaattaaatttcgtgccatgagaaaattgtggcagttactcctacttagagcaggtacaatagcaggctattagccagctataaacatattttaatgagataaacgatgagagagaagagcagcgggctacagatttgtagccaaccgcagcacggactccaagacgcaatgtgtgtatgacaggtgggaccatatattaatagtatagtaagctactattgtattaattggctattagctcggctatagatgaattggagctagtaatgggctatactattgaacttgctcttaggctatgttcgcacatagtgattacggaaaacggagcggtctattagcgcgtgattaattaagtattagctattttttttcaaaaatggattaatttgattttttaagcaactttcgtatataaactttttgcaaaaaacatactgtttagcagtttgaaaagcgtgcgcgcggaaaacaagggagaggggttgggaagaggggataccgaacagagccttagctttcttgctagcctttgggtaaatcgagttttaaggccccgtttggcaaagctctagctcccaactccaacttacctggagctggagctatgccaaatggttcatatgctccgtttttaggagtggagttagcagagctactcctgaaaaatgaactacgggggtggtgctgggtttttgctgctccatagctctactacaatctaagactcactaccctctaattttttagtgtatttatgcaaaaatgccattgaactaccccttcctactcctctcctcttgttctctctcctctccatcttcctccctaacctcctcccgacggccacttcatctttcctcccaacctccttctgacggccgcccgcgtcggcgcctacggcggcagcatacggtggcgggggcgacggcgcgtcggcgcacggtcagcagtcgacgcgcggcatcggcatgcggctacgtcgacagtggcagcgtcgtaaggcggcgcgggtcggcgatgggcgtgcggcggcacgtgggagtagcatcggcggcggcagcggagggcaacgcgcgcgtgctgagcagcggcgttggcagcgcgagctgagcggcgtcggcgaggcgatgctaacgaggtgttcgatgaaatgccaacaagggatgtggtggagtggagctaaccaatatagtcaaacacttttgtatccactttagctgctataggagctacttcctccgtttcatattataagactttttag

SEQ ID NO: 42020 - DNA, 8095 bp, Oryza sativa
tattaacatctatatgaatgtgagcaatgctagaaagtcttataacctgaaacgaaggtagtagctctcactggagttggagtttagagttaggagttagagtttgaagtttggagccctaccaaatagggccataatttcacgtcatatcaaatataatttcgcatatcaaatacacaagctgcgtggtgactaaggtgctaagggcagcaggcccatttgggtcaggtggagaccggctgaggagctgttccagacttgcagttgggggctgggcagatggcccagccggcccagtgaggagacgtgcaaagctggcccatctataagctagcacgtgcgcgaggaaaattggatatgaatttttgcgcgaggacgataagaaaatcggagatatccttttttttttttaatctcggacgaatatttttttacggacgaaaatttctagccatctaggtcaagccgtcaactcccgtgtcgtctcccttccttccgagttcgcccacaccttacgccgccgatctatctcgcaagcaggccgcgacgccggccgtcgtcccgccgcgccatatccatcctggtaagcaatcccatccgttatgcacatcctccctctctcattcatctctctctgacacccacctaaccctagtgtaccaaatcccaagttagactggacccaggtcccaagttagatccgcctgctgatatttaattaatcaatctaagaaagacatatcgatggtgctgacgagttaattctatttgctgttctatttgaattatgtcggtctagttaactactacagttaatttctcacgctttgctgcgggatatatgtagatgaatgcatactatacgttataaaaatagtagatgtatctgtttaaaaagtgtgaaaaaaatatgaagataatgatttgatattatttacctattgagttttaaaaatataacaaaattataaatgatatttcaaatattttaaataataattactagtggatgatagtgataatgtgacacactgtcatattaagccttaggagctagtggacaccaatcatatagtaagataggactgatgtctcaagtagaagatcggtacgcatactctactggagatagagatgcaacctatctggtatatctttcttgtatcattggaatgctatcttcaccgagtgagaccagtctcatgggagattttttatttctgtagtggcgactggagcgtacttcgttgggtagctttgtcatcacaattttttccacctagtacttgataaaatcaattcgcctaatgtacaacctgactagagggatcaagataggatccccctagcttttttttttaatttttgattaaactaaatgactagtgaaagaatcttaaagcaagccttttttttactagcaaaaatgcatgtccgttgcaataggtgaatataattttcatgatggataaaaactcggccaattcaaatgataaaacgaaacaagataaacaaaacaatgaaaaacaaagttagaaatcatatagcattgaatccagttgcgctcgcttcatgcatcatcatacgaaaaatcccttatatacaccttttaatagcctcacaaatcgatcgggtggctaatccgtaaattgatgcatgggtatttgctatagattgctaaagagatattatcatcgaccaaagattgaaattttgattattcaatttgtgaaaggtttttttactgtagattgggcatttgcaaagtaacatcatacctaccttaaacaacgataatttcaaaaggaaagtatttacgagagatattaggaagagaaaaaaaagaggaaaaaaaagaaaaagaggataatggagagaagatcagaagaagagggacatgatcaggatgatcggaagaaaaaggagatcagaagaagagggagaggatcaggatgattggaagaaaaataaagtgaaaaaatggagagaaaaaaggtactgattgggagaggagcgcaagcagagcggcactatggtgtgggtcggttgggctaggctaggaggaggatatataatagttattcacgttaaactggatacaggcgatgcatcaaacggctgatagaaatatcttcaatttttataaagataaagatttgatggtaaacatctattattgtttctctcatttttttttgttgtttgtggctttcgtcttgttatttttctattctgtaaatgtttagcattgtttctctctttttttcgcttactcactatagtagcgtctgtatatatgaaattttttctatgagaatagtaatgcgaacatccaacatcagtgtgaaaaaaatgcatctgtgcaatgttcaatggatgtcatgtgtgttcttaccaaggggaccttttagctatatcaaatattgaagcacattgctaaattattattttttactatgttttggttcaaatggccttacacttcataatgattcacttcaacgcgcgagatcttacaacgtgaaaatcttagagagtaaatggtattgttggtacacaataacataaaaccttatcaagtgggtgtaattttgtacataatcttgcaaacgatagttttggttcacgaattcgtctgatgcgtgttgtttaagacttcagctcatgcccatattattattattgtttttttaccatgcaatggttattaattaatcgatctctctgtaaggcaagctgatggagcatggttaattctaattttctgtttgatttgaatcagattggtctaactgtttgcacatttttgatgcctcgagtttgtgatcggacggtgctctcgggaggtagagtcaccgccgagctgtcatgcctttcttgcttcggtgggggatgctatcttcaccgagtaagatcatgggggcttcttacttgtgtagtggcatctgggattgtacttcgtaaaatcactttgtcatcacattaacttttatcacttagtgcttgatactatcaattcacctaatgcacgacctgaccgaagggattacgacaggttacgtctacccattttgatttttgacgaaatgaatgacttgtgaaagaatcttaaagcgtcagcctgttttattggatggtaaacctctagtattgtttatctccatttttttaaggcttctgtcttgttattcgattataaacatctaaaatatttgtttctccattttttttggttgttggcttacttgcttgtccgtatatatggaatttgttttctgtaatgcatcagaaaagatattgcgtatgtccaatgttgttctttggatggatattaccaagtagatattactcaagaatggaaaggcacttgggcaattgggcttgggacagtctatgagtgctggggtagatcaggggctaagggcatctgcctcaggttattggacggtgttccaacaacatccaaagcatgatgttgttattaacaacatccacatctggatgccctgaaacatatacatagcacccatcccacatttacaaattacttcctccataagaaagtatatgatatgtacttttaaaaataaaaaggtataaatcttttgaccaacaattaattagattacaaatacacttaccaacaattaatcagattattaacatatctagatgccctcgctctgcctcccatcccacctgccatcgcgcgctcccccctcaagttgcgttgccccgcacaaccgctcagttcgttgatgccttcttcctcttggaccctccgccacactgttgagtcacatgatctggattggaacgtcctctatctccgcaaagcaataaaggccatggctgccaatctactagccttgtagcaccccaagtaacattgtttgtcttcctcggctcaaatgaggcgagcaaaggagaggagcactgtttgggtgatagttttggtgatggaacaatagcaacggtgatatggcgggacacatctcatggtgcggctcaccaaggaaggccactcctagttcagggaacaatggaaaagcggagaacggcgtggcgaagcttgagatctggcattggaaagtatctttacccagtctttttacagcatagctctagcaagcaatggcgtgtatgtcaaccatggaccagaagtccctgaactagtcggggatttcgaagccattggtagagaagagcgcaacgacgagcctaccgctgctgtgaaacagcaacttcggagacgtcgggacaagaatcaggcaacaccagggcatcctttggcttggtttgccatcgagcacctggcatgtgtggtgaaacaacgcctccggcctctctccgcggccgctctggcgtgacctcgagtgtgcacaaagagtacaactcgggaggtggagatagatgaataaaggggagttggggagaaaggaggaagaagaagaggaggggtgaggatgacatgtggggcccatgtcggcctcaccatttttaaaatattttttgtgtaactgacatgtgggcccataatttttattatcttccaaatcagattgccatttaagctccacgtcattgtcacgtcatatgaagaccgagtcaaattaaccacataggcgtcacgtcaccgaaaaccgttgtccataccgtcatgggacctgtattgcattggttttgactgttgagggacccattgtatctggtttttcggttgagggacgaacatcggattcgttcacaagttaaaggacctcaaatgaacttattcctaggtgcgccgattgagttggagggatggaggccttgtcagaagcccacgtacgtatgccgcgccgagccaggggcgaaatgggcctggcctggcagaatcgcgtggtggtgtgttggtccaggttgatccggaattctctttggtcacgagtatgagttggatttttcacattctgatcgttttagaaaacttattctacaaatagatcctaaaaacttattcttgaaatgacgcggctccaacatcattagtgtcaggcaaattttgctataggacatcgcgacttcgtggttttagctatgagacaccgcacgaagtcacttttgagggaagacactctcaaaatgtgattatttgctaatggacaccgcagacaataaaaaataattgctagttcaataggagagaaaaacagtgtaaaaggtcaaaaatgcccccgggcccacttttcatattctttccccacaactaactccctctcgcactccggccatagcaccacgtccggtcgtcgcaggcgaccaccccgaacctccctccttgcctcatctacccccaccggtgacgtcgtcctcaccccacgcatggccacgagcgacgagctcggcgctgggatggagacgagagacgtcacctctgcaaggagacaggagtcagaagagcgagagagagagagagagagagagagggagggagggagggagggagggagggagggagcgcacgccgacggcgctaacctgtgaccccgagtagcctccgccactgcccgttgccatcccaccgccagtgccgtccaacgccctcctcggcgccgctcgtcaccgtgaagcatctaggcccccggtgttaattttggtaattaatgacaagcactaattgtggactaaccgttgtctttgagctatacattttaagttaggtccacgtcatatgtgcacatggatgattatcgatggattaaaattgacggcgcaaagcaaagggaaagaagacggtaaaactagcgctttaatttagaattgatcgaggtgtagggcgatcaaatttgctagtttaattttagtttcgctgtactattaagaggggtaatgacctagcaaagagatgattttaattgccacattaggtcattgcattttcatttgtgctctctttttcattacacaaattcactgggttcggcctgaccactgggttcggcgtgccctggccggtcagaccggctacatagtggcggtctgaccggaggcactttcccggtcagaccggcctcttggaggccgagacgatgctgctcgggatggccgatacagagccgaccgagctgtagtcggtcagaccgagccgatggcggtctgaccggccaggccgatggggccctctgacagggctacaacggctagttttctagccgttgtagagtagcacggtctgaccggccacatacctccggtcagaccgacagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgttagagggttgattagccaagagtcaagtgcatttgcttccattgtagagctagtgtggcacttgatcatctccacgtcgggtcattgcttgttactcttggaggttgccgcctcctagacggcttgtggagaagttgcccggtgacctctccgagaagattgtggaggaggcccggtgccggttgtgagtggtttggagttcaccaccttcggagtgaaggaagaactaccctagtgatcgaggcttgggtagtcctctccgtgggccggctcccgccttgcccaccccttgacgaagggggcgtgcggaggcttcgtggttgagcggtggagttgggctcgcctcaacggggagtaggaaaccgacgagtttccgaacctcggtgaaaaatctcttgtctccttgtctcatttgtttgtcgcatttacttttgtgcaatttacttttctagagacaaacttgagatcatatcaccctaggattgctaaacattgacataggagtgtgatttactttcctagagatataattgagcctctatcaccctaggtttgcaaaacataacttagttgcttagttagagttgaccctcactaagcctagcaacttaggttagttttgattaggtgtcatttagttttaaatcgcctattcaccccccctctagtcgacatctcgatcttacaagtggtatcagagcgtggtctctcttgattgggcttcaccgcctagagagaagatgtcgaacgaggtgaaccacgtagggaaggctcccatgtttaatggcacaaactattccacttggaaaattaaaatgtctactcacctcaaagctatgagcttccatatttggagtattgtggatgtaggctttgcaatcaccggcacgcccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcacttcctcaagatccaatatgagacattctccatgttgcctcatgagagtgtgaatgacatgtatgggaggctcaatgtcattgtgaatgatctcaaggggcttggggcaaactacaccgatctcgaggttgcccaaaagatgcttagggctctaccggagaagtatgagacccttgtcaccatgctcatcaactccgacatgtcaaggatgacaccggcaagcctcttggggaagatcaacaccaatgacatgtataagttgaagaaaaaggaaatggaggaagcctcaccttccaagaagtgcattgctctccaagccgaagttgaagacaagggcaagggcaaggtgaatgaagtcaatgagaacttggaagaagagattgcccttcttgctagaaggttcaatgatttcttgggaaggagaaaggagagaggaaagggctccaactcaaataggagaagaaatagaagacccaacaagactctctccaacttgaggtgctttgagtgtggtgagaagggatactttgcttccaagtgcccttccaaggatgatgatggagacaagtcatctaagaagaagagtggaggctacaagctcatgaagaa

SEQ ID NO: 42021 - DNA, 1043 bp, Oryza sativa
aagggtaagaaaccttctcaccgtgccactcgttttgtcaagaacaatggtaagtattgctccaagtgtcgtgaggttgggcatttggtgaatgattgccccggtggtaagcctcctaagacatgcatgtttgattctcattatatgcttaggaaggctcatgatggtagcattgttgctagatatgtgggttcccctatactcggtggtaaaaagaataccatttgggtgcccaaagctttggtctctaacctccaaggacccaaacaagtttgggtacctaaaagagcttgatcttcttttgtaggtgaactaccacaccagtgggagccattgggtgcttgatagtggatgcactcaacacatgaccggtgatagggctatgttcaccacatttgaaataggagtgaatgaacaagagaaagtgacatttggagacaatagcaaaggaaaggtaattggattaggtaaaattgctatctccaatgatttgtcaattgataatgtctctcttgttaaatctctaaatttcaatttgctttcggttgctcaaatttgtgatcttggcttatcatgtgctttcttcccgcaagaagttattgtttctagccttcttgacaagtcttgtgtgttcaaaggttttagatatggaaatctttacttggttgatttcaattctagtaaagcaaatttgaaaacttgtttagttgcaaaaacttcattgggttggctttggcataggaggctagcgcatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagctcttgcatatggatttgtttggcccaacaacctataagagcattggtggtaatagtcattgtcttgtgattgttgatgattattctcactatacttgggtattctttttgcatgataagtcta

SEQ ID NO: 42022 - DNA, 3857 bp, Oryza sativa
ttcctgcagcccctttccgctacctactcacctcaacaaaatggtgtagtggaaaggaaaaatcgtacattgattgagatggcaaggactatgctagatgaatatggtgtttccgattccttttgggcggaagccataaacatcgcttgccatgcaaccaataggctttatttgtatcgtctcttgaaaaagacttcctatgagctaattgttgggaggaagccaaatgttgcctattttcgagtttttggttgcaagtgctatatttaccgaaagggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcatgagaatttggatgatgtaggtgatgaaggcttgatgagagctatgaagaacatgtctattggagatgtcaagcctattgaagtggaagacaagccatccacctccactcaagatgagccatctacttccgcttcgccaagtcaagctcaagttgaagtggaggaggagaaggcacaagatccacctatacctccaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaaggtttcacacaagttgaaggtttagactttggtgaaacttttgcccccgtggcaagacttgaggctattcgcatccttcttgcatttgcatcatactttgatataaaactatttcaaatggatgtgaaaagtgcttttctaaatggtgaaattgccgaacttgtctttgttgaacaacctcccggttttgaagatcctgaaaatcctaaccatgtttacaaactctcaaaagctctttatggtttaaaacaagctcctagggcttggtatgaaagattgagagattttcttttgtcaaaggatttcaaaattggaaaagttgacaccactcttttcacaaaaatcattggtgatgatttctttgtgtgtcaaatttatgttgatgacatcatattcggttctactaatgaggtattttgcaaggaatttggtgatatgatgtctagggaatttgagatgtccatgattggagaattgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaaactttatcgttctatgattggtagcttgctttaccttaccgcatctaggccggatatcatgtttagtgtttgcatgtgtgcacggtttcaagccgctcctaaggagtgtcacttagtggctgtgaaaaggattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatctcttgtgtcatggttatccaagaaacaaaactccgtagccctctctaccgccgaggcggaatatgtttcggcgggtagttgttgtgcccaattgctttggatgaaacaaaccttgttggactatggtatatccttcaccaaaaccccactcctatgtgacaatgatagtgccataaaaatagccaataacccggtccaacattctagaaccaagcatattggcattcgccatcacttcctaagagaccatgttaccaagtgtgacatagtcattagccacataagaaccgaggatcaactagccgacatttttaccaagcctcttgatgaaatccgcttttgcaagttgaggaatgagttaaatgccatagacttctctaatgtggcttgagatggtgcaccatggttgcttcttttgcatattgtatatttgctcctatttgctcttatgctttggacttattgccatttggttcttcattgcgaaaatggagcatgtcatattaagggggagttttggactcttgcatgtgctctacttccttttatatgtgagcaaatcaactaaaagtgctagtagtgttttcaaaatgcccaagtcaacataagtcaaaaattttgcaaaatcaatgaaatttgaaaactatctcttggaaaatgttttaaaagggtccctatatgttttccaagcctcacattgctagaaaaatgatttttgaatgaaaaatgctattttggctctcttttgaagaatctagatttttgtttttggccaaaatgagattaaaccccaaaatgagtttgagaaggaatctgagaaaagattcaaaacaaagttggtagagaggagaatttgaaatgtttttggtattcaaatcatattcaaataccaaatatttcaaaagttgtttgaaaatcaaattcgcccaaaaacccctatagaccataaatggtcacctcctagcactcaagtgagttttgttgcaaatcttcataaatttcaaatattatgaatggttggcaatatttcaactcacacatttcaaaattgctccaaaaatcaaatttttgttgaattttattgtgtgggggtagccgaactgtacaagggctgtgcacagtcggctgggggccaggcggtctgaccggcgctatatgcgcggtctgaccggcctggtggcggcggtctgaccggcctctagggaccggtctgaccggctgcaccctagcggtctaaccggccgcgtatagccggtctgaccggccaggtatggtgggcccatgtagcgcccgttccgtcgtggcgcctagcgggaaaaattatctcttaaaaaccctaattgcgaaatttgtttctttgcttgttgtctagtgtccgtgccatctcaagatctcaatccccgatctatcgtcgagttcaaatccgaatccaaatccttccaaatcaaattcctccacaaaagtctattttgcctcccccgggtcgatgggccgaatctcgctcggcccatctccctctctccctctcccgggcgctccctctctctctctctcgccctctcccctccccggcgcgctccgctttcccccccgctcagctccgctccgcctcgcccgcgcgccgcgcgcgcgtgcgcgagagccgcgccgagtgctcctcctcctccgctccgcccgcgcgcgtgcgtgtgagccgccgcgccgagcgcccccttcccttctcctcgctctgccgcgcctgcgtaagccgcccgcgccgagccaagtcctccctctccgctccctcgctgcgctccccacgccgtgttcgcgtgcgcgcgcccgtgtggacgccgcccgttgcaagccgcgcgcgcgtgccaagtggctgaccgcccggttgccgccgccgtcagcctctgcacgtgtctgtcgcccgtgtcgtcgcgccgctccaaaccgcccgccgtcatc

SEQ ID NO: 42023 - DNA, 1582 bp, Oryza sativa
gtccattcgcggccgggtcgtcgtctacctcccgccggcctgcgtggcagccacgtaggcgccacgtcggcgccagctcagcctagaccgggtcgagccgaccccggtcagtccctccccgtgcgcgcgttccaccgcgagccgtgaggctgcgcgtgggcctgccgcatccgcgtccaccgcgaaccgcgcgcgtgcaccgcgtccctcccccgcccgcgcgcatgagccgcgtactccctccgcacggtgagccgaaccgctgacaagcgggtcccacccgggaccgcgcatggtgagcccggtccaccggctctctctctcctccctcccgcgcgcgcgcgtcttgggccgccttgggccaccttcttgggccggccggcccgttaagctcggccgagccgccctttctctcgggccgcgccctagccgcccgagggaagtctatatttcctccctctccctttttcttttcttttcttttccaaaaaggatttaattaaatccttttcctttagaccaaaaatccaataatcttagaaattcaatatcttcccaaccgtaaatccgtttgactccgttcaaattccaaaatttctcaaatctcgagatctatctaatggcacgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcagggcagattggcagacctacctaacttgttgcatttgatccttccattgttaattactataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccgggaaatgtaccgggtgtacggtttcccgctctcgcacttaaggaccaattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctaggacccctctcgtcggcatatggtaaacctgtgtcggctttggaaattccttgtcatgaaagcttggaggtctcccgacgtggctgatcccctcgggctgggtgatccgggttagtaatgtcgtgtgggtaaagtgtaccccctctgcagaggttaacaaactgttcgaacagccgtgcccacggtcatgggcggatgtgaggtgattcctagcgtagtttggtttgactactg

SEQ ID NO: 42024 - DNA, 8176 bp, Oryza sativa
aaccttgtttaaattctaaagactgatacattgcacatactccgaccggacgagacgcactgtttcacccgtgtcgtttgagaagcactcacttagttgtttttagaaaagagctcaaataaaatcaattgcaaaaacaacagcctttctttgaagcctgcattaaacacttacttcccttggcttgctgagtactcccgtactcacccttgctctatataaataatccccccagttgctgaagaagatgaagcggatcctgctgatgaggagttcttccaggagcaagccggctatgatgagttttagggtttcggcctagttcccaagtcgcgcctgtgttgattagtccaagtcctggcttccgctttccttttgtaatgcagttgtgagctcgggatctgtccgcagcccaacatgactgtacatctactctataataaagagacctctgttgctgtgatattctgtctctctgtgataccagcactgtttcctgggactggtatcgattaacaggttaatttggagcgtcacgggctagttccggtcgggactagttcggggcgtgacagcccaggactttgtcctttcttcctcctcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaaccctaggtgaaggaagaggtgttcgtcgatttgcaccaatagagggtagtttcttggtgtgattcaactccttcaaccggtaaatccctctccctcttgtgcattgctctcaaatcggtctatttcaatctttagggttaagggtagtttccccattgcttcaatagaccttgatgttctagttccaatcttgtgcaacactgttctagcagtttttagaatcatttgtgtggattgtggaaggatttgggtgtgctcgcgtgagtggcggtctgaccggacgcggtctgactggccgtgagccgtcggtctgaccggccgagggccggcggtctgaccggccttgagccgtcggtctgaccggctgtggctctcggtctgaccgcccctgacaggcagcactcgcccttcctcccacttcactatgtggtttctaaaattgttgctcatccatcctttgctccttgtttttcagctatgcctccccacactcggcatggtcgtcgtgagcccacgcccgatcccgttagtaagaatgaggaatcgagcggagatgagtatgttcaaagtgatgaggacaatatggaaaatgttgagggtaatgagttggatgtaagtgatgatggtgatgacaatgggagtggcaatagtgaagatgatgaggcaagtgatgatgggagtcctctcgattccaccatccaatttgtgctaaatttgaggaatgctcaacaatacactatcctccatcatcatgatcaattccggaggcctaacgattgtaatgatccaagatttcatacacggttccaaaagtccgtgtatgaacaagtgtatgccaacaaagccttcgccgaacacaagtggatttcttggaggcacattggtgagacaccggagtttgagaatttgcaagagatgttccggaccgttgggattgataggattgtcaccatgaagcaaccttttgatgaagatctcatccggcaattctatgccactgtatgggtgtccggcgattgtgatgcaatgaagtggatgtcggggaccctccgatgctctatcaaccgccgtgaattcaaggagctcttgcacattcgcttcaataacggggatgaccttcatgatgagcacacccacaaccccttccccattgatcacttttctcagttttatgaagaagggggagggtacacatatggaaaggtggcgggtttgagggctctcccaagtgtgatcaaccgcagagtaagggccaccatcctcccaagatgcggcaacaatgatgacatacgcggagttgcttggcatgttattgatgccattatggatggtcgtcggtttgatgttatcaaccttatgatgaaggagattgccatctcaaaggggactattggacaaggaatctattatgctccctacataatgaggttgattcaaagcaagttgggacaaattggtcacaatttaaaagaacataaggagtacaagcctcgtctccaactgtcctcccctagagctcctcgtgtgcgccaaccaacttttgatcaaggtgcaagctcaagtgcagccccccctcctcctcaagggtatgatccaagtactttattccatccacaatatgcctactttggaatgcaaccaaatgacttcttcaacccggtccttggggctattaataccctaagtgaaagcattcaacacttatccaccgggcatgaaacattgcatgaggatgttcgtggcttgcgcaccgatgttggctacttgaatacttcggtggaaagattgcatactagggtgggtgtattggattctcgcgtccaaaccttggagagtacccaagcttttgtctatcattgtcgccgtgatgcttcttatccttccacttcggcgcgtcctccttctcctccacaagagtgaagacctttttagagcttgatgccaaaagggggagaatagtgtgttttatgttttgtgggttgggactagtagtagtgaggttagtcacctcatatttaataggttaaggaggattgggctatatttggtatgggtatgggctattactctatattgtgtattcctttttcgttttgttgttctctatatcatttggacccttcgtggtcttgtaatagcctatatttatttgtgagccctttatgtggtcttaatgtgaacttgtgctatgatggatggttggtgtgacattgatatatttgtgaccatcttatgctcatgaatgaatatttcttgaagttcacattgagatattgctcttgtgtttgtgatatgttgaaatgtgaaattgaattgtgcattaactccatatttgctatttgtgattgttatgcatatgtttagggggagcttttgcttgtcaatacaatatatgtccatgtgctctatgtttgattatatatatttgtggtgtttgtcatcaattaccaaaaagggggagattgaagcatctagacccctggtgttaattttggtaattaatgataagcactaattgtggactaaccgttgtctttgagctatatattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagattaattttagtttcgccgtactattaagaggggtaatgacctagcaaagagatgattttaattgccacattaggtcattgcatttttatttgtgctctctttttcattacacaaattcactgggttcggcctgaccaggggcggtcagaccggccacatagtggcggtctgaccggtgtgccctggccggtcagaccggctacatagtggcggtctgactggcggcactttctcggtcagaccggcctcctggaggccgagacgatgctgctcgggatggccgatacagagccgacggagccgtagtcgatcagaccgagccgatgacggtctgaccgagccgaggccggtctgaccgagccgaggccggtctgaccggccaccccatgtcggtctgaccggccagggcgatggggccctctgacagggctacaacggctagttttctagccgttgcagagtagcacggtctgaccggccacatacctccggtcagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgttagagggttgattagccaagagtcaagtgcatttgcttccattgtagagctagtgtggcacttgatcatctccacgtcgggtcattgcttgttactcttggaggttgccgcctcctagacggcttgtggagaagttgcccggtgacctctccgagaagattgtggaggaggcccggtgccggtttgtgagtggtttggagttcaccaccttcggagtgaaggaagaactaccctagtgatcaaggcttgggtagttctctccgtgggccggctcccgccttgcccaccccttgacgaagggggcgtgcggaggcttcgtggttgagcggtggagttgggctcgcctcaacggggagtaggaaaccggcgagtttccgaacctcggtgaaaaatctcttgtctccttgtctcatttgtttgtcgcatttacttttgtgcaatttacttttctagagacaaacttgagatcatatcaccctaggattgctaaacattgacataggagtgtgatttactttcctagagatataattgagcctctatcaccctaggtttgcaaaacataacttagttgcttagttagagttgaccctcaccaagcctagcaacttaggttagttttgattaggtgtcatttagttttaaatcgcctattcaccccccctctagtcgacatctcgatcttacacaccgccgcatcctcccagcgctttgccattgatgcagagccgcggagctcgagggggcggcagactcgtcagcatagcccacctcctccaacacccttgtcggcgccacccgtccccgcacgccgccgcccacacccatccccacgcaccgctgtcttccgcgtgtctctacgcactaccgcccatcgcccgcgcgccggcgtcttccgtgtgtccccgcgcgctgccgcccacgcccgttcccatgcgccgcgagacctcagtagccaaccccgtcgtgttcttgactgcttccctcaccgggaagaatgaatggagggagagagagaggaagagaaagagaaagagaaagataaaggaggggcaatttggtaagccatgtaaaaaagtgggcccctctcgcttagtcagcacaaaaatattaatttaatggatagagtgtcccctggcaaataaccacattttgagagtgtcttccctcaaaagtgacttcatgcagtgtcctacagctaaaaccacgaagtcgcgatgtcctgtagcaaaatttgccttagtgccatggtccaacatgacaacgctaatgacgttggcgctgtcccctctgcccctccgctagaagctaagttaccaatgaacaagaatggtgttgaggattacaatattatgctataaatttgatcaaacttaaaaaaaagttaagagaaaaattaaatgacttatactataaaataagggagtataagctaacagttatataagaaatccaaaataaactcgtacatataatgataccttcagacttgtatatataccacgtaactgcgccaccatatattatcaaatttgtcatctactagaaaagatgcccgtgcattgcaatgggtagagccaatttaatttgtacatatgtgtagtggataaataatcacgcccattatttcgtttattcatgtgcctatccaaattacttgttaccaaataaaagactatttatgtgcaaatctcttatatacatgttattagcgacgcaaagtaaatgctgtaaaataaagtatgataaaaaaagtcattccgccaagaagaaattactaccgggttcgttttttcattatagaatcggaaccaaaatgtcgaaatcaaaattaatttctaaaatttaaaatttggcttagaaataagcataagccaaacaatgaggccttcaaacacgagcttgatttgtcgttaacctttatctcaagtcgggcaggaattgatgacaaacggaatcaacaattcgatcgtcctttattttgattagcatgttcttttcgaaagttgttgacgaaaaacacgaggcctgggagatctgcttaattccaatgcaggtccaaaactcgcattcgggtatgctagcgtgctagttgatttgatcctgtaatcaacaagaaataaagacaaagaaaccgtggttaaatcataaacgatagccgatcggctaggtgctgatgacatatcatttatctttgagccgatgtcatatatgcatcgataggcaagcattaataaataaaacagaactaaatctactcgatcggctgtagatattaacgatatataatccttatatcgatatatacttaaatcaagtaattgggatagatcggtcgccatgctgagacaatataaatcacttagatcgaaatatatattaataatgagattatatatgttcatagcatagccgatcaaatagatctagcatgtatcggctaatactccgatactgctctatactaagatatcaaagcaaatagaatatatcaaacaaaagcctaatatacttaaatgcaacaagatcttaacataaagagcggattcaacatatcaatgaagcatataaaacaaatatagttaaaccaggtaagatcggctgaaaccccgatactaccctaatcggcaaccaagaagcaagctagagattgagactctaatcacaactcataagatcaaaatcaaccgatgcagctataagtatgaaaagaagaacaatatctagacaattaagccattggaagtttcatagagtggtggatatcatatataatctaagccaatattgatatttaacctaatcggctgccctctattaatagacgttagccgattgtagattagatagcgatattgtcagagattatataagatatatgatagctcgatgaattacataaacaagattagagtatcataaagatggaagcactaatcccgagaacgcaagccgtcataacaagttttacctcttgttgaagatcgaaaccgatgcagctcaacctaaaagcaagaactcgtcgaaataaaactaaagcaaaaagggtggcgatgcgccgagattgtattgaacgtgtgttaaattgattacatagggctcggggtttatttatacccgagaattatacaacatatccatatcggagacgactcttatccctaacaaactctaagataccataagtctttacggcagacttttgtccaaacatatctctaaggaaattacataaaatattctaattaatagatacaattgtcttctcaggactctattcgtgcatggcaatcatcttgaagcatatcaactcaacccgatgtcgtacaccaagtcatattgtcggaatcggctgtattacccaacccagtctgacttggatttagccgatcccgatcgtaaccgatttggaccccagccgattcttactctgtttccgcgacgatcttcatctttgattccgcttcgatctagtcttcttctccgatactgatattaccaaatttggtcattaacaaaagtataactgattcttatggattaatgtaactaggggtgaaaacggtaccgaaactttccggattccgggcctgttttcggaaacggaatcagccggtcagaattttttcggaatttcttagaaacagaattgaatatgatattagcagtttacgttggaactcggaataggtcgtaaaaattctagaatatttatcggaatttccgaagttaaaaaggcccatagaatcaatagtctataagtgtccccaagttcctagcccaacccaaaatcgcggcatctacccaaattggagcagctaaccctagagaggagagagatacacatgggacacggcatcgccatcgcgagaccgcgagccggcggcggagcagtgcatccagatcggggcatcgcgctccgcccaccgcccgcgcccacctcccacgcccatcggctcttcggctacttgcgacctcgccc

SEQ ID NO: 42025 - DNA, 972 bp, Oryza sativa
  unsure (1)..(972): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgaaatgtaaacttaattttaagcttgtgaggatgagtgaaaccaagatacgtggagtgaactttctgcttgtttgaagttgttgggttgggcaggtgacaaatcacaatgtaagtgtcgggcgattcctaagtatttgtcctttgcatgcactgaaatgagatcattggtagagtgagctgatgtgactatctggtctcgtggcttaattatcagtaactcaataatagacttacaaatttagtacaaaccaggaagatgaacacaaattgtgtagattgtattgcgtgacttaatttttcatgtttaatgtcctgagcaagttgtgtcagttactcctacctttgctccgctgttagtttttgggtaagtcacactaggtagtagccgttgtttatttttctgatcagtgagcatctgacaacaaaatacagtcaatcattatttctttggttagcttctcctgtgcttttttgttcgagatgtaaacttttatgatcatttaggagctctggacagtaatttcgatattgtgtttaacttcactacatttacatataggcagtacatttacaactagccccctacagcaacgaagagtggtaaaagaattgcaatttgccccttcgtgttacgtaccaccctaaaacccacaaaatctccaaattcctcgcctccctcatcgctattccgtacttcaccaccacccaccgctccctcatcgctaccccgtacttcaccgcctgagtcactaacccaagccatcggggga

SEQ ID NO: 42026 - DNA, 4834 bp, Oryza sativa
  unsure (1)..(4834): unsure at all n locations
ttcctgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaaaaggcaagacatagtaccagttggctgaggaaatcattctggaacttggcttcagcatttatctcctgggccacctggaaaaaatcaatcaagcctcacaaactgagcgcccagaaatgtgaacagaacccaagatcaacagcttatgaacaaaggaaaaaaaaaatcataacttgaaggattttcttataaagtcatactcgttactggttgaaatctggcataacatgtacacataatttatgggattgtacagcggcctaatacaaaaggtgcaattccatatgaaggttcaatgaaattacataatgctcataacaacaaagacaatattaagtaccatgtcactataggagccttagtttggacgtacaagaaggatttattttgctaaaagtaaatatctaaagaacctttataaattcttaactctccatgagttcgggatttacaacaatatttcttttagatgtttagttgtagagaaaaaaaatacttaggggatgaccaaactacggctcttacaattgataggtcactagtgccaagcaagcaaaagaaaataaaagagcagatggaacactgcaatgtaataattatgtaaactaataaatagatcaagacaatgtcctgatcacctaatcggagtttgacatcatatcagtgtcgaaaatgccatcacatcattgaaacaacctagacaacaaccattttgtaacttaacatatggtattgatattaacaacatatatcaaagaagcaggcaagcagcccttgctccttagtttgaagattatatcaagtataaaacaaactgacaagatgagacgcacaagaaacaatatagttgatcgatcaaattacgaatcaaacatttgagaagcacaaagtttatcttacagcactgcatattaacacctgaacatattgggagcaggtctaaagttcaaatgcacacacaaaccaatagacctctaacttgcaaataatggcaaaaagtccacaattgagcatacctaacagaaattaaaaaaaaacagaaagaaacaaggatggagagaaatggaaatcttacgcctttcagtaggcgaaccctcgagtgcagcccatcgatctcctcatcaagatcgccgtgcaccggatcgatccgcagctggatctcgtccgagctcgacgcattcctgcaatcaataccgaaagaaccccgacaaccccccaaagttatcagggactcgattcagttctccggagcaaagacgagggattcggacgccaccggcgcaagattggatcgaacgaaaattcgctggctgtgggtgcgggttttacctggatcgaagcggacccgagccgtgcagcgggttcgccatcgcgcttaccagcgcagatggggttcagctcgttccctcgcgacttagatggaacgacgaggcggcggcgcacgggaaggagggagggggtggcgcgcgcgcaacggcgacggacgacggcgggtggaggccggaggggaggatggaggagaggagaggacgggaaggggaggggaagacactagaaggaaggcttcaaaatgaataattatttttaggaaaaaaaatttctggttccttcctaattaatggagtaatacaaaattatcttaaggtgtgcttttatacttcacttgtccaacttttacttcctcagtttttatacacaagcttcccaaactattaaacagtgtattttttttacaaaaattttctatatataagttgctttaaaaaaatttatattaatttatttttaagttttttttgctaatattgaattaattatgcactgatccattgcttcgttttgcatggtaagagaaagggttcctaataacttgaaacgagcgcatcctaaagcttggagtctcgatcaaaagttttgcattgatcaacaatccagaaatccggttgaagatataccaaattgtgtttgcattggaaatccggttgaagaagtaccaaattgtgtttgcgttggaatcttaattgtaaagcctatgaattttatagatggtcttatggtttaattgtataatttgaccattagtttatttcatttcgtattatgttatcatcaactataaattagtataacatgaaagtattttaaaatatataaatctagtgttatcatagatattgatagtataattattagtcaaaaattgccaagtttgatttttttttaaaaaaaagggcgccctcttatttggggtagagggaatattaatttaacagtttgaaataaggaaaatattattactaaggtttatctcacataaactcttcttttaatttaaatcatacctaatgttaaccatgttataggagacgaaagcataagcaccaatagaatccgatgcaacaaaaaatctggtccaagaccactggtttcgaacttgaaccaactaaactgtacaaatgtccatactggtaggatgaatgaaagtacgcatttctcatatattattgatcgtgagccaataccacattcgaccaagtgaatatttcatagtagaatctgtggaatattagtattttctttacatattagtatttcctaataatcatgaaatgtagtctagcaacagtaagagtcccaggagaatttgtttcaactcgagattgatagagaaaacacctctttttcacccatacgcttcccgaattattaaacgtgtgtattttttgcaaaacttttctacagaagagtcgtttttaaaaaaatcatatcaatccttttttaaaactaggcattcaaaaaaaaatccttttttaaaactttaaaataattaatacttaaattattcatgcactgatagctcaccttgatgtatctccccaatattctctttctctttttcctcaaacacaaccagttcaaagcctcaaattaattttacattgttcaatagttcctgaattggaaactgagttcaggttctttacagtgaaacctattcatttggatttaagttatagatttgatacattatttttttttcaaaattcaaatcaaacaaatacctacttgtaacgtgtttgaatcttaatttccctattatattaattttccagttccaaaataagaaattaattattaccacctactatataggtggaataggtgtatactattcttttttaacttaaattagtatataaatgtttttagggaaaattagtacatgtaacttactccctccgtcccaaaataagtaatattttgcactgtttacgtctaaggtttgaccgttcgtcttatttaaaaaaattatgattaaattttttattgttattactccctccattccaaaatataaggcataaccacccctaacccaaagaccaacaaataattattatcatcttgtagtttggatcatcctaataaatacaatgcatgcatccaatagaattatagcaagtttaatagtatagcccactgctagctctaattcatttatagccaatctaatagctaattcatataatagttgcttactatactactccctccatctatttttgatagttatatttctaaatctgaaaattttatttttgataggcatatttcaatccaacaacctatcctcttaatgattttctcgaatttaatgcgtgactctctattcttccacacatgattggctacatgggcattgagaaatgtaaatattaatgaatcgcttgtttacgaggaatgactagtagcatgtttaaatggatgataagtagaattacttatccttggtctgtgtgccaagatgaaatatgactatcaaaagtagatggagggagtattaatttatggtcccacctatcatacacatattgtgtcttgtagtccgtggtgcagttggctacagatctgtagaccgatgctcttctctctcatcttttatctcattaaaatatatttatagctggctaatagtctgctattgtacctgctcttagagagcatgagagtgtacgatttaaaaaagtaataatttattggagaagtggttatagttaattgttgtcacgcccggaaattcactagtaattttcgaactaatttgtgcataaaatcctcgtccagaaatcagccgaggtacacaaactgacaatttaatatacaaatccatcataataataacgttacatacttacaaaagaaaagaaaaacaacagcggaataacggtctagcgatggcttcagctccactcccacaggcagctcaactggggtataagccaaacgtctgctccttctggatcctttctcttcaactgaggttgattgattattgcaaggatgagcatatgacatactcaacaagccacacagcaaatatgcaagtgcacaagaataccaaaggatggcataatataggctcatttgcaaaagcagcatttagcaaacatttaagagaagtaaaacagtagagtaattaatcatcaattttaatcaacactgaacagcaccccaatgctgcacaggcccaaccatcctaaacaaccatacccggctgtacagatctaactccaaaccaggagcta

SEQ ID NO: 42027 - DNA, 2340 bp, Oryza sativa
attgtcatgagcacgactttcaaaaccatatactcacaacccaccattgacaagttttaattatcaattaattatcataacacgataaccatgagctacatttaaatctaaccataatttaaatctaaccataagaaatgatgtaatatgattcaccccattaatgagctaatgtttctaagcatggctaagcaattatatatatatagcatttagctgaaccaaaccaatatataaggttctagctaatcgaattataactcataggaaaataaagtcatcttcggccattaattaattgggaaaggctcaccacccgatgacattcgaaaataatgcataagttgaaataaaacattagctttaaacgggttcaacatgcttaaagggtcctttgggatctgtgtgacttgccttgagcttcctcaaacgcttctgaaccttcctcaacgaaaacgctctcctccaaaacgtcagaaacttaagcgaaagaacaaaatcaacaaaacagtacaaaaacaagcataaacagtacatgtggatatttttaacatgtaatgaatttagcaacttgaaccactcgaatccgagttacgatgatttagttatgaatttccgaagtttaatcgattttcatctaataaagaaaactaagaaaagggattaatgacgtcatcgctgacgtcatcgccggccatggcacggcttccacgcgacgaccggcaaaagagagctcggttgggctatccgagaacacctacacgtagaggacgacgacgcgaactcaccggtgcaaagaacaacgacggacggcgacgaacgacggccggcgacgaccacagcagcggcgcgacgcggctgaaggatcgccggcgacggcggcggctagggcaacgtggcggcggctctacgggcgacgatggagctcgggacttggggcaaacggaagaggacgactaggggatgctatttataggtatgggtggaggagatcggctcaggaacggatggatttggtgaaggaagttaggatttatccgagttcacccgaataaaaacggccgaaattcgtgagatagataacgaatttgatgagggtttcttcgggattaggtagaggagatagagaggaatccgttttttcaatcaattttgggagggaagcaacggatgcaccggatcgaacggagaaggcggcgttgcaacgcacggcatcgggcagaacaggggctctggaggaagaagatgacactgttgcgagagggaggtaaagcagactttaggctgggctgaggaagggagagagaagaggaaggaatgggccgaaaagggcccaagctgaggaggaggatttttattacttttccaaataaatcaatcaccaaaatgatctttgaattgttaaaaatacttccattgctcaaataatttcaggaaaaatcctgaaaatacttggacactcaaagtacttaacaaaattaaaatcagatcatttaatgattaatttaatatttaaataattgctgaactactctttgtaggattaaaattaagagttgagctccgaaaaatccgagaaaattccagagagtataattaacaatggagaatttaataaaacttaaatccagccatgctttatatttagaaaattttatttcccacatttaacttcacttgtaaattaatgaacatttaatataaattctaataataatttattaaataatttataaatcctgaaacgaaaatcaggacgtgacaattgtctatatgcatgcataccttatattatggaacatcttaaaaaaaatggttgtgccttatattatggaatggagggagtggatgataaaacatgaataatactttatgtgtgactatttttaattttttttaaaaaaattaaataagacagacagtcaaacgctggatacggatacccacaactgcatttatttcgaaactgaggtagtagatccttagatggatagccttttaatatatacctccattaaatatgtgtttcctaggtggcctgattttagtatggacgcagagacataatcggagacgtaatctagtagcaggcgtaagcgtaacccagacggactatatatagttggaacccacccacccgttgcgttgccgcccagccgaacagccagaaatccccatccccacaccccagccagccgtctcatcgccaactggttcagcgcccattttggccactccacacgatcccctccgctcccaggccgacggtggtagaggcagaaaatcggatggacaagccagcggcgacccggcggcgggggggggggggggggggggggg

SEQ ID NO: 42028 - DNA, 2422 bp, Oryza sativa
ggggggggggggggcaaagcggtcaaggacccacgacgcctgctggtgctgctccttctcctccacgcagatccccttgacgaggggagcgaagcgaaggagcgttagccgcctgcgcccttgctccgccgcgccgtcgtcttggtgtagttggggcgcaaagcgcgcgcgcaccggcaccgcgctcggtcctcctcctcctcgccctaaactatcttcggatcggattcctttatttgaatccgaatcggttgatgggacggattggcgaatctcggtgaagggccggcggggctcatcgccgagcgcgtcctcgccaacgatgtggctgactacatccgcttccggtccgtgtgccagccgtggcggcggtgctgcgcggcgccgccggcggatgacgccttggaccgccgcttccacccgcggcagtggctcatcctccccgagaaaccccgcattcgctaccactgccgcctcctcaacctctccaccggcgagtgcatcctggcgcacctcccggagttccgtggccacagagtattcagcccctccacggagggcctcgtcctcctgctccatgagagcacccatgtcgcccgccttctaaacccactcacccaccagctcaccgacctcccaccggtcaccactttgttggacctccttctgccgctgtgtgatctcagcgtggacggctttggcctcgccgacgaccgcacggtggtgatccataacacagtgttcctcgccgtcgccaagcccggcgacaagtgctggacggcggtcaacctcagcgattgtctccggccgagcatgtcattagcgggtcgcttctacggcgttaccagcgatgccatcatggtggtggaggtcagccgggagagccagacgccgcagctggtggaggccgccgacctgacgttgcaacacaggttcagcaggatgctcggcagcgcgcacctggtggacaacaatattggcgagctgttgctggtgcaccgtaccctaagtggtaacaagaggttgtaccaggcgtaccgggtggatttggatgggaggaagacggtgcctgtccgtggtctcggtggtcgggccgtgttcatcggccatgactgctcgctatccgtgtcccctgctacattcccctcgatcgttggtgacgccgtctacccgggcttcgactgtggggatagaactggcctggagcacatcgaagcctatcacctggcagatggaaccattgaacactcatgctatgaagaccccggcaaggaatgggaacaccctgtaagtatcgctgattatctatcctcgtgggtgtaaataataggctacgatgcagcagttgtatccatcatctcaagactgtcccctgcaatgtgctgtttattttcgtcctcttatttattaagaggtaaaacctcacacattactgcaagagaaatatgataacaagtgaaaatagtgtgtaagatagctaaacgacataatattatataagttgatgtggtttttgatattttaaatagtatatcgtaattgctaaaaaaacaacttttaaatgtaactatagtatagcatagttgtagtgtaagtacaatgtaattacgctatagtgtaactatactataactatattgtaatttctatataaggtagatataaagttgcatatattattttaatacttatatattatagttgaattatattacaattatattatagttagatttaaaagtttttcccttaaagaacttgcggcagcttttttagataattattcaaatataaaagtaagatgatgtagctatgagaaaagaaaataaagaagataattcgaaccatagattaatcatctaagggttagaagcaactgagataatatgacttaatgagagaagaaaaaaataatattaactaagtgatgataacggttaggtactttggatatcgtaaaaaatgatgaaaatacatatggaagtcaaataaattggtctatattgaaatgttatgttgatgatttaaatgcttgcatttcaaagctctaatattaataaattatatagatataatacaacatgtttgaggtttaagatgtaataattgttagtgtaggataatatgatatttttgcatgttaagttttattatataggatttgtacgaaaatataaatgtgtagagtggagagtctaattattcctccaacgtttccttgcaatacttgcacttaaagagaaacagaagaatcctccagcacaatcatcaagatgagccgcgagtagcttcccttttggtggaagatactccctccgtctcattttacgtgtagtcgtgggttaccctcttatttgaaaaaattaacaaaaatttgtcacgcttaaagtactattaatgttttatcatctactccctccgt

SEQ ID NO: 42029 - DNA, 4419 bp, Oryza sativa
tagtaatagtatgaaccaatgtgacagtgtgctgattattattattattattattatatctgaaacctgatgctctgtgtccctgattgaattaattattgtgatgaaatgcagcacaggaaggagctccaggcaaggacaagggaccagctccagacattggagttatctacgtctttgtacgacacggcgtgggtggccatggtgccactgcggggttcccgtcagcatccgtgtttcccacaatgcgtggagtggatattacaaaaccagcaggatgatggatcttggggtacaagaggattcggcgtggcggtcacaagagatgttctgtcgtctacgttggcgtgtgttcttgcactcaagagatggaatgttgggcaggagcacatcaggagaggtacaaacgactgtgcatttacctgtcgatgtttgttttaattgactctgtatgtatctacacatttaaggcttggaatgtcttaacgctatgaaaatggtactgtcaggactagattttattggaaggaatttctccattgccatggatgagcagattgctgctcctgttggtttcaacatcacttttcctggtatgcttagccttgccatggggatggatttagaattccctgtcagacagacggatgttgatagacttcttcacctccgggagatagaactggaaaggtctgttaattctaacacgaacatggatattgtatgtcattagtatttgtattactgttgttacgagtatgtaaagttagtatgcaagggttgattgtgtggatgaagttttaccatcaggcgttctaaaaataactgtcagcttagttttattccctagttccccctgcattctttttgaaggaaggaatataatgaccttctcctctctttttttccaagatcctatatttggaggaaatgatcaatctcggttttaatagtgcctatgagtaacgcactgaaaatctgatatgattaaatgcagagaggctggagaccattcttatggaagaaaggcatatatggcttatgtcacagaaggattaggaaacctgttggagtgggatgagattatgatgttccagaggaagaatggatcatttttcaactgtccttccacaactgctgccacattagtcaaccactataacgataaagccctccagtacttaaattgtctggttagtaaatttggcagtgcaggtgagtctgcacgcattttcttgtcaagaactttctacagtgtagactgctcctaaatacatagtaatacatttggtccattgcagtaccaacagtgtatccactaaacatatattgtcagctttcatgggtggatgcacttgaaaagatgggaatttctcagtattttgtcagtgagataaagagcatcctagacacaacatacgtgtaatgactttgagtaagtattttatctatctttaatagttcaaacttaattttagctagtttgcagttcatggttagaaagagatgaggaaattatgctggacataacaacatgtgcaatggcttttcgcctgttaaggatgaatgggtatcatgtttcctcaggtgtgttctaaggcttgaaaggaatattttttttgttggtttcgaactatattctacctttggttttcatttaacatgctgaattattttttatttaacatgctaatttaaatgcggtgcagtcgagttatctcctgttgctgaagcttccagtttccgtgaatcacttcaaggatatttaaatgataagaaatctctaatcgaattatacaaggcttcaaaagtcagtaaatcagaaaatgaatcaatcttagatagcataggctcttggtcaggtagcttattgaaggaaagtgtgtgctctaatggggtgaaaaaagctccaatctttgaagaggtgcttgcatgaagttttgaatttccatttcattcggaagttcattttgtgtttaagtatatgccttttgtgatttcagatgaagtatgctcttaagtttcccttctacaccacactggaccgtctagatcacaagaggaacattgaacgttttgatgcaaaggattcccagatgttaaagacggaatacttgtaaggttttcattgaaaaggtctgccaatctgagtaatatatatgttaggcaccaattccactatgttgtttactcaggcttcctcatgccaatcaagatattctagctttggctgttgaagatttcagtagttctcaatctatataccaggatgaacttaattatcttgagtggtaggtaatccagcctgctgtcaatctgtcatgttatgctcctttattgtactaccttggataaattgcaaaattttgtttgcgacagttgggtgaaagatgaaaagctcgatcagctgccatttgcacgccagaagttgacatattgctacctttctgctgctgctaccatattcccccgtgaattgtctgaagcccgcattgcatgggctaaaaatggtgtactgacaactgttgttgatgacttctttgatcttgggggatcaaaagaagaactagaaaacctcattgctttagttgagaagtacgtacaatcctaattcattctattcgatctatttgtctggtcttttgtaagtggcgctggttatgcacagctaattcatcttctctgatttgcaaatggctgtctaggtgggatggacatcaagaggagttctactcagaacaagtaagaatagttttttctgctatttatactacagtgaaccagcttggagcaaaggcttctgcattacaaggccgtgatgttacaaaacacctaacagaaatagtgagtcccatctcatggttgatctattgattctgtggtgaatattgctctgttgcatagtgtttagtgataagctcaaactcatctgcagtggttatgtctgatgaggtctatgatgaccgaagctgaatggcagaggacaaaatatgtgccgacaatggaagaatatatggcaaatgctgttgtctcatttgcactgggacctattgtgctcccgactctgtatttcgtaggaccgaagctccaagaggatgtcgtcagggatcatgagtacaatgaattatttagactgatgagcacttgtgggcgtctcctgaatgacagccaaggctttgaggtacccggatccctttctgtgacaaacctccttgtattctcatatttctacaagatttagcatgtaaataaaattttcggttttacttgatgttatatgattgcagctatctcattctctgcccacaaatttgttgactaatctgtataaatgtgatactaattatgaacacttttatttttctgttgaaggattaggacgtggctacagttcgacccaactacccaaagcttgcaaacttattctaacaaataatttctctattgctgcagagggagagcctggagggaaagctgaacagtgtctcactgcttgttcatcacagtggtggttctatctccatagacgaggctaaaatgaaagcccagaaatccatagacacttccaggaggaacttgttaagattggtccttggagaacagggtgctgttcctaggccatgcaagcagctgttctggaagatgtgcaagattgttcacatgttctactctcggactgatgggtttagctcgccgaaggaaatggttagtgcagtgaatgcagtcgtcaaggagccacttaaactcaaagtgagtgatccatatggctctattttgtcgggcaattgagtgcttctccgttctgttttatcagggatatcagcaacgagctttatacaggttgatatttcttttctttttctttacgataagggtttaaatcctagtacccacgattatagctgctgtgtgctttaagtataataaattttacactcttaccatttttttttaatgtaaatgttggtatatattggtacctgacataatcagaagcaccaaattatacactccttttgtcccagaatataaaaatcgtctagatttgtagtactagaaaatgtctcatccaataattcttaactaccgtcaaatacatttttttaaaaaaataaaattactctttctgataattttgtgatcacgtggcgtgcatgctatttcacaaattttcttctacggtattttacaattgaaaagattgcttgctacattcagccccatctacgtgctaataccaatcttgcacgagataatgatgtatgtgatggttggcatgacttttttcattgttttttttaaaagtacattaatttggcagtagtttggactctagactgtagacagccttattgcaacctatagactatagttttataatgcattggcacatgcaaaaccgagtactccctccgtagt

SEQ ID NO: 42030 - DNA, 8366 bp, Oryza sativa
ctttcaacaacttgagagttattcatgatttatatttccaaggtttgacttaaacattgtactaaacgacttcttttatgagtaccggagagagtatatatttctctattgctttaaatgcgaagtccgccaccatcgtactttcccacacacaaaaaaacagtcttgaaaaaccaccttacccaataggtatacccacgttaaactaaaccccataaattcatttatctatgtttctttatatcccgctgcaacacacggatatatcactatagcattagttaatagaagaaaaactgaagtgagctgaaacaaaacatccttgtctactccactatgtccctttttgtaataaataaaacgaaatggcagcgcgaatgctgaacaaacgacgtcttatgtgcgcctgatgagtgacatgctatttttagtagtttagtatatatgatcacgctataaacgagtagtccacatgcacaatggactgaatctcaccgacgtggataagacttgatgtgttttggaaaatactccatataaaagtaacatatgaatgcattcccttagtgggaagaatatagtacttattatattattattaggaaaggaaaaaaaagcactttgatgtgcaacaagctaattaagtgcaagtgttaggtggtgtttggatctttgatgtgcaacaagctaattaagtgcaagtgttaggtggtgtttggatctttgatgtgcaacaagctaagtaagtgcaagtgttaggtggtgtttggatctagggattaaactttagtgcttgtaacaaaatgagtaaaaaagttgatcagatttgaggggaaaaaaaagaacataatgagatgtcctcttgtaacggtcaactagagacaacggacaacggacataactcacagaacaacatacattttgtgtttgccagtagtaactatagagaggaggatgtatctcactagctacccaaaaaaaaacatccctgcctgcacatcacatcactgttggttcggtgtgaatcggcaacgatactctatatatcattgttggttcactttaatttactgtttaaaccagagtaaacaatatcggctgtgtttagattcaaaatttggatctaaacttcagtcattttccatcacatcaatctgtcatacacacacaacttttcaatcacatcatctccaatttcaaccaaaatgcaaactttgcgctgaactaaacacaaccatcggttcggttgaggcctagaacaggtagagatacatcattcctggttcataagaaaaacgtgtattcatactcaacgggttagattatttttgagaattacacagtacaacgcagacacttacaatgtacgcacactcacccctacgaacgcacgcatgtaaactctacccctatgagcatattcgaagactgggccggcaaatcctagagattgacgaagtcaccacaggcgtctcactgtcgacgggtacgtcgcctagactaggtgcgaactactgtccagagaatatcgagccggcaggtattggtactcaaattatagtttttcaagaaaaataataaaatttttcatatgaagtctgatgaaaacaaactttacagagatgcacttaatagtgcagtggcaaggggtgtgtggtttcaactcaaaggtcccatgtttaatcctcaacacgcttataatttcttcttaaaaaagtttggagggtcgtctctccctcgcaacacgctcatgatttcttcttaaaaatgtttggagggacatatctccctccaaatcttgttttttaaacaaactttatatcgaaattatagagtttggcgatgataaatacacgttatagaacttaagttctctaatctacttcgattttttttttagtttttcaaacaacttcaaatgcatggagacaaactccatatgaaaattttagatcttcacgagattcgcaacttcttagttgataaccttttcatttaaaatcatttacatagcttaatatgttttcaagacaggaaaagtcaaaagaaaatattatgcaatatcaaatagctagcattcgttattctaccttccgtcaaaacatgtgcgcgcttttgatactgttgagttgggtatcatggagagcagatccatacgatcatatatttaattgttcaatcacatcaccaaaagaaacaggttttcaatatatattgaagtactataaatcatgctatatatacccctcttcccctccacaatacaattcaattccctcctaggtttgttatgatccatttgacacacgaacacacacatacactacactctccctagctatctttttccaaattctgatcacagatcaattactcttgatcgcccatttattacttcttcattttaaaccctcttttcgtttaattaacgtggcaaggagtgatatatacgatgctgccgtgcttgttcccggcgtatggtagcgtcgtagcctgcaaaccttccgcgatcgatcggtcgccttttggattgttgtcccagcccaaacaaactaataggactcttattcgtcgtcctaaggttactaaaggtacattatgttcatcattttatgcttactgtaaatatacagatgtgtaaggccggccatatattaatttcattatgtaatataaaagatacatatttatttatttattagtacaataaggtagttttttttaattccatatatattttctataaactttactaatggtcaggactgcctaccaaagaaagacgtgggcccaaaagataacttactgtacttcattttcatttaagagcaatacaaatccatgttaattctaccgatcgagataaaatttcgaaagaaaatttgtgtaaatattaacatccgtagaaggactggttgcatttgggattttctttcggatcgatacgaggacaatgccgctaataaatacctaatatatataagttgcatatataattgcattgtttgaaccatgttccacataaatatttcaacgatttatatcacatatcttccaaattacagcattcatggcgatcgaggccatgcggcactgcagcagcagcagcagcagcgaggaaggaggagcggcggcgacgacggcggccagatcagcagtacgggagcgcctccaattagcgccgccgtcgccgtcgccgtcgccgtacgacacggcgtgggtggccatggtgccggccctccgccgtggcggcggcggcccgcggttcccgcagtgcgtcgcgtggatccagcggaaccagcggggcgacgggtcatggcgccacgcggcggcggcgcaccagcagctcggctcctcgccggagatcgtcaccgagcgcgacctctcgtccaccctcgcctgcgtcctcgcgctcgcgcgatgggacgccggcagtgagcacgtcaggagaggtatagtagtagctcgttgaattctcagtcatctgatcgaccaatctctgatcagatctatcgatgatcgcaaatgatcagtgactgattgagctgctgctgggatcgcatatactcccttcatcccataaaaaataaatctaagaccgattcgtagtattaggatgtgtcgcatctgatactaggttgtttttttatgggacggagggagtacacatgtattgatgctcggttaaaatggagaatggattcttagagcctgtttgaagctgaagctcaaccaaacagtttcagcttcacctaaaataggagcgaagctaggtagagcactctcataaaatgctgattttagctaggctactccacaaccacactctagacctaactcctaaaggtaaattttagaagttggaaactctaccaaacagacccataattcatgagcggatgtctcctatgtcctatctttgtttttttttcacatcatctaaatatgtataatttttttataggatagattaatatgtgtgatatatcactccgcaagcatattaacctagctatatcttatcaaatttagataacatacatagtttgctggtaaatgcagggctgcagtttatcgggaggaacatgtcggtcgccatggacgatcagacggctgctccggcgtctggttccgtcgtcagtttcgcagcgatgctccggatggcgatggagatgggtttggaggttcctgccgtcagccaagctgacgtccgcgacaggttaattgatttgcatgtgaaagaacagcatttcgttcccgcgttactgtttgtatttttcagggtaacgtacggtacggtcgagcttcagaaacaagttgattaaattgtttaatttgctacctatcgaagatggattctgattcttgattggagagggtgtcacacatattacacgtttttactgttttcaaattcaatttaaaaagcgaattgagcatctctctctaatcagctcctaagctaagttcatcgttatgtgggggtgagtaagtgtttggtgatgtgagggtgagtatacgcaaggcgcctgcgtttatattttgtgtttcgagaaaaaaatatcaatttaaaaagttaaactgcgttgtatacgagcgcttacaatatttgtactttgtattttgagaaaaaaaatcaatttaaaggttaaaaattttataatataattaagcacgacatacacatatgacccgttagaataattaaatcaacttgaatttgtattttagtgatccatgcatattgtgagttgtgaggaatatcctcactagtgaagaaaaaacactttcggtacactggcaagctcctgcatttttcgttgggctggtctggctctagatgttcttgaagaagaaaccgtgttatttattttttttattactctctctaactaccaatatttggtgtttagggcgagataccatcgaactaattctatattaaattaagtttatggaatctaataaacttgtgtgttactacttttcaaagcaaacattatttgagaaattgttttagttaaagtttttaaattttttaaactactagtaagtcttattataaatgttatttttttatgatgggagggaatacttatttatctccttcaacttcatgagtcaggacaaggatctcaacagattaatttacacgtgagagaactacatttcggtccccatttttttaattttctggtacgatgtatggagcttgctagctaccttccaaagatgggctctaatacttcgagaagacgtccttttaaacacttttattttccaaatgcagtaaaaaggctataataaactatgataatataggtgtgtatgctatatatgttctgtgacagtgacatccaccagctcatgcatgctctgggggaaaaaatacattgacgacatggtagactatttattaatatcaagattaaaaaaagtagccgtcaaagtcacatttcccaaattaattaagaggtcaaaaaccatatagagaaaaggaaaacgcagtagtttgagaaaggggagataaagaagattgggaagatacgcaaaacaaggtgagccattagcgtatgattaattgagtattaactattttaaattttaaaaatggactaatatgattttttaaagcaactttcctataattttttttgaaaaaaacacaccgtttattagtttgggaagcgtgcgcgcggaaaacgagtcacaatcttcccaatctcctttgaaagaacgcagccgtcaagtcgcatcttcgaaattaattaagaggtcaaaatcatctacagaaaaagaaaactactataagtactccttccactttatattgctttgattttttttttctaaatcattactccatccgttctattttaagtgcagtcgtgtatttctgtgttcaacatttgatcatctgtcttatttgaaatgtttttatgattaatatttttattgttattagatgataaaatataattagtactttatgcgcgactttttttttagttttttcatagtttttttaaataagatagacgatgaaacgttggacacagaaacccacaactacacttaaaatagaacgagggagtattttaaattttgattaaatctataaaaaagtacagtacaaaataagtatagtatcaaaatatatatattaaatgttagatttaatgaaactaatttgatttagtgttatagatgttgttatgttttctataaatatgattaaattaaacttaagaaaatttggcttagaaaaaaaatcgaaacttcttataatatgaaaggggggaggagtatcaaaactatatcaacttgatcattacaataacaatcttgctgtgtaaattaattcagagatgctggggtgatctgccacggtggaagaacagaatatacggcttatgtctcagaaggattaggcaatattcagaactggaatgaagtgatgaaattccaaagaaagaatggctcactgttcaactccccttacacaactgcagctgcattagtccacaactatgatgccaaagctctccagtacttagacatgcttctggacaaatttggaagtgcaggtaactgcactttgtcaatggtttaataggatacgaaatataaacatttgctgaatgcctaattaatgtcagttaaaatttgcagtgccagcggcctatcctgcaaatattcagtctcagctctacatggtggatgtgcttgaaaagatgggaatatctaggcattttgttggtgagataaagagcatactggacatgacctacaggtactaagtactaccttaagataataagattagttgtttggagaccgtggttaattagcagttcaggtaaatgactaaatttggttgcagttgctggaaacagagggatgaggaaattgtgcttgacatgcaaacatgtgggatggcatttcgtatgttgcgtatgaatggatatgatgtttcttcaggtactttattctgctagaacctaaaaggataactcggtactttcttttacctacttaagaatcataaaaaaaatcaattgctagctcgattttatgattcttgagaagataacgggaggtagccctttgatctttagtttcagttccttgtaccaagctaatgtattgcattttaaaaaatgtggtgcagatgagctatctcatttttctgaaccttcaagtttccacaattcacttcaaggatatctgaatgatacaagatctttattagaattacataaggcttcaaaagtcagtatcgcagaaaaggaggtgatcctagataatataggctcctggacaggttgcttattgaaggaacaattgttatccagtgcaatgaaaagaaatccactctctgaagaggcaagttgtcaagtgtgaatttctcatctccattatttatccataacgatattattataattattattttgtattttcaggttgaatatgctcttgaatttcccttctataccatcttggatcgtctagaccataaaagaaatatcgaacattttgacattacaagcagtcagatgctagaaacagcgtacttgtaagtttttttcctttgatgaaacaagccagttccatcaaacctgacctattcagacaccagaaatcaatatatatttttttgccgggtcggccgaaaaatcgaccaaccagaaatcaatttgtcatgaataattaaatatttctgaaactaaacaggccatgtcattccaatgaagaaatcatggccttgggtgtgagagattttagtagctctcagtttattttccaagaagagctgcagcaactcaacaggtatgtacatctgacatttattgctcttttttatttcctatgtaaaccaacaaacttgcagataatttcgttacaattttttgctgcagctgggtgaaagagagcaggttggatcagctgcaattcgcacggcagaagttggactacttctatttctctgctgctgctaccattttcactcctgaactgtcagatgttcgcattttgtgggccaaaaatggcgtgctgacaacggtcgtcgacgacttcttcgacgttggaggatcaaaagaagaactggaaaacctcgtcgcattagttgagaagtaaaactaatccttaaaacaaattaatgtcttaaccaattctagttcctcaggctaacaaaaatttcagccctgataacgcttgtgatattcatatctaggtgggacaagaatgacaaaactgagtactactctgaacaagtagagattgtgttctctgcaatttatacttcaactaaccagcttggatcaatggcctctgtagtacaaggccgtgatgtcaccaaa

SEQ ID NO: 42031 - DNA, 35694 bp, Oryza sativa
gatccctgattctgtcataagaagccaagaatgcagcgagttgttccggctaatgagcaaatgtggccgtctcctgaatgatgtccaatcctacgaggtacagactacagaactactagctgttctgtcgagtttctaagccactgccaaattttaaattttaaattttaactttgtagtttattttaaaggtttttctccgaagcttgttttttcagcattgatttttaaacaatgaaaacagtgtctttctgaagagttgtgcactttctgaagtttgtactagaacttctgaacttgtgcgtcaattcgatctttctgaattctgaagttcccacgatgaatttgagtgtttcacactgtctcatgctgcagagagagggcagccagggcaagctgaacagcgtctctctgcttgccctccacagtggaggctctgtctccatggaagaggctgtgaagcagattcagagacccatcgagaaatgcaggagagagttgctgaagctggtcgtcagcagaggaggcgccgttccaaggccatgcagggagctgttctggagcatgtgcaaggtctgccacttcttctactccggcggcgacgggttcagctcgccgacggcgaaggccggcgcgttggacgcggtgatccacgagccgctgaatctgtcttgttctgtgtgactaactaacgacagaggctggaaatgcagtcaaacttctgtaatcctaaaaggaaagaattgatcttgacatcaaagataatgtcaagttagcatatattatgtagagattcgttgtgttggcgtgaatatcaagttagcatattatgtctcaaataattgggcaaagagagcttgaaaaagctaaagaggaaaaaggcgagagaggagtgactagtgctagtataatactccacatgtgaaggaatcacctttttgcacaagtattagtcgtgtaataatgatcaaaatcatgctaaacagctagttacaaaatctgcagtgctatgtggcctagaggcaaatggaatgactgcccaacaaacttgcaaagaatgtttgcacatcgatctgcatgcacatgcaatgcagcctgttctgctgcatctctgcagtgcaactccttcatagtaggtcgaattggcacttttcatagcctgcagagttcatcaaaaacagcataagagagagaaaatgacttcttagttgcaacaaaaactcagcaagtaggtagtttcaaaaactgaaatttagccaggacagtggacagagcatctgaatgcagagcacctgattcagtgcaatatgttcagtggcaagtgtccttttcttctctgttctagctagcagattgcactaactaaagcagtaaacactataaagtactatacaaaagatttaataaaaaaacattttgtttttgcaaaaaaaaatcatcaacacataacattcctaaataacacaaatccaactacatcaatttcccgtcataaaaaaatataccctaatattttgggttgtgaagaaagaatacgttgagaaggagatggtaataataaatgttattagtccccaaaaatctcttttttttcgttttgcaaaaagattcatcagcccatactactcctttcatcccaaaatatacaacatagtatcggataaagtattagaatatatttcatcttatactagattcctatatgtttcgtggaatgcgatgagaagaagaaaaatgaggaagagagggtaaatccccaaaaatcttttttattttttttgcaaaaataatcatcagcacgtactactcacttcatcccaaaatatgcagcgtagtgttggatggagtaaaatatgttttatcttattctaatcctagattgttatattttgggccgagaagaaggagaaggagaaggagaaggagagggtaaataataaaaaaatggtgttgttattatttacttgggtcacgggtgacgatggtggcggtgccgccgaagtcgcaggtgccaccggcggccttggtcatctgccagtagctgttgaaggcgtaggaggcgtgggcgagcacggtgtcgggcgtgtagcacgccccgctcggctggatcgacccgcactccgcccccgacccgcacgcgtagtccatcgcctcctgcattatcgggtccggcaccgtcggcttcgccacgcaccacagcgcctcccccgcccccggcgccgccggcggcgccagcggcggcgggtacactatcggcggcaagaaccctccccctcctcccccgccgccgctgttcccgcctcctccgctgctcccgcctccaccattgctcccgcctccaccgctactgccgccaccgccaccaccctcgccgccactgccgccgccgccaggcccaccacctacaccaccaccgccaccgccctcgcctccactgccgccacctacaccgccgccgccctcgccgccgctgccgccacctaaaccgccgccgccgggtccggtctcgggagggctgggcacgacgaagatcgggctcggtggggcagacccaggcgtgctcggggtgaagccaggcgtggacgacgcaggcgggctcggctcgaacgacggtggcgtgaagccgccgatggggggcagcggcgggggctggtcgtccggggcgaacggcgtcgaggcgaagggaggtgtcggcgtcggtgtcgttgtcggggtggaggacgacgggggcgcgttcggagggttgacgcagtacggcgagctcgagccgtcgccggtggcgtcggcgaggctcgccgcgtcgccgtccggcttcgccggagaaggagacgaagaaggcagctgcatcggctccaccgtcctgatgaagttgagcttgtacagcgcgttcagcagcgtgttcctcctgcttcgcctcatcagagctctcgcctctgctccatcaacaacaacaacaaccacacaatcaaatgcacatcaaaaaccaaactaatcactgacattacaacctagctatgaacctaccacactgatatgatccggacagtagcaagaacaccatcatcaaccacactgctactctcccatctctgttcttgcgagccatgtctagctagctgcagctgcactggggccagtagccactgatgcaggaggaggaggaggaagaggaggttgttatagcagaggccgcgacgacgacgacgaagggaaagaacaacaacaagtgtggattggccatgatctcaaaggcacaagggggggggggggggggcgggagaaaaggtcggcggcagcagcagaaagaggaaaaggtgagctcgatcagtgaagtggcagtggagtggagtggaggtgatgatcttgttcttctctcgcgcggccgatcgatcgatcccccttcgctttgtgcagaaaacgtcgtcgcgcggtttctagtagcttttcagtaccagtactagtgattatctccatcactctctcacttcacttggagagattaattagttggagtgtgtgctgtgctatcagtgtgtctttctttgtgtttctttttggtttggacgttttgcctttaatttcttgttgtttaattttggtatctatgctttcttgccactagagcaaaactgagagagagatagagggatatagatgggagaatgtgtggacgacgacgtgtttgtactttggttagcttctgggttagtagcttgctttaagctcaaggaaagcatgcatgaacaacagatcgatgcagtggtgtggcgacgatcgatgctgtgtcgtgttgtagcatctgcatgctgagatggaaggtcgattaggataacatgagatgcgagctaattaagctagcttagctctgtgaaaagttggtgatggcaacgtgtgtgatcgatcatgccaggggtcagggtggttttcttgtttactgattggcttatcagagacgtagggttcatctgagcttaggttgaccaatgttttggatggatggcttggccacctttgccttttcgtttgtgcattttaatgagacacttgccgtggggtttcaggcttgatcagtattccaatcccctacagtctacagacgctttctgagttttttttttttgagggttgggggggggggatgataagcttaggcattcgtgatcatcctgtgtctgctggttaatttgtcaatagcaattgtaaatcaatcacctgttaaaggcgtacagtttgattaagatgtacctaataggctactgaggaggaaagatcaaccgctgtcagaactacaagcatgtccttacataaaaaaaactccagtttgattaagatgtacctagtagcaaaataaattcttttttgctactagctgctatattatcgcaaacacgtttctcaaggtgtgtgttttttttaaaaaaatagtttgcacacacaagtttttttaagaaaaatcaaacaaatttattttttaagtttataatagttaaaaattaattaattgtgatataattgagcattttgtcgggtagggaaacaagaaacgttctccatgggctgtcgccggagtcccgcttcagtgcaaaaggccgtgcagaacgccgcctgcggcctgctgtgacaacccacaccggccgcgtctacttgggccggcgccatcgccatgcgtccgtacaaaacggccgcggatttcgctcgggacgccactaaatcggcccaaaggccgttgattatgctcgggaccccggtaatccacggcccgtgtgggtcgcgtttcaccgaccggtttttgtgtgcgcgcttgctttgcagtgcagtggctgctgttacatcagcgagcggagataactgaactgaacagtaattgcactgcacggaggctgcctgcctgtctggctactgtagacggaaaaaaatatgtagccaaaatttttactcatgagtaatagacttgctagtaaaaattttactcgtgataatatgaacaaatttcagacgtctatttcttaacccaacgttttcaaatttcgaatacatacgtagttttgaccgtatattttgctaggggcatctcgatcgagtggccatccgtcgcatcgggactactactactactagaaaacagatttttacaaatgaccaaaacagatttttctttttttcagacgcccatccatcacgcctgcactttttgttccgatccatcgccggtcttcgctgactaattaacttacgcgctagctatcacaccttaattggtacaggcatatgttaattaatatgcacgctacacgtacaccacgtacagacaacagccgttcgatactttggataagaccatatcgtttcatgcatgaacagtgtccatgtacgtatggctgcttggtgcctgggcaatgcactggcggagttagccatgggacatgggtacgtaagtagagtgggctgaccccatagcttaattttatacattcaccttagaggtctttaaaatttctatatgaatctattcagattcaccttagaagtctttagtgtactaaaatataaagtaagaataatccaccttatgccaagttagttggtatttaacttctgagaatatagaggaactaggtttgtcagcttctagagtttctagtttatttcttaaaatcaaattcaaaatctgaattgctcggggaagatgaagtttttgggagaaactacagctgtacaagatctaatatataggaggcggcagccacaggaggcatacgttacgttgcatgtctcgatcgatcggccggtttaattcgtcagcgaccaaacattcttggcgacgatattatggactattgggccataaagcgcatacgcatgcacgtcgtttccttgctagccaggaggatgaaagccgcaagcgcgcgtaccagtttatcatgcatggactgatcgcttgcaacttgatcaacggatgaccgtttggtatatctatctaatcatcaatagcatattatttgtatgtagaagttatatatgtcgcatatgcatgcatttcatgtcatgtatcttcgttttttaatatatgatagtaccgttgactttttaatcaatatttaaccattcattttatttaaaattttaaataagacgaatgaccaaattaacgtataaaaagataatagcgtcatatattaaaaaataggggagtaattattgaaaagattagcataaatatgtaaaattataataaaattatatgttaagattatagtttatttgataataaaacaagtcacaataaaataaataatatttatatatttttttaataagatgaatgatcaaaacatcatgtgatgtcaaaagttgacagcatcacacattaaaaaataatagaggtagtgtagtactccctctgtcccataatagaagggatattatggattttgtagggatgtaacacatatcctagtactatgaatttggataaagagtctatcaaaattcatagcactagaatatgtcacgttccttcaaaatctcttatacttcgggacggacggagtattagttttgctccagcgtttgccgctgctcacagccaaacacactcgtgcgatcaggtaaaaggaagaaaagagctttgctctttttgactataagactcaagggaacctgttttttacccctcgaggggatgttccctcgttatttgcatgtcactcaaatgattataaaaaaatttaaaaattctgagaagatgtattaacatgcatgtgatatatcactccacaaacatgcaagttcaatgcgatatggagctggtgctgtggtgcatatactcacatgcatgggcggtgtaagtgtaacgctccgcttctcgtgagacgttaaaaaactattttggcaaaatcctattcgcgaaaattttcgttctttgtgtgtgagtctaagttgtgccaaggatctcaattcaatcccattgttccctctcatcgaaatcaaaatcctctgcctcaaatttcctcttccaattcaagtctccaaaatctaattccgaaagtcaatcccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagcaaaagtctattttgcctcccttgtcgatgggctgattcctctctctcacggcccatcccctcctctcggcccagctctctcgagcgtgcgtcgcacgtgttcgggagcgagagacagcgccgtctcctttctctctctctcggcgtcgcttcccgccgacgccgccccaaaattccggccgcgtcaccgtttcccgcgtgctcgcgcatggtcgaccggcaaggacgccgctcccaccgccttcgcccttcccgcgcgggttcgcgtgtggccaacgccccggtcgccgctgcgacaaaccctggcgccgccagcgtcgtgccctgccgcgctgccgctccgccgctccacgccgctagcttccaaggccgagagaggcagcccctgtctcactcccctctccctcctccttttcccgtttcggcaagggtcaaaccctcctttccctcttcctttcccctttttcccgaccaccgccgatgtcatccatggtcctagccgctcgctccggttcgccgccgctcgccggaacgcctcgcgcgtcgtcggccgtccgatcccgggcgcctcctcctcctcctcctcctcccctttcgcccctgcccacatggccgaccacgtggcagccacctcagccccgggcccgcttgaccgggtcaagtcgcgcccagtcagcatcctccctccgtcttccctcccgtgcacgcggtccacggcaagccgtgcggctgcacgtgggcccgccgccatccgtccacccggcgcgccgcgcccgaaccacgcgcacctgaaaccctagcacccgcccccgcgtgcgccctccccaccgtgaacccgaccaccgccatgtgggtcccgcgcggtggaccgcgtccacccgcgtcggcctctctctccccgcgccccctctcctgggccgcccctcccgcgcccgcgccggcccattaggtccggcccagccgcataaacccctcgggctgcacctaagccgccctaggaagtctatatggcatccctcccttctttttcaagggatttaataaaccctttttcccctattccataaatcaattccttattcccaaaattccataaatcatttccttggtcccgcacgtcagtgacggtcaataatatttttgagaatattatttctataaatttcataaatcaatttctccttgttccacaaatatcttcctttgcccagaaattccaattaaacttccaaaattcatatctctcaatccgtagctctgattgactccgttcaacttccagtatttccataaaattgagatctatttaatggcactactaattagtctaaataggatctttcttttggtcttttgtttaggttttcgattgtttgcgtatagttgcggttaccggattttcgtcgatcgcgggttttctcgaagattcgtgaagcttcgtgcagaccttgagcaaggcaagtcaccctctgaccaattgctcctataattggaaaatcattattattttgtttgcaacttgcattattagaatcacacactcaacttgcttggcctcggtatgcgtgccaaaccgacggacctacccagtagtcgcactaattcatgtaggttgtgctaccctgatttccttgtcgctccacctttgtggtacctcagtatccgtgctatctgagcgcgtataccaaatatcccacatacaccgttgtttgtcgaaaacttgggaaatgggttcgagaagccttgaaaacccgacatgtggtgtcggcgtgtttgaaaataaaatggattgtgaaaactcgcgatgcgggggttgtgcctgtgtggcactgtcccgtattcgcatataaggaccgattcctgtggaaaattcatccgagcatataacaagtgcgaccacacgggtgcaatgggacgcccctggctgagtaattagctaatcgggggagccatgatgccaagagacatgtagattcaacggggtggtgttggggagaaccctcgggcttcctggcacagtatggtctgggacctaatctggtgttagtctgggacccctctcgttggcatatggtgaacctgtgtcggctttcgaaatgccttgtcatgaaagccttaaggtctcccgacgtggctgatctcacgggctgggtgatccgggttagtaatgtcgtgtgggtaaagtgtaccccctctgcagaggttaactaattgttcgaacagccgtgcccgcggtcatgggcggatgtgaggtgtttcctgtagcgtagatttgttttcctgtgctttgtgaaaagttgttgtggtgtgggaatcgttaccagaatcagcctatgtggcagatggatgacctgagtggtcaagaaacgaatctgtgtgattcgggatgtctacgggcatcatagaataggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaattgagctgttgaaaaacatctcttaaagtcgaatcgagacgcaagtctcttttcggcccaaacttagaaagaaataaatcacttagtgatttcaaaatgatttcaaaacaaaagatttgcaaaaacaaccttgccgctcttccaagcttgcattaaacacctaagttcccgtgacttgctgagtacgaaagtactcatccttgctctatataaatatatataaatatatatatatatatatatatatatatatatatatatatatatagttcctccgccctgaagctgaagtgaagtgaagattagggtttcgtcctggttcccagctgtcgcctatggtgatgggtgttagttcgttggttccgctgctgctgctgctggtgtttcttcgtccgtgtcgtcggttgcattctcaggctgttctgagctgcaacctaagttaaggtaaataagtcctctatttattataaggattgcaatgattcatatttgtcaccgtgggtaccagcgctatgtcctaggactggtactgagatcgcggtttcgtaggaagcggttcgcgccgtttttcctacgacacactcctgtcaggtgccgttgtacggcggtgccagattggggtgtgacagtaagtgggtcagccgcgaacccacttataggtcaaaataaataggttcgctgcttattttaacctataagtgggtttcgcgggctagccacttacacccctacgaatggccgccgagatgagactttttggttgaatttcagcagcaacgccgactcgatcgatgccagccacaatctatcttcgccacggcgatcgacgtgacacgccaagctctagctagctcatcagtgacggcctctcgccaccatcgatcgatcggtggcctataaatccacacccccacctcgtctccttcccagctcgcatcagctagccaagcccaaagacatcaagagagctctcgatctctcgccatggccgccgccaagaacggccgcattgccctcctcctcgccgcgctcgccctgtccgctcagctcgcgccggccgccgcgacgtggtgcggctccaactgcccgacgacgaagccgcctccgccaccgtgccagccgccaccgccgacgccgacgcccgcgaccccaacgacgccgccgactccgtggactccgccgcctgcaacgccgacgccgccgacgccgactccgtggactccgacgcctgcgacgccgccgccaacgccggcgacgcccgcgactccgacgacgccgccgacgccggcgccggcgccgtcgacgccgacggggaagtgcccggtggacacgctgaagctgctggcgtgcgtggacgcgctgaacgggctggtgcacgcggtggtcggcgccaccgccggcgacacctgctgcccgctgctgtccggcgtcgccgacctcgacgccgcgctctgcctctgcaccgccatcaaggccaaggcgctcggcctcagcctcgtcctccccgtcgccatctccgtgctcgtcaatgactgcggcaagtacgtgccctccgacttccagtgcccatccactgatccaccgtacatataaatcatctcaaataattaatcacacacaccatctctgcatgcatgcgtgcatggatggattaattaattaattaagctattaatacctgcatgagtatagtttatcgcctggctatactatatacatgcataaattatataaaatacatatagtaacgtatgtagcatatatacatgagctctgatcgacttgtgtcatggagacatggaggcatgcatatggagccttggattgtgcattaattgatgtataataatatttgtgtgacatatatatatatatatatatatatatatatatatatatatatatatatatatatatatatatatatacatgtggagtttgtggtatttgcaggtttgttgtggtttgggagatttataatgaaataaagagtgtgtgatatgtatgctatgaaatacaaagtttgatgtgtatgtaccatgtatatgtgtatggttgacaaagcctgtcaactttcctatatataaaacgtacttaaaagaatatgtttcctatttccatgtgttttttcatccattgttcaaaaggagtgcataatattaaaaagcagatctggtttctttcaagttcaaggctacgatggaatggaagaattttacgacaatttcatgaaaattaaactaattcaagtgaatttcctgtaaacttcacgggttccagcttccaaattaaaggagcatgcactaagttgtatatgtacaaagtggatatttccttcgcaaaagaaaggtggatatttcaatcttgatcgaagggatcagactaattaacagagatactctgcaactcaattttgatagttgccacatgcagagttaataaagaaaaaaaatacaagaggccgcacaactcaaggcctgagatggtctttaacatccccattatttcgcttatgtttaagcttataatcaaattttaaattttaaaactaaattttggagttaattttgtggatttttcattcagatcatgtgtgttcagccggtcaggtaagctatgaacaatttttagcttttcttttttaaaaaaagagagagttataagtgggtttgttataatatccttgcaaaaatgaaaagtcaaaattaaatctactcaatggtaaaataacatgtagaatccacatgtgtaccacgttgactaattaagttatcatcttagctaaaaccaagagcaatattgacttgggtaccagtcaatgtatgtagtatgatagcttggcacttaccggcggagcctaggtaataaggtgtagggtcgactgattcataacttttttacattcatattgattcaccttagaagtctttaaattttctatataaatccctttgaatttatagaggaagcaatagtcgtgtagtggtggagtcgtgggtgtataatgtggaaaatctaatatgttgtattctaatgttttctaatatattggatcgaccctctcatggggtatatatatgagtacataggggatagagacttggagtacaatacaagtaagagtaaatttatctctaggattctatctataggactctatcttatctctaggattctatctctaggatatatcttatctctatatttgtatttgactcttatctctaactaacatattatacttctaacattccccctcagtcgtaacgggagcgaagctaacgattgcaactggatttaaaatcttctatttcttcatcttctttaactcaccatcatcaattgcatctctgatggacggtcctccacctggtgcctgcgtccccttctgtgtcgtcccttgactctcctctattccctcccgcagtcatagcgggagtgtcatagacgatagcgatgacacggacgctttgactagagtttccgtcaatgatttttgttgtagacgttcgtcgatgtagctgatcatgtagtagttgtagtcatggtggtcatggtagttgatgtagccgcaaatagccgaaggcgaaaaaaaatatttacgccatggtgtgaagacgaaactgtaattgttagcatcttgcaccttgtagatgtcagatgatgccattggagacgtcttgcatatgtcagaggacgccgttggcgatgaggccaccacttcggttggtccttccgcaccatgtagcggtcatcacaatggtgatgccggattgatgcagtctttgtcgtcatagatgacgtgatcgatgccgtcgtcggtgtcgcggtcgttgccgtcgtagaggacgcggtcgatgtcgtcgataaagcgtcttgcagattaatctgtcagaggacgcgagatgtccatcttcgtggacgagtcggcggcggcatgttaccatgttgatgaagaccataggagtcgatgtagtcgtacaactgatgatgagtattgtccgttgtagatccgaagacatgtgttgttgccgcggagggagtcgatctcggcggccaccggtcgccggccgccacaaattcatgcatgtgaattctcctcgggctcggtgcaccgtactgctgcttgcctgctactgatgtgtgcacgcactagatgcctctctgattcttgctgctcgatatgacgcttgaattggctatacagcttgatggacaatggttgcttccgctcaggaggatcgcttttatgtggctaatgaagaaactaatctaatctaatgctaattaatggaattggcggctgattaggcacttgcttcttcggctaatgattgaagaggctagctaatggcgttgccccagggagataccatttgaaaaatctaatatgttgtattctaatgttttctgatatattggatcgaccctctcatagggtatatataggagtacatagaggatagagacttggagtacaatacaagtaagagtagatttatctctaggattctatctctaggactctatcttatctctaagattctatctctaggatatattttatctctatatttgtatttgactcttatcgctaactaacatctaactaacatcttggcgacgatatcatggactattgggctataagcgcatacgcatgcacgtcgttcccttgctagccaggccaggggatcggatgcattgcgcgcgtaccagttcatcagtaattaatcatgcatgtactgatcgatcgcttgcaagttgactaacggatggtttggtatatccatctgtctaatcatcggaagcatattatttgtatatatgtcgcatgatgtagagctagcctaggaatacttttattagtatatttcgtaaaactatatataatttgattaaactaatacgaaactacatatatatatttaaaggtctatatattataaaattatagatttatcattaaatttatcacgaaacggtagacttaaagcatagtagcacaaaactatagatttattattataattctcaacatagctactccctttgtcccaaaatacttgttattaattctaattaaatgatgtatgatgtatggttagaagtaaaatggttgtttgagggtacaaaatttgaatgggagaagctagatggatagaaaaccaactattttgggatggaggtggtaggacttgttttcgtgtttagttccttgcactaatattcttccggaattactaaacttatatttttatggtaactagtgctagagctgaaattttgtgatattgtaccttctctatatattttcatgataattgtgatgcatgctacatatgtagatatattctattaaatatatagttttgtgatagtttagtcaaagtatctattttgttttgttgtaaaatttactctattaaggcccggcgaaaaatttactctattaagagtgcaaaggctaggatttttttatacggttattaagaaaaaaaatataaaaagcaccatggtgtggaattgatatgataataccgtactagctgtgagaatatatactccctgtgcatacgtctcctgtacggggttctccagtaaattaccaaaatttggatgttctgtagtaaaattcatcttaattaaaaaaagatgattaaaggtaagatagaaaaaattaatatgaattgatcaatgggataaatagtactttaaaaatacttatattagttataaatatttagtgtgctctagctgactactccctctatctacttttgatcggtatatttttaaatctgaaaaatttatttttgataggcatatttcaatccaaccacctatcattttaatgattttttcggatttaatgagcgactctctattcttcaacacaagattgactacatgggcatcaagaaatgtaaatattaatgaatcgtttgtttacgaggaataactagtagcatgtttaaatggatgataagtaaaattatttattcttgatctgtgtgacaagatgaaatatgactagtatcaaaagtagatgtagggagtaattagtaattaacttcttctccaatcaatcaaattaagaccggtacgtacgtacatgcattgatcggaaagtagattcccatgcattatacagtatgtgtacttgtacaggtgctcgtacatgcatgatgaactgatcatgtactacttatgccccacacgtacgtacgtacaggagaatccctcccggcaatacaaacctgcatggtccacacattttggaatgcacgactaataatatggttcttttcctattaattccgcgtgtacgcggaagacttttgcgccaatctattaaagagtacttcttcagtttttaaaaaaatcaatctagaaggagctcataagataacgaatataaaaaatgtagtacatattcattgtcttagaaggggatgcttctaggttgagtttttgtttttatggagaggaagtagaagataattaaacgtacaatattatttttaatgaggaagcacggggtcacgccacaataaaattatgggtgcacacgtcttcatatatacatgactcacctatccatcaagcaattaaattttggtgtccataaacattacacatatatacggatgtgttttcagtagctaggattttggtgaaataatcgagttaccactggcatccgtgtctctcttctcttttcaaggggcaccctagctcgcggcgtgcaaaaaaatatcgttcataactgcacgaatatgtatcgtgctatatatagtaccgttcgtaggtataaatatatctggtttaattcttcgttcgcccatgcgaataatcgcctctatttctttcacgctactatatgtacaattggtacatgacatggaaattcatggggccggggcaagctatctctatttgttccagaattccaggaattccaggtcaaatgtctcagggctgaaactatagtggtgtgtttataagtggttaattaatctactactctcttcgtttcagcttataagacgttttgagttgtcaaagtcaaactgctttaagtttagccaagtttatagaaaaaagtattaacattttcaacccaatagaaatttattatgaaaatatatttaattattgatttgatgaaactaatttagtattataaatattactatatttatctataaatttaattaaacttaaaaccatttgagtttaaccaaagtcaaaacgtcttataacctgaaacagaccgagtattatgggcctgtttggttatttacttcaacttaccaagccacaagtatggccatgccacaagtgtggcggacgatttgagcgccacacattcaacaaagaaatatgcggcagagtagttcacattcaacaaagaaatatgcggcagagtagttcactgctgttgaattttgtgcggcagcctcaggtgcggtaagcaaacaaacagtgaactaactatgtgtggtacgcctaacttgaagtgcggcaaaaggaggcaaccatccaaacaggtgtctgtacgactgatggtcaatgggctcgcatatatgcatctgagctccaaaacttggacagagctagattccaccgtatctatgttttagaaaacatgcatgcatgttaattcctgccaatttcggtacttgtttcaccggccgatcgattgctggcatgatttgtttgatcaatcatggaaaaacaacagcttaacggtgctctctctcatatacgtgttgcaaaaataaactgtcttggaaaaattaaaatggctagatctgtagtttgtagctagtattcgataactaaacgatattttaatttagataattttaccatctttaaaaaagtaataccacgaagtatcacattttttatgtaaaatttgatatctctagatgctactagataactgaggtatcaaagtttctagtgtaaaattataatgccccaccttttaccagatgttgaaaactaaattaataaaagcctatatgtgaaaatttcattctttgagtgagagtttaaatcgtgtcatggatcccgatttaaatatacccttgttccctctcctagaatcaaccatcaacacctcgaaaatccccgttccaaatcgagtccgcaaaaatcaagttcgaaatttgaccttttgaacccttgccaaaaacttctcccggtttcaaaaatatcaaattcccttccttgactgctccttgaacccttgagttcaaatatccaattttaattcaaatcaatctcccaattccctcaaatcagttcctgcaaaaagatcaagtcgtttccttctctatttgggccatctcccttcctctcctcccggcccagtccttcttctctccatcccacctggcctgtccctcccttccccctcctaccagcccatcttcgctagtgggcctcgcgctacggcccagtggcgaaagccaccaggctgctggcctgctgcaggacacgcacgcgctccgcacgtgctgcgctttacctcgctgggccgcgccgctcctccggcccagtggaccaaataccatttattcctcaatttcttttccagaaattcccgcaaatacattccctttgtatagcattgacgcattgtatatacactaaatatatgtgtatgcttactgaccattggtcaaagtctgtaaagtttgaccttttttcaatataaaaatattccttataaaaagttcgaaatcaaaataccccttataaaagtgaacggaggaaatactaaatttcacaaaactaccacatacttcaacaaaacaacaaatttaattagtcatcgtactatatctccgccccagaaaaactacagttttacattgtttgtgaccaatgtttgactgtccgtcttatttgaaaaaaaattatgaatagtattcttattgttattagatgataaaacatgaatagtattttatgtgtgactatttttttaattttttcataaatttttaaataaaacgaacaattaaaatacagaaacccataactatacttaaaattgggacggatgtagtaatttgtagtggttctagctttctaggcttagctagggcaacaggactacctagtttactttctactagcagtaaattactagagatgtatagccatacataaagatatatgtcaatgttgaaagcaacaactacagctaaagaacgtaaccgatgaatgcaacccggatcatcaatcaaaagtacttcaactcttcaagacagtaaaaaggaaaagaccaatggcctgtgtcacacgactggtacccaacaaaatcaactcaacaagacaccacatgagcagtagttttaattttcttgtggcatccaacgtagacacgctggaagcaggaaaagcacgcagggcaagaaacaaaaccctaattaagagagagatggatgatgaatgaattaagaggtagcaatgcaaggcaaggatagatagatgcaagttgagctggggatggatggatgcgtggatgtcggcacgggaaggcgccaaacaggggacgcgccttactcgccatttgcttccaaaatctccttaattttttctatcgcttgatgtgcccattccttggaggagactgagaccgtcgctctctcgtcctagctcggctcatccgtcagcgtaaacgcgcgtacttagcagaaaatatgtctacatgagactacgtagatatattttctgcttagtagcccgaccgcacgggattaaagattatcccgtgcggttggaccacccgcacatgaaagtgttgattttcgcagacacctgaatgcagacggacgggatctctgcatgaaaaaatccattttgaccgcacggaaaaatccaatctgtagtagtgtacaagttatatatgcccgtacacgaatcaaaacaaagctttatcgtagtccaaacaactgatctagctaggatccagttgtgtagatgtgtgtgcacacccctggtcacacgccacagctagctcagctctgatcgatctcctttttctgttttgttgtgttgtgtctggaggaggaagaagaagaagaagattggattgatctcagcctctagattttggtagtgaaaataaaatgtgattatattgaataattgaaaggagttgaagctcactggccacctatcctagctctagctaggcctctaaatatctggggacagtgccaatggagtaagggcccataggcatgcatatatgccatgcaatgtatgctgagtaatgatggtttcatactttcatttgccttcatgcatggcaagatcagagatgatttaacagctaacccgctgtcagtactcggtgacacgttcattagctagcaaaggtaagactgttctggattccaacaataagggcatgtacaatggttgtcaatagtggtctcttagcgttactaattaggaatacttattgacatggaagaaagagaaagagaagagacaaaacgtcgttgttatacatgacaacggcttaacaacgactcttaatcactataatatgaaaatatggttgcacgagggtaaaaaaagggaaagaatattaacaaatggaatattttttgagttaatgattagagtctttgtcgtctcaactattgtaaagacagggtctctaaataatcttgtattgtttaagagatcatactcgtctctaccattgaacgtgccctaatagtgaattattttgcatgcggaccatgctgtgtcgatcgattaactcacctaccatgcagtaatttggaggttgcatgggcaccatggaatatccgaataaatagaatagacataaattaaaggtcctctttcaaaagaaatttagtgatatcaagaatttatcattaatttctactatatctttcgacgtaaaagttacgattctttcttgggtgtgatatgcacggaaaatattttctacatctagtacttgaatagggaacctttttaagataacagaagaattttatcaatctgagtcaattatattaaaatgatacaactgcattaagaatagtctcgacctgttgactgttttaaggttaaaaaaaaaaaagctttgctcttttgactgttgactccccaatcagtcggttttgttttaaccgcgacatgcaatatgcaggggccccgcatttgctcacaggctcacatgcctgcgcgagtaatccaaagcacgagtcatccaaattaagtccaaaccgagatgacttggttgaatttcagcagcagcaaccaccgactcgatgcatgccagccacaatcctcgccaccgcgcgcgacgtgacacgccaagctctacctagctagcgtgctccatgtccatcactagctagcttcagtgacggcctctcgcctccaccaatggcctataaatccaggctcccagctcgtcttcttccctcgcacaccagctagctatagctaagccccccaagagacatcgagagcgagatcgccatggccgccgccgccgccaagaacggccgcattgccgtcgccgcgctcctcctggcggcgctggccctgtccgcgcagctcgcgccggccgcggcgtgctcctactgcccgacgccgaagccgcctccgccgccgccgccggcgccgtccggcgtcccgtgcccgccgccgccgtacacccccaccccggcgacgccgacggggaagtgcccggtgaacacgctgaagctgctggcgtgcgtggacgcgctgaacgggctggtgcacgcggtggtcggcgccaaggccagcgacacctgctgcccgctgctgtccggcgtcgccgacctcgacgccgcgctctgcctctgcaccgccatcaaggccaaggcgctcggcgtcagcctcgtcctccccgttgccatctccgtgctcgtcaacgagtgcggcaagcacgtcccctccagcttccagtgcccatcataaatcacctcaattatgtatgatcactaattaattaataatcacctactgcatctgatctctgcatgcatgcatggattaattaattaagctatcaaattacatattacctgcataattaataagtatagtttatcacctggctatgctatatacatataaatatatatagtgacatatgtagcatatatacatgagctctgacttgtgtcatggagatgtggaggcatgcatggagccttggattgtgcatttaattgatgtataataatatttgtgtaacatatattttgctgtgtcatgcatatatgcatgtggagttgtggtatttggtttgtagtggtttgggagatttattatgaaataaagagtgtgtgatatgtatgctatgaaatacaaagtttgatgtgtatgtatcatatgtatatgtgtggctgataaagcctgtcattctgtcaactttcatatatagtataaaacgtgctatgttgtgcttaaatgaatatgttttcctatttctcatgtgtttgtttcatccattcttcaaaatgcgttcataattgaaagcagctctggtttctttcaagttcaaagcctctcttatggaacgaaagaattttacagagaaatttatttttaaaaaattaaactaattcatgtgaatttcctgcaaaaactcctgcgttacagcttccgaaggagtactaagttgtatatgtacacccctccccacaaaacaagttgtatatgtacaagtggatatttcaatcttgatcggagggcatcttacattggctcatttctctggtcaaaatattgatcccttctagtccagaaaaacggaatgctttgaattttggcgcaagcagtttcctttaagggagatattactgtaaacagggccggccctgactttttggtggcccggtgcgaaaaaaaatgtaggcccccattcaccataaaaatataagataatatttaaaaactcattgtcattaacgaatttcacgctaataagcttaaaatacaatcaggcaatcacgatatgctcgatcgtcgattggttttctgtctttcctctaagcctatcaggcctgataccatagtacatatattttggaggcctctaatttttggagacctaatacggttgcaccgtccgcactgcccaggccggccctgactgtaaatcagcaattaacacagcaagatgatagattgttacacatgttctaagctcagactgtgtagtagtaagtgcaaagatctgcatgcgacatacgctgatatgcattgcactaccagagatactctctgctactcaattttgacagttgccacacggcagagctcagaaagagaatacaaggcacaaggcagcccaactcaagcatccctatcatttcacttacgcttataaccaaaatttaaattttaaaagtaaaacttgaatttatagttgattttgtggatttttatcaagatcaagcgtgttcagataagccaagaataatttttggttttctaaaaaaaaaattatagattattatgttatatatccctacaaacatacaagttcaaattaaatatactcagagaaaataacaagaaatttaggaataactttgaacggggacattgtgcaattttgtatttccatgcgtggatcaaaaagacacgatcatatataggttattcaatgttctagaaacttcttatagctgtttaaaccacatgcaagaaacaggagcatgcaagcaaagatggcgctacataacgtcaggttccacgcgaggaccacactttctagcacaagaaaatctgcgaggtgcagcacggcgcacaaacgaatacaaagaatcgagcgatgtaacaacaatccagcagaatataacaaaatgtcgatgctgaccacaaacgtcaccattcaagattctacattatatttgtttatacagcaggggttcagagtacaagattggccgggtagtatatcaccatttgagcaaaacagactgagcaaatgcaacataattttcgctgtgttaaggcactcaaaatggaacatgggggatcaattgtgttatctgcaatctggcaagcgttttccgcggacgtgttcaagcgacggcttggagagctctctcgaagttatcttctgctgatacggcacgctttactagcacatgatcggggtgtgatagtttcagctggctgcagatggaaaagaaaggttagaagtgtggtaagcatttttgggttcactaaaagtaaagcattgtgaaaatcacgggatagtttccaaacactgaagcaaagcatgaaagatgttctacggtttaacccgcacagatggtaaattccaccgaaccattctactggtaattatatgttaaaaaaaatgaattgtgaagtcatcaatcttcagtgttgatattcttctcaacagttcacatcagtttcataaactattactaactgactcgtttagtaaagttttggatgtccctaactgataggcattttatgaagaatctatacttatatatattattatatactattaaaagacattagtggtggtagtgagcctgccaccaccaccaccaccaccaccatcactgacacatgggccctgatatagtacaacacatgtcaatgctctgcttgctctttggacttgttaggctgtaggctgtagtctataggagaagaggacattgggatttgggtgattacttaatttgtaggctggagctcttaaattttctaagcatgtaatttttcttttgttctttaagatgatagatcttctttcaaccaatgaaaaaataattaatttccacaaggacttaattttgctattttcaatatccgttgcaaagcatgggtatttggctagtgaagacaaaagatacatagaggatcctaacatgatagtctgataccctgccgcttcttttcatactggaccagtaatatctaaaacaaagtagagaagttctgtggaatctgggtggaacaattggaatgttgaacacagccaattggaatgtcagtttcaagttgctgggcagaccttgtcttgatatatcagatcaggaactagtggctataacaaatttgcttggatacacaaaatcagatcatagccaaaaaaaaaaaacagctgtctttcgcaaaacttgaacatataaattcaatcgccgaaataagagaaaatgattcactagttcaaagaggaaaagtatctcatgacattttgccagtggtcctactcgtgacacgtctttcaccatcccagatcaaccaatgctatagttcatgtttctttaatagctgcggggaccagtcatacgattgccaagatttgactagacttattgagtggctattgttttaaataggctgaatagtgagacacaaatacaaatatttctcttgggtagcagcttttgcaccatgccatgagatatttacatcagtctggtaatttctgatacattattgcattttcattttaactttttaactactaatcttgaaggtctctgtagcataaaataattaggtggagatataaattttaagaatgtccccttatcttgctagcaatttaactttaaaatattgtttggtagtaattgtccctctggatacatatttaatagtttgtatatgcaagccacatgatttatcaacatgtaattcttctagtttggcatgcatcttccaaataataagatagaataatataatgaaatcctgcttgacacagcatgacagtgttgccttccatgcaaataactaaacagagcaaacagttgaattgtacagttgtgttacagtttgtacctgaggtatcttgatgacggtttgccaaggtggagattacacacaataagattagcaagagtttcaggatcttttgcatcctacaagagtagaaacagggtttgagtaccttgtgtcgaacatgccaacgtggcatccttatgtgagtcaaataaaaaaaattaaatgtcataagtttttttttccaactttaattcaaacttagttgcgaggtgtgtcatcaagctaaccttgttcaatgcttcgagtaaaagagtctcagcctcatcaaagctccccatgtgcatacagcaaactgccttgccatttagaaccattcctgtcatcgggtatttttcagcaaagtcttggaatatgaggtaagcttcacggatcttagagccaccctgcacgataacttgattgttaataagctcgatagattaaatgttgaataagcacatttgtccagcagttgtcaatgcaatgctgaattttcggtactccacaaagttggactgtcaaagtacttacaacagcaatgtccagccatgcgtttgcaagttgtgtcagtgtatggtcctcatcaatctgttgcatgatctttaattgcttctcggcatagtctgaacggtgcatcttaatgaagatctggacattcaatgcatgcctgtaaccgaaaagcaacagatagtaaacaagatcatcaacaaacagtattccacaaatgaagggggcaccaaacagaagattctgaccaccaaggtttgcagttaactaaatgatcagcaacatcaaatcgaaatcagcaaagatcagcaattaccagtgttgaacaatagaaaatattaccatgctaaagatcatgaagccagaaagcacatttaagatgtatcatgcagtaatgcattttcaccaactctcaaaacgtcacattttcaacaagataaacataagtgcatttgcatgtgcatagttagcacttagcagcatataagaaagaaaagtgcgttgaactacaatgtccgagtgataataaacgtgcacaacactgagcatttgaacataccttttcggaaacaagatttttgacttatcttactggataccaataaacttgaccattattgtaaggtgatcaaaattcacaaacaaaattttctattgttctgcacctatgttttctaaaaataaatctacacctggaaggatgaaccatataaagttcagaggacaaatgaaactcacaggtccagagttccaccagagtgtgtgtgcttgagagcttcagtgtagtcttgctcatgcataaatataattccagcaatcaatcgtagaacaggattgcttccaaccgccgaatcactcaaccattccttcagactgacaatcgcactttccttcaaaagttgtacaaaagaataatacatagcatttcagtgtatggacaaaccagagggaagagaagacaatatgatggaaaaacaaaacaaaaaactatttttctaggcttagctgtactggactactggttaaatactcataaagtgcatgacatgaaccaaaataagaccataaaaactctgaaatgcaccagaaaacaatcgtattattggaccataatgtatgcggtagggttaaagtgaaaacatgcatacacaagttgagttcatggggcctcatagcaatttggggaaaacatataccaatgatccatctatgtttgaggaggtggtatccctgaattgcctgtgattgccaagttgaccatacattccccagcagactaccaaccaacattatcactgatgaatgccggtagtcctagtctcctagatgcatggtaggcagtatgtatgttttcccccaatttatctgaactgaacaccctgagatcaagtttacgttatactggttccgttttgttttcttcttttgggttttaacagtgaggaggaagtagctctaatggcatatctttgtgtatgcaagtgtgtctatgctcttttttttttactttaaactttaaaggaactgtggtttcaacctatggtaactgaagtttgaaacgaaaggtcctaatatgcattgcgcaattgagctgaagaacttaacagcttcagcctctgaacaccatcagagtctattcatccaattgaaatgaaaaataggaaatcaatgatcaagtatcaacgaactaatcaagccctgagcctctggcaatgcatacgatccactagatctaactccagatcacataactcaatatagatctagcccttcgatcacaacaaagcacaccagatccagactcagacatcacgttacagaggcgatgggatcagatccagcgtgctaaccttgtctccggagaggtacagcgcgagcagcttcacggcctgcagcgacgtcgccgcggacgagtcgatctcgctgatcaccaactgcaacagccacatggggggaggggacacgcaccgatcagagccgccaacccgttgtagagcgagcgagcgaccgagggggaagggaagggagctgagctcacctggtaggagccgagcgcgacgtaggagcggaagacgatggcgtcgcgctcggcggcggcgtcggcgtcgaggcccgggacgtcgctgttgttgatggcggcctggtaggcgccgaggtagaagaggttgcgcaggttgaagaggaggtccggggacgccatggggtggctgctccggtgctctgccgccggcgacgacgaggaggaggcggctcgtcggcgacgaggagtaggagatctcgcgagcggtggcgctgctgctgctcctctctccttggcccgtttggtctctgtgtgggttggtaaagactgaggcgtatttataactgggctcgattgggccaaaaacttctggcccgttgctaggtgggcccgtcggaaatctgcagagaggtgggcccattgtttgggccttagttctatagtgggccaaaatatatccggcgctagcaaattctagtacagtacatttttgctatatatatttttgtcgatatttttttctaatataatggtaatgtacattataacttacatggtaactataatataactttcatataattttaatcgttatatttatttcaacattcatgcaagttagaaagaaaaaaatccgagcgcatatgtgtgacgattcggtcccacaatcttcgttttataaaaatagcatgtaactaacaaatttttgaaagttacaagttacaatataattacatcatgattgcactataatttatatgtataggcagtctcagtataatttggtcgtgctgtcgtggtacaaatccaactccgacttggtaacaaattatcttctagattctaatcgataaatttcaacgaaaatttgacgagccttttggccaactcgagagtgacgtcagcgcgcacggcgtgctcggcccatcgtcttataggctcttagctcaagacactggcggagtcataaacagcgctgtaaaacgagcagcgcgcgcacgccgatcagcaagccgccactggctacttaaagccgtagcctgtagctcagctccaccgcgcataaacctagccagctagcaaccgacaagccaaggcgacggcaatggcgccgacgacgacggccacggcggcggcggagcaggcgccgccgccgcagcatacgaggaaggcggtggggctcgccgcgcacgacgactccggccacctcacacccatccgcatctcgcgcaggtatgaacagccaaccgtataccgctccatgctaagaggatctttgtcgtgctcgatgattgctcgatgattctcccgcgccatggcgccattgatgggagattgggagacatatggagcttttttttttctctccagagtttaagatgatctatcgtgtttgaatttgactgttactctcgtagcaacaatagtttacaggatgtccacatcgaattagtgaaaatcgccgtttggttcatggagttaatagaatctgaagctctcatgagccagcgtcacttgagctttcgatttttgttttccccttccatttccagtcatttccagccttctcatcggatttgtagattgtagttttgcatttgatttccctgcgagcaacggtgctcagcatttgcacatcgaatttcggtcatccatgtgcaaaggaagcaaaattcaccactttttgaaactgttcttttttaaaaatcttttagagaagtgtatttattacctggcctcgttcaaccggatatatgcagccatttaaattggttctgaaactgttcttgatcaaatggagtatctcaaccaagccctttcgtgccaaatcaacaaacaacagcaaaatctttccccagacgtctacagtacaaaaaccctgaccatccagcaccagccagcgctggctcactgacctgcagcaaccagctttaaaaaccatgcgcatttgcagcacgtattctgtaccaggaatacgggatccgtcagatctcaactgcaaggcaccctttcttcaattgtttttggtggtgagttaatactgttcaacagtgaccatactgggcatgcctcagctgcaagaatttatggtgctcgatcgctactacgtcatccatcttcttttcatgtgcgaccattctggctgtgattggctggctgctgctgtcaaagtaacaggagtgatttactttcacagtctggttgtatggtacataattcagttatccttctggaatctgaactcctcctggcttagtcatagcagtaaaaatgttcattcaagaaacaggctttcaagcagtaggcggcttgctgcacatggcttgtttttgttaccagtttttttgtcgagcctatgtgaattttcacaagtttacagccatctgtgtgatggtaaattgaggatcttgctgtatgccaattcacttgctagtgttgtaagcatgcatcttctttcagcttcagcagttcaaggctgttgatttgatggtactgaattagttccctgaaatacttcagataaagtaaaagggaaagcaaaataaaagaaaaatttcagttctaccagttcatggcttagttaaaatcttgggaggtgaagcatggtgtttaggctctctcttgttgtgtacttgagagtctgaactctcaatgctgaagtaataaccactgcagttctgctaaaaggttattggctcagtagagaaatagtatatgtttctgacttgtgttctatatattgccatttttcaggaaaactggagatgacgacgtcgctataaaggtgctgtactgtgggatttgtcactctgacctgcacaccatcaagaatgagtggagaaacgctgtctacccagttgttgcagggtacatccttcttattgcatcaccaatttatcaatcaatcgtttttcttttcttcttggttctgtgcgcatccagatggaaaggctggatgcaatttcattgcttagtgaaatatccattatcagttcatactttcttccggcaaagctgaattatcatactgtaaactgcaaatcttgtcagttttttttcacgataatgaaattcattttgtttttacttcaaagaagctacaaccaaccactaccgccgtttcaggttataagacgttttaactttagtcaaagtcaaactgcttcaagtttgactaagtttgtagaaaaaataataataacattttcaacccaagacaaatttattatgaaaatatattcagttattaatttaataaaactaatttggtattacaaatattactatatttgtttataaacttagtcagactttatcaaagtcaaaacatcctgtaacctaaaacggagggagtattactctaaagtgctttcaacttacttggaaaaaagaaatgcaaactttggctgcatggtttgattgatgcaggcacgagatcaccggggtggtgaccgaggtggggaagaacgtggcgaggttcaaggccggcgacgaggtcggcgtcgggtgcatggtgaacacctgcggcggctgcgagagctgccgggacggctgcgagaactactgctccggcggggtcgtcttcacctacaactccgtcgaccgggacggcacgcgcacctacggcggctactccgacgcggtggtcgtcagccagcgcttcgtcgtgcgcttcccctcctccgccggcggcggcgccggcgccgcgctgccgctggacagcggcgcgccgctgctgtgcgccggggtgacggtgtacgcgccgatgaggcagcatgggctgtgcgaggccgggaagcacgtcggcgtggtggggctcggcgggctcggccacgtcgccgtcaagttcgccagggcgttcgggatgagggtgacggtgatcagcacgtcgccggtgaagaggcaggaggccctggagaggctcggcgccgacggcttcatcgtcagcaccaacgccagtgagatgaaggtaattttaaagctagtttgatcaagtcaagagattattaaatgaactttaagaacggattacacgatagtaattacaatctacaactcctgtacaagtagtaaattaataggaccactttggactgagttaagaagagatcaatgaactattcagttctacattaatcgtgtagtcatatggaaggacatcctactgatgcagatgcagtaatatggcacatcacaaacatacaatttcaaatttgacttttacaagttgcgtttgatatgttatttttgttacaaattatagaagtcgaatttgaatttgcatgtttgtggagtgttatattagtagatgtcaatctattttttcaattttttttaatatttttataatcgtttaattaacatgcaataaacgggttaacatccactcaagtggttataatccatctccatcaatttattgatgtgctgcagtgcaactttgcaaggctatgcaagccgaagaaatctttgaatacaactgatgcacctcattgccgacagagcatcttaagattgtttggtcaagtatctgaatttgcattttggacttgtgtttttgcaggctgcgatgggcaccatgcatggcatcatcaacacggcctctgcaagcacatccatgcactcttacctggcactcttgaagcccaagggcaagatgatcttggttggcctgcctgagaagcctctccagatcccaaccttcgctttggttggaggtaatttactagtttgtctgacgctgcatcgtctgattccttctcaaattcatggcaaaatttgacagtttgttttgtgacaaatctttgcaaatcaacagggggcaagatactagctgggagctgcatggggagcatcagtgaaacgcaggagatgatcgacttcgccgccgagcacggggtggccgccgacatcgagctgatcggcgccgacgaggtgaacacggccatggagcgcctcgccaagggcgacgtcaggtaccgcttcgtcgtcgacatcggcaacaccctcaggtcggattgactagggagctcactgtcactggtctcagctctgtagcataccggacctgcaatcctgcaaagtagtgcaatcttcttgctacaagacatacatatcacctctacttggtgtcaataaatgtagcaaaagtggtacattgttgtactaatctgtgtttaatatagcgttgcaacacacatgtatattgtgtaatggaatggaatgggtcactgactcctatccaagaacgagccatttgcattttgcaataaagcattactgtacttgtacacagggacaagggtaacgttctcactctgatggttggacaaaaaagttatactagtatacaatatgccaatatggattctgcttgaatgaagctaaaacgacgtactacagagatagacatcatcaccttgacatactaagggacctggggatagagagcgatcggacctccggcgccgaacttgggaacatcacgttgagcctgtgcatcaggacgtcagccttggatggtatctcgttgagcaggaactgctgcacgatcggcttcttgaaccactcgagcaccgagtcacctggcgcccgcagcaccaccttgctcacctcaaagggggactccagcgacgccagcacctgcgccaccaccatcttgagcgttggtccagtcactagcttgatgcggcgcggcaccaccccatagtagagcatacgcttcctgaaccggtgcagcgtgtgcacggttgccactagcgctgcgccaacggagaggtttctgacgtccagtgaccaggcgatgtgctggtcgaagacgatcgccttggcaaacagcttattctcgtaggcgaccttccagatacagcgggcacggttcatctgccccatgagaactaaatagttgagaagcacattcacgaagtaccttgccgcactctcctcattgtcgtagtcgatgccctggaagaactcccggacgaacgagagcactggcttcttgcgctgctcaggcccggtgaacagcccgcacatgaagtcatgtgccttgtgcttgcttacactcaggatgtccatgattgcccgctcgcgtccctcatcctggcaccgcaccaaatgtgcaaggatcgaagtgtagagtatcaagtccacctttgctgcccccgcgacatatgtctcgagcaatggccgtgctgagtcatacagccccgtcttcatacatgactcgaatagctgccttatgatgaaattgttggtccttatgccagcggagcccatgaaccgaagccaccggagtgcaagctccgtcgacccttccttgatgtaaatcatcaggaggtcgctggcggtcacctctatcgggaaccctgatgccttcatctccagcaatacctttgccgccaaatccagcatcctcttattcgccaacatcatcagcaatgctgtaaatgtgctaagccccggccgttgtccagcatttgccatcgagtggtacaaccgcatagcagcatccacctgccctgcagaagcatgcatctcaaccagacaagcgtatgtcgctggcgtagggaagaagccggacttctccatatcaccaaacaactgtgtggcaacatccaacctcccggaccgtgcattcgcctcgacaaccatggtgtacagaccaaagcttggacggagccctcccctcctcatctcctcccagagctccatccctgcatccaacttcccagccctcaccagcccctccaccacggctgtgctcaccgccgggcttgcacggtgccccaccgccaccatctccctgtacatccccatagcagcatcgagcctccctgcttttgccagcacgtccaccagcacgccgtacatcccagccgacgcccgcccaatcccctccctcttcctcatttcatcaaacatcttgcgtgcggcatctatcctcccggcgcgcgcaagggctggcaccacgagctcgtaggttccctcgtcgagcgcgcaccccgacgatgacatttcgtcgagcacctcaaaggccttgaaggcgaggcccctggtgagcagcagcgagaggagggcattgtaggcgtgcgtctccaggaccctgaaacccgcgtcgcggaggcgcttgaagcagaagaaggcgggctcgaggaggccatgggtggcgagcgcggagagaacggcgttgagggtcttggggaaggcggcggggtcggggagggcgagggtatcgtcgaagagggagaggagttcggaggagtgggtggccggggcgaggcgggcggcgaggagggaggagaggtcgtcggaggggacgaaccatggctggacgcgcgcccaggcgacgagggcgaggagcggggtggggtcggaggcggggagggaggacgcggcgaggaggaggagagccggatcgggctgggacggcagcgcggagagcgcggcggagagggatggccccgagcggaagcggagcgcgagcgccgccagccgcgccgccgccgcggggcgcgggagcgcgtgggccgaggagccggacaggatggccgcgtcggcgc

SEQ ID NO: 42032 - DNA, 10289 bp, Oryza sativa
ccgtggggctctctgcgactgcaagtaggggacttcgctagggtgccctttgggccgtgctcggcccatccaattacatgttgttgggccgtggcccattacaaggcccatcgcacaccgttgccgagtcgtcttcttcctcttcttcccctcttcttctgctctgctctactcgcgaagccaaagcctccgccgcgatcccctccgccgctcccacgagcttcgccgcccgcttccgtcgcgcgtcggcgattcgcgctctccccgactccagcgccttcgtcttcttcgacctcctcctccgaaggccccgccgatcgatccccggtgtccgcgccttctagttcgccttttcgagctctttttcgccggagacgacgggcgtgggcgattcggctggattcctctccggtacgtgcgatctcgctccagctctgctgatttatctaccctagctttgtggttgcggaacagccctgagtagcacccatgttttgagatgtttcgactgtatcgacttgctgtgcgcgcgtccctgttaggtctagcttccactgggtgttgtttactgctcaatctatactttaccactgtagcttctgccaccaatcggttggtcatgtgtatgcctgtgtgaattccactgggtgtgtgtgcacatgtatgaatgtgtgatgcaaaccaatatggtagatccagtggatgcttatactattaactgcttaagtaagatgtatatgccatagttttgcgcaatgtttgggtgtagttcattccatgttgttttccctgcagctggttgtataattcatggtgcatattttgtcttgcctctgtttcagcattcctgttaggacttaggagaagtaatgtcaggagtattagcaaaattcgctattgcatctgcggtgatgtggacagctccagttgccatcgtgtatggattttactaccagatgattccaggtttgactattgtatctaatttacattgtttttcatcgctacttttaaaactgggacacatgatattcataaggagacttcatttgctccctgatcaggtgtgagtcaactgtcatcctcgacgcaaactctagcaagtggattccttgctgttatatcgattaatctggtaatcggcttttatatatgcatggcgatgaaggagactccccaccaagagccacaacctgatccaaccttcttggcaaatgctaaagcaagcattgatcaaccaactccgtctcaagtgaatgatgattcccatggaaagggaaaggtggagtaggtcatatcacaacatgtgcatgtttcacatgttatccagaaacagttcttctcgataccctgccttctaattcaatattatcttctgtaaatcttgagaattatggaaccaatatgagttttaccttttgtactgttattatcgagatactgtgttagaattatttttgtttggctgcagagaactactttggctggctgtatttaagtcaatttcgtttttcttcaatgtggtcagagatctcctttagcatacatttaataagataaatattatatctatttagttatccattcgcaatgtggcactgtttttttaaaaaaaatttctggttaggagaacaaacctggagaaagttgtgttccaaacttatgcaaatgtttgcccattggaagtagatgatttcatggagtaagcctattatgctttagggagataataatttattagtgcccatgccactcactcttatggatgctcgacgctagaatggtactgatctgaccaaatgggaagctcagaatctactttacccttagtcattcacatggcttagcagctaagaacaagttaagtcatcatgtattatcatatcataaagtacaaagagatcacctgagataagctttggttttagaaaatctaggatggatacaataaatactccaccaagagtatgttattttgcgaagatagaaaactcatagattaatacaaatcaagcctatctgggaaataagatcctctgttattctgaagatctatgcccatatggcaagcattgacatcagtccagcacctaggaaaagtgcaaggtatgccatgagctgaagctttgtattaatctgtagcttcgggttattgaaatctgttgctagaaggtcaactagggacatgtagatcaaaattcctgctgaggctgagttgaagactccttcaacgacgaaggcagttgagctatgcacattgtagctcgatgaaattgcaattcctagcacgatgcccacaggtgcagtcagggagaaaaatattgccataatgacggttgcccttaccttaaaattagcctgcagtaagaagaatgaatcaaacatattagctttttgttgctgtaagacatgatatgttatatgcatagttgtctctttcttctttgtgtccaattatttgatttctcgataaatctattattattcttacctaactagtgaacctatgttctctatatgaaacagttatatttctttatttttcttttgcagcctgttactttgttctcggcttcttttttttgtggtctgttacttcgttcttgaagaaaatggctaataacttttcatgcttgcaatgtgtcttgttgctattgtgcctttttttttccaactttgtatgtctctgccttatttctttttttctctccccttctgcggaagggcccttccactggcctacgagcatgttgatgttaagccttttcgagcaagcattttgctatcttttgtcaaaagtcgaaacaacaagttagatatttgtcatcaggtgtctactatctaggttacagtacttggacatacctgaacaatgcaaccacccaaacctacaccttcaaagaactggtggaagctgagggcaccaactagtggcctgatagtagatggcctcacagatgcacctaaggatactccaatgataactgaatgcaccaagattcccagctcaagaacctgcatggccaaaaattcatgtggttattgcaagagggcctatctggttttgtgaagcattcatttagttggcaatcaatgtgcaaatggagttaattctgagtttagtgggaaaagtttcccctgaagtgcagattatcagacatatccattgaataggtatcttctcttccccatatatgttttctatgtgttttatggaaataagtaaaaagagatattagataatcaacatcatcctgcactattgtagtttcaagattacaatagactaaacttattctcattactgttgccaggaaggcctatgagcttcaagtgactgctgttacctgagatactaccttatgtcgaattgattcagctactgaaccctcctctggtgagccacagaccactatatcaccatgtgaatgtgtatgtcctccatgtgtgtgcgcatttatgtgttgtgcatgttcagccctctcgtctccagcatgcttgtgtacgttgatgttgtcaactgggcgtgccttcctgaattgagaccggtgatagtatccagcagccaatgagtccaccaccattgtggacactgcagcagacattgaaacaaggcccgcaaaggggaagggattcctatccccaccaccccttttgaggcatggagatgtgagcgcatcaaacgccgctggaagaatgtgcaccatgccagtggcaaggatgacgccggctgcaaatgccttgacagcaaagaagatgtcaccatcagggcgcagcgcagccatggagcggccaatcactggcaccaagacaccagccgccccagctgcaaggatggatgcaatggcaatgagctttagcttcattgcaccctgtctgtctgccccgtctgtggtgttagcacagtcgcaggcactggctgcagtgtgctgcgcaaagagcagtagccatggaagcacttgcaaggtatgcttcttggctcccattgttgctgattatgttgattatttccctgtgatacgatgtatgtatattgctatgagtcagagatgaaggtagtactgggttctttatataggaggggatgagatgatagggattgatgtcatcctttgaccagaagatggaggcaatgatgggttttttcttcttctttttttatttaagtagaagggaataagatgatgagaagagatgtcattctttggccagaagatggatgcaatactgggtcatttatataggaggggatgagatcatagggagatatgtcatcctttgtctaggtgggatgagctatgcccatgtgtcaaaaactgtagactaaagcactttggacaaagttgacccaaaaatgtggaaggaccaaactctctccataaatatgtaaaccgtaatttaacgctatcactctatcatgatgttaattgacaggtgtatcatggggcatggtaaagccataaaggtagatcaagcctgggctcatgtggaacttgtttgcatccatggtaatcagttgtggggtgaatgtgaaaaatcttcatgttcagtgttaacgtccgcatgccatgttgacccatctcctgattaccaatgaatatggctgaagcagatttcacctgattatattcaccttgagtaaagctggggatatagcattcagatagatttttttttgccttctattgccacccttcttcatctcttaagacttctaattaacattattgttcttatccggttggaagatgtacaggtgcaaatctgatggttcgaacacaatagttttgcattgagctgtcaatctgaatcaagcaaatcagctaccagcctgccagtgagtcctgaatgtgcaatctgaattgattagatggctcatgatgaacttatcgtcggacatgttggatcggtatgttcatcacatttgctccctttaattagctttaggcacaattgtgctgcatcattggtggcttatcgattgatatgtacatgcaagtaagaagtgacttggaaagtatttgttgcctatacggatgggtctcaagatctacactcgtgggttctactgttgacaagaactaatgcactgtttacaagaatattagcaggattctgcatatttccttcaccaatcactactacccgtatcaacctaagactatcatgttttcctttttccttgcacctgtttctgatagttagaagtgacatttttaagtgcttgttgatacagaccattcgtttatattcattttcataaaaaaaagaattcagttatatccaagttttcaaattttcaagcaggggtatccttgttcctcgctgacctcgggctcggctaatggtcgaacggatgcaccagggagaaaagaaggcgacacaacacaccacaaggacagcatagtgggtaggcagaccagctatgttcttgtacacgaacaggagaagcaccactgagccggccggccggccagccaaccgcagcggagtggaggtgagccaataatgctatcctagctcgcaggatttaagtggtatcgtgcacttgacttgaccccataacagttcacccttttgctttttgcctcgtgaatttcttcaggaaaaaaaatctgaccaatcaaggttgtgcagaatgttaacactgcatagataaagttcctcttgatttcgagggctggagtatgtccattgatgattcaagggacaattaaaacccttcctgtgctgatgcagttttgcatgatgctgaagcggtagatcggccgatctgtgacttgctgggtggtaaggacagctaaaaaaatctcagagggatatgaagtgaatcagtggctcaaagttgccatcgtctgggcttgtgcagcacctggtatctcgcattgccgtaagagcgacctaacatgaaatactgcacacagtcatctcatttgcaggacagcgacacagtgtaatgctcttcactgcacacactcagctcatctgcaggaggacagtggcacagtgtactgctctttcgcctcccactcagcaagtcatgcaacagcgccatgtgcttgcgatgaaagcccatcgctgcccactaatggccgaggtgatcgtcgcgtttctacatccgcatcattggttgctcggacggaggccatggggcgcctggagccaaagctgcgtagcccatgttctccttgactccttggatttcgtttgcaagcaggaaaggtattgtttgcactttgcagctctgcactgtgttattcgtttccttatcttctttcttttcacgagtagaattctgctttggaataaatctattttgcctctctcctaattgaatcgcctcacaaaatcacaaaatcggatataacgttttcctcatcttcgaaagctggtgaaaactgtcatccttcctgcctctaatgctgctggaagatgagataggaggaaaatggaagagaggattgatagaggggaaaagataaggagaaagttgttgacatatgggtcccactcattactcaacgagtcaaccgaggttaacttgttactacgtcagtagaaaccgtttccaaaccatcgaaggagctgatttgtagttgagagaggctaaggagctgatttgttatattcggttttatagttgagagaggctactgctgggtggtaactactgtcctcctgtcatggacaagcagagggatgtgacaatcagtagctcaagttacgccatcgtctgggcttgtgctacacatatagcgttgcgcggtgtgtaacgtgtgttaggccgactagtgtagtcctcttcattgcacactcagcacatttgcaggacagcgccagtgtaatgctcttgactgcacactcagctcatctgcagaaggatagagacacagtgtactgctctttcgcttcccactcagcaagtcatgcaacagctcatgaaaatatgcagtgcaaatcacatatgcaatggaaatctggagactacgttggatccaaatatgagtgttttagatttgttcgtgtcaccaagaataaaacttttactcgtggttaaatctaagagtaaatctaggaaaaatatgtagtgcaaatcacatatacagtggaaatataaaaactatcattagactaaaatggacgcctacaatttatcaatgccaacaatagaaaaacttataggcgtccattttagtctaagatagttttcatatttccactatatatgtgatttgaactacatattttcccaaacaacaccatacttttgcgatgaagcccacctgtacccactaacggccgaggatattgtctctgttctactaccttcgtcctagaaaaagacaaaccctgagtttccgtgtccaacgtttgacagttcgtcttatatgaaattttttttataattaatatttttagtgttgttggatgataaaacatgattaatactttatgcatgacttgtctttttaattttttttcataatttttttaaataagacagacagtcaaacgttggacatggaaacccagggtttgtttttttattgggacggagggagtatattacaaatctttcaggtttatcctaagttaaaattcttttaagtgacattaatttgtaaatatttatcaacaacactaaattaatttgtaaatatttatttacaatatatttattttgtgtggaaaatatacctataatttttttataaaatttaatcaaacttaaaaaagtttgatttaggataaacccaaaacgactgtaatgtgacggagggaatagatacggccaagctgggtagctgcgagcatgagaggattggtctgcacattgcagctctgcgctgcactgtgttctccggctcgttgttcttctttcttttatctcctatttcttctccggctcgttatccggcacgacggcgtgggctagcccgtgctcgctagttgctactcgacccagtgtgtagtcgcgacatggctgtgatttgagaagaggaagcttgatgaggagaaggggaagggaggtggggaggaggaagaggtggttgctagcgcggggtggaggcggaggtggaggtggtggcgcttcaacagccggtggcgccgtggcggcgaagactgccgcggcgcttcccgatcgcattgcctcctccccgacggtggcctaggtgatggacgacaccccggcattgggcgtggagcggaaggggaaagagggggcggagcggtccacgggaaactattttaacagcgctcgtgtggacgtccacccgtttattgcatgtcatctaaatggttatgaaaaaatatgaacaagatagatcaatttgtaatatatcaatccacatatttttgttacaatttgtagaagttgaatttgaacttgcatgtatgtggagtgatatattacatattgatctatcttgtcaatttttttaaaaatttttcgtaaccatctaattgacatgcaataaacggatagacgcccacttgagctattagaatccatctccagctgtccacggctccacgccatatatggcccggccatcctgggttcaaagttgttgggctatcttacatggctgtatgccccgaccatcctgggcccaaagttgttcgtttccagcctgaaaaccagccatattcagtcaaggaataagttcactctaggtccctcaagttgtcgccctgtccgatttttcgtcctcagtctagaaaacctgatacaacgcatcccccaacttacaaaacaatacaaaacaacgtcagccaaaatcagggtcaaatactgccgaggacctcgtttgcactggttttgtaatttgttggacacgctgtatccggttttccggtttagggacgcaattcggactgggcaacatattgagggacctaaagtgaacttattccttcagtcaagtgaccgggtcccccaaggacattggtattatcaggcataccgacaaaccagatgggccaatactgaattcagcatacaacgtactccagctagcaccggtttcagtcaaatgatcgatgtagtgcattactacattggccatggatgattggatgtgattgccggttcctcaagagttaagcatgcgtgcgacgagtcgctgtcaaagttttcagaaggtatggggcagttaacaagctgacatactacaggaattatactgatgtcccatttattagtgttggaatacatgagattaatcagtcaaagccaactgccaaaagaactactgtacccctgaaaccaggaaacttcttttctgcatggttgctcgcctaattaatcagtgattgcgtgcctttcggtagttacaagtagcagcagctgtacttactttgattagttctgaatactacataattaagagtttaattgtgcttttacttgtatagatagtactagtagcaggctactactgttatcacctgagacaacagaggatagatatacgagtgagccggtctatccgccgcttttgttgcggacaaatcactgatgctcccgggacagctgctccttctcccgggatttattctcagaagttgttttctcttgacgagatttattttcagaagttgtttttctttttactgtaaactgtccaagtttctaccccgtttccaaaaccattttttctctctcgtttggtctcaaggtctcaccgacctctcttggtcttggccctggggctgatcaactacctagatttattttttatttttttactgtcaactgcacggcatgaggtagtactgtttttcttctctggaattcttgcgaatgcttgaatggatctttgtccatgttctctttttctttagcattacgtcctcatgtcctatgttgcaatttgatgcaggaagcttcttgtaattttctcctgtaattttctctctccttaacttttccacttgatctaggaagtgagccttgtttaggtcccttttgaatcgcaggattgagaaaacgtaggaataggaaaaacgtagaattttgataggaatgtaagtgtaaaacaaagaattgcaaaacgcaggaaaaatacaggaataactgtttgattgaaccacaggaaaaacacaggaattggatgagagagagactcaaaggaaagttagcaaaaggttaggccccctttgatttggaggaaaaatataggaattttagaggatttcaatcctataggaaaatttcctatgaagccctttgaaaaaaagattgaatcatatccaatcctttgaaattcctatgaaatggacaa

SEQ ID NO: 42033 - DNA, 26351 bp, Oryza sativa
  unsure (1)..(26351): unsure at all n locations
ctttgccatttcaagtctagagagagagagagagagagagttgctggattggacgccattgatgctgtagcagagaggtgccaaggtccaagaaagtgagagagagagagattgatgaagaacatggaggctgcaagaagaggaagaagaggaaggcaaggtggtggtttgctgctggtggttcttgccgctcttctgcttcttctccttgcattggcgcgcggcgcgagcgcgtgggcccacggcgggctcgccggcggcgccggcgccggcgccggcgagcggcggtacatggatctcgcgatgaggaggatggagagcgtcagatcttccttcgtcgcgaggagggaattagcaacggtcagtgtagtttaactaactctactccatttcatggcttcctgctgcttctgcttccattactgtgttgattgcgtcatttcaacttgttaattgcaagcctctctgctgcttccaggcttgcagctctctgctgcaaaaaaaaaagttttttaatgagtagtttgatcattttgttggggagcgtttgttgtgctgggtacatgttgcaattaattaactgcattacactgggccaaagttagcagtaaaaccatcattttcgaagaacagcaatgcatatgcacacaaagagaagttatcagataattgtgtcggtttgcttttgcactggcagtacattctttttttttttcatttgccttttgcaataaaatgagcagttttattaccccaaaaagcagcttttttcctaagcatatctccgtcatttgtcggccggaagtctctgtccacgctctcaatgaaatctagccgtcctcaaagaaatgtctttcattcataaatccgcattcacatgcccaacgcattagctcatgcatcagtaaaaaaaaaaactgcatttgcagttcatattttccaacttttggtatgcacaaacgcattacctcaacgttttttctttttacacttttggtattcccatgcacaactctttcaagagttcaagggcgtcatattttgactgcatttgtcatcaactttggaaaaagaaaaaagaagatctcccattttctcacaatttcgtcaagaacgttaggtatactaccaatctagcaatgtaccatgaaatgcttacacggcagcgaagaaattgagaagttttctcctcagaaaatcctgctcactttccaccgtgttcggtagcaggtagcactagtagcaactgcccccacataaatgtaaaaaaaaggaagtaaaaattaaaatcaaaagcttcgcggctactcgtgccaaccaaactttgaactttttaccggtgctaactttgaactttctgagttttttttttaaaaaaaactttgaactttctaccggtgctgtgctgtcacgtctgacatggcgagttcgtgcattgcagtctacggcggcgagctcgtcgcgggtgtaccacgtgacggactacggcgccgacccgaccggcggcgccgacgcgacggcggcgatcaacagcgccatcgccgacgcgttccgccgcccctccaacgccaccatgaccggcggcatccccgacctcggcggcgccgagatccacctcgacggcggctcctacctcctcaagggccccctctccctccccgcctccggcggcggtaacttgaaggttagtaatgatgtcacgtgagtatttttatttattacttcatccgtcctataatataaaaaattttagagggtcataagatacatgtttcatgtttagatttatatgtttagatttatagtataatgatatgtcacataccttattcagagataccttattcagagggagtatatatcttttcctaactcattagttgtatacatattaacagaaactagatatatgaatcatttttactatgttaaaaaaattgcactatcttcgtcccaaatgttagtacaacataaaatgaaaaatgaaatttgacaaatcatttttaagaaattctttcagtcccaaaataagcacagtaatgagtttccgtgcccaactttaattgtccgtcttatttatttttttttgaaaaaactaaaaacataagtcacatataaagtaatctaatatcaataaaaatattaatcgtaaaaattttcaaataagatgaatgattaaagttgtacgcggaaatttatgattatgtttattttgggacagatggagtaatgaatttggacaaactaatactttgggatgtagaaggtattttgacatatgggtcccactgagggtgtatgtacacgtggcagattcacagcgggtcgctgcgggcggcggacgacttcccgacggaccggtatttgatcgagctgtcggcgaaggcggccggcggtggcggggggagctcgccggcgatgagctactactacgagtacgtgacgctgcgcgacctgatgctggactgcaactaccgcggcggcggcgtgcgggtggtggactcgctccgcgtcggcgtcgacaactgctacgtcgtccacttcgcgacggacggcgtcgcggtgagcggcggccacgagacgttcgtccggaacaccttcctcggccagcacatgaccgccggcggcgaccccggcgagaggtcgttcacgggcaccgggatccgcctcgacggcaacgacaactccgtctccgacgtggtggtgttctcggcggcgaccgggatcatggtcaccggaggcgccaacgccatctccggcgtgcactgctacaacaaggcgaccgggttcggcggcgcgggcatctacctcaaggtgcccgggctgacgcagacgtggatcaccaactgctacatggactacaccggcatcgtcgccgaggaccccgtgctgctccacgtctcgggctccttcttcctcggcgacgccaacgtcgtgctcaaggccgtcaatggcgtggcgaggggggtgcagatcgtcggcaacctgttcaacgggagggggaagggggtggacatcgtggagctcgacggcgagttcgcgacggtggagcaggtgtacgtggcgcagaacgcggcgacggggatgacggtgaggtcgacgacggcgcgcgccgcggcggaggggaacgggagctcgtggacggtggacttctcgccggtgctgctgttcccggaccggatcgggcacgtgcagtactcgctcgccgccggcgacgcgttcccgggccacgctctccggaacgtctccggcaaccgcgtcgtcatcgccaccgacgccgccgtgtccgccaccgtgcacgtgctcgtcgaccagaacagcagctgaagaacaaaaaatcaaaatgctgctgctgcctgccgcgattgcgcgcgagcaaggcgttagattcgtttgttcttgcgattcaccggcaaaattcgtctatatcagagagatggcaaaattggcaatagctatagcttgtatttgattgtttctgaagatgattcagaatggatcacttcgtcagttcatcgtgcttccagtttccataaaatgcctcaagattcactgattcagccaagatttcattttttttctttttcggaaaaaaatggaatcaagagcatgcagggatgatcagaattatgacgacaaggagaacagctggtcattctttcagttacaaactgaattcactgacaagaatgatgcaattgctactatactgtactccgacgtaggagtactgtatccacaagtagtagtacttgtcccatttgttttgctggtcacccgtcagtctcaagtgtaatactctgtactagcaaaaggcaattcattcatgcacacgcttgatcatgcccaatgccccagggacccaaagtactaagcaaaattatgtggagcaataacaacttttaacaggtagctcacctgttttcctggctattatttcgatctgtcggtcggcactggctatttcttgatttcttcttgcgtgattcaactgcaaagacatgtaggtagcttatctgattatctcttctcctaatactatctatgaaaaaaaaatgttgttagcactgatatttcctcagtaaaatgtgagtaattaagcatcagaaacaaactaaatggtccaccaatcttgtttcttcttgttgctattgtctgtttaccatctttaattgatgtgtttcaacattagtaagttgtttcagagcagccaaaaggaaagcgatcactagctgctgaaattttgaggtgaaaggcagctaatcactttcaaaattccaaaatggactctttccttcattcccaattgttgatatgccaaggactttttgagctgttcatggggttagtttacctgctttctcttgtcagacgtcagtgtgtgcctcctctttcttgatcttttcttcagaaaccttccaaatggagtacttaagctgaatttttctgtataaagtagctcaacagtttctcttgacgaatcttgtgcgtttacacaccaataacttctaagttgtagaccaaccaaaggtaagctgcatttgaaaactgaaactcttcaaacgaagaaataattctggaagctgattttgccaaaggtcttcatttttactgagttattcattaggcttttttttcttcttcttgagttataatgttctcaattttgccacttcttgcagagttagccattgggctttttttttttaaaaaaaaaaccccaaatgctacaaaaagttaaaccgatacatgtgccaatttctgtgcttttggcattgtcaggtatagtgtggagaaggtggcaactctatcatgtccttggtcccagaccatatgaattatggcatatggaaatcttgatttcttgggtcactggtccaatatttttctttttctagaatccactaatccaatattatactactagtactaagctatttaaaagtctcttactagagttggttagagttgcacaatttcactgtcaccatgagcttactttaagatttggcaatcctgtacatatgatgcattgtcttttaagtttcactaatcactgtcaaaacacgagaaaaacatggcattattttgctgaaccagtcaaacagttaccattaaaaaaagttaaacagttaaagtagggggagagaaatatggtagtagctcaagaaaaagtcatgaatccgttaatatggttcattctttcgcttatttgtagaataagccaaaatcatatttgcaaacaaaaaataatttgtgaataaaacttttatatacgtgttcttagtgatctaaaagcaaatgctgaaaaataaattacgatgagaaaacccaaaaatcaacaccaaatttaaggtggaaaatttaaattttggctgataaatataagcataaagaaaagatgaggcccgtcctgtggaattcagtgtagaaattcagattattcgactggtgatccacccaagtcgataaacatgcttgtagcatggtgataaatgccttccggtgagaagctaccgaccagggttcaaatcctatatatatatatatttttacataagaaggtataactggcttaccttatagtcatttcattgatagaaatcctaatctcgcataaaaaggggatttgattcacccaaagtccatgaactgtgttgcatttgtgtcctcctttcttggaacaggtccaaagatgtccatttgagatctgcatggcatccgtgattgcgtgaggattagtctgatagggtagttagaacaaaccttgttaaggacctacttgactttgaaccgtattgatagttgttggtgagctaatctgacgaagtgaagcagacagtgatcatttgaggtcaagaactgatacgataagtacaaacaaatcatcaacgaattaagctttttgttaagggaagtaatgcatagtacggtacttgaatgaataaagtttcaaacagcaaaaatcttaactttgggaagcatagatatttgtcattttctgtaccagacaagaaaatttctcgtccttcacctgaaacttgcttgcaacctaactctggtagagccaggatataacaatggtttcttttagataatgggatataacaatgatatgcttcctctcttttccatggaaggtgacattttcttcgcttttcagtagcaaacttcagtggacgcatttttgtgcagatgcagacattcagaatccagtaacaaattgcttgcttttcacaagccaactttaaagccatgtgattgtttcagatggtgacatttagtatagattagagattaatattaaggtgcagtatgtctactaaggttcatagtggttcatatatatatatggttatttcttgcagcagaaaacacacaccaggtcgaaccaaacagcaagccaacatgcttgtgctgtattcagagctccagtacttgtacactgaaccaaaacgcgagtgaatattcgttaagctcaaaggcatcccacatctctctcccttgataattcatggatgccaacagtatttcacagccgaatatactctctcagcaagcagtacaaaaattgccaaacagaggggctgatatatcacaaaatgttcatggcaagttggcattttggcaaccttcattttcataatttaggatattgaaagacctgctaagaatagccattaacttttgagacttaagagactggtagatacattctagaatgcgtagcaaagattctgagacatagttatctaccatgtattgtatctaaaattgttattctagagctacagtgtaccaagattaatagcattatgatttatgtatccaccttctatacatcttccctaagaaagctcactaccaagcagctagccctgaagctcattccatcctatgaacaagtaagcagaccttcaatggcaatgccagcaggatcattgccttcccgctccacggtttccaccaccgcctggtagagatttgcccatgagcacccatcaccagtactcccaaccatgtcccagaacgtcaaattggggcttggtgggcatgaggcgacgacaatgtcagcaatgctgcctactttggctgctggccggggaaagtccagtgccaaattatcgactttgtgctcgtaaatcttcccgttcctgtcgaccttgtatctcgaggtgccactgaagcaaccgtatgattcccacgggacacgcggggttccccacagctcccaccggacaactatcgagttctctgtcagttgccaaatgcgtgatatgtcaagcccgatttcacggaagagtaggcgcccatggaatctgagagcccagaagattgtcttgtagttgtcgattccatggaaagtgttcaacggatcgacgaatgttatatcttcactgcagtgtgatgcaaagagtgtttttagtgcccattttacaagaataactgtagaatatatcaacaaaaataatataaatatgaaactacaagaagtacacttgtcaagtcaacaactagtgttcttcatacatgactagaatcaagaatcatttggttacacaaactgctgtaattgctggtgatatatggactgctacctgtcactgctctctgaaagtgtaaacttatcagttgattcaattctcagtctccatgtttatcagttgattcaattatcaatcttgaatatgacactctcttttaatggaaatcttgacaatgataaattatcattctaccaatcatttcctccgtttctatgttgactgacacatcattttccatgattagccaactagcacaaacactgaaaacttcagcccagttttagtggaagctttcagcttcagttccccatggacatttattcactgacgaactagcaaactaaaaattctcactacagcaacaacgataataataagcaaaagtaacaaactcaaaatctatagcaataacgataatacgaagaaagtaattagcgaagattaatttttaccggtagatgtcgtagttgggttcccggacgaacaccgccggcaggtcgtcccgcagcgtgcgcaccgccgtcccaaggttgaggtaataatccgacctccgcgggtcctccccgccgccgccgccgctccggccgccaccgttcttgctccggctcttgggcgtcgggacggcggcggcctcctgctgcgaggcgccgagcaggagcaggaggttgaggtggctcggtgccacggcctgcgccggctggagcttcccgccgccgggaaggccgagctgcgacttgagcgggctcggcggcgacttgcaggacggcgtggtgagcttggggaggaggaaagccatggcgcgcctttcttgatctttctggctagcctacaagtagcggattccttcgcctacgagctccatgtagtagaagcttccaaattggccattgggatgttcttggggagggagaattgagtggctccgatgggtgcagcgaaggcgaaggcgaaggcgtgtgtgtgggagagagatggggtccgacgtggagccagccagccagccgtcgaggtggagatgatccggggtttcatccttcgttttccttgtccttttgtaacaaagaagaaaaaagaagaagtaatttttgctacattttctagtagatagttttctttttctcctgattacgcgagacacaccactacatatgcagaccgcatacacgcactataccgtaacacatgagcttatcaccgttacatatgcaggccatatagacgagaacacgccacgcatatagaccgcatacacactctggtgaatgtattgtaatatgcgactatacctgtaacacattctaaaataatagatttgagaccgaagttaaattttcacgacctcttttctgtagtaaataattagttgatgtctcaggtcttgctaggaaatacatggagaaatacatggatgaatgtatgctgcatattgcagaaatgaaataaagtggaaatgatatggggtgataattcgatatgcttatatattaagctctagaatgtattaaataataaatgctatgttatatttgtatgtgatttaaaatattttgatagatttgcatgttaaactttaaaaagctagcgggattcaaatatataaagatattccatggtgagcgcacttctatctatcatgctctaggcgttgactagatgtagcatggtcatttgataaagtaccatactctacatcttattaaattttagcagaatatgcacacttgtttttgtttttgagaggatacttaggagggtgtaggtacacatgagttatatacaaagacagcctacgacatggctggcctgtacaaacattacttgtaaacggttgcacatcacaccacaattaaacatcatcacccaaaggcagcatacaacatagtcttctttcgtgtatgctcctcatggaatcaattatcaaacctaaactcttcctctttttttcttaaacgttggaactgtcaaagcaaaagcagttctggtgcaagaacataaaaaggagctttcttgctgtccttgtttccacagcattaaagaataagcacagcacccttaacagccaatgacactaacacacaaacagttcctcttgttttcgaaggttggactaaccatgctacctatttctagcctaaatacctaggagatcttccctacttgcaattcacgggtagataaggttattattgttgtgaattgcagcaatcagactgatttatatccccatcatgtgatccaggcctggctgaggagcagctcccatgcctgcgcctgtcacattaagaagcaattgctggagccagcgccttgttgtaggatcatcctgtggttgtcaaaagttggtgtttcaaacctttcatttagtattaatttatcaagtacaggaataagaaattggtggcagctgatgggttaatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaaatggcagcacagacctggaattgtctgacagcctaaggtaacatcggataatgtgcttcagcaaccttgtggaaggctgctcagcaagtgaaaccaccatgtttgctaaaacactgcctacagcaaagaaacgctcagcagtggcacaaatgtagcgcaatccaacatcatcgaggagaatcttctgaacaatgaaggtggccacctacaaaaatatttgactaaatcagtgaaataataatggttcattaggcctagcttggcaaatgagatttatttctggcctcatttgaactttgagctctcatcaacaaaagaagcttaagttcctcatgagctaccaacttaactatacctgtgtacctgtgtacaaacttaactatacctaccaagtttaaacagttaggtttgggtcataaaaaaatggaattaaaagtggagcaccatatagttgccaaattgccaacctcctctcaatacatatagcacaatccaccttttaggcttataaaacgaaaggtggcatttgagcttaacaaagggaagcctggttgagaacaagaaaattccaaagatgagcggcagcctgtaataagaagattctaaagatgacaggtggcttacttcacactaacctggacaggctatcattattcatggtagcagaaattttaacctagccaagctacgattcatggtaacaaaaaaaaaaattacacacaaacttcagacagcatcatcacatacttaaagaagaaaaagatgatggtatttagataaacatgagatggttagcgacatacagtttttgacagctcacttcccatttccatggtacgcaaacacagaggaattatttcagtttgcagcagaaaactgataacttcagtatcatcaacctgcgtgtattacatgtgaaagaagctttaattccatttgaaggaaaaatatctaaaaccagttcaacacgaaaaaaagaaggtagaaaacatcaaagagtacacatgtttgtttcaaagtaattcaacatattacaaggttacaaattctgttttgtgcatttttcctcagaaccctgccagagggctagtttccaataaccaagctctgtgtctacttatatataaaattggtttgcatccaaacttaattcaaatttctacaaccccacatcattcccccccaaaaaaaacatggatacttggtagttacagtgctacaggaaccaggcaaaccactaaacagaagtaaatggctggttaccacgaggatcttggaaatcttttgcttacaatttatgcttgctgttctgcctaatacaagaaggatgcattcttataaggcctcatgcctaactactgaataataataacatggctcttcgccaagatggcagaatagaattactgaaatgtgtcaattgtaatatatatcatgttcgtatcactgtttaaacgattaactcatgtaactacatagatgaattaccttaacaagtgcaccgatgacacccaggctggtgagtcgcaggtattcaaaaggtcttgtcttgctggtagtattcaagaatgggtacaggtacaggggaatatgagctgaaaagaacaaaagaaaatgagagagggaaatggaatttttcacagaaacaaaaacaagagctaaaaggttctttagtgtgttattttcttatgaagattaagactttacctcgatttttgttagcacgcttttcaaactaataaactgtgtgtttcgtgcgaaaactttctatatatatgttgctttaaaatatcaaatatatctatctgtcaagtttgtaataattaaaaattaattaatcatgtgctaatagctatcttgttttacgtgctccaactttatcttcatcttcatgagtttcaaacactagtactacacatttaggaattaggatacgtcaaatatagattacaaaagcatgatcatacacgcatatgagagacagagatgcaaaggaccatgaccattaccagttaagaaaaggatcctggtctcagggtgagatgcaacacactgaaattatttttgaaaagcaaaaaagaaagagttaatcagcaaatctatgtcataaatccaacttgggtaactcaaaaggcaatttctactgtaaaatacatcatgaaatgcaagcaaccagaagacaacttttccagcattaccgccctatttcataagattatgtacctgaagaagtgcaagtgcattgcagactcggttcgatgcacctggtgacaatgttgggggtgaaagtgcagagtagattgacacaatttcctgtatgtgttggcaagtatggatgcaccaagtgagtaagattgctgaaatttgagtaagtttggattctaagcaacaagtgctaatttgaacagcatacaatatttgacctcaacagcaaactgatgacttgagagtaggattaaaactataaattatttgtgagtttaatcttcaagcatgcaaattgtaaacatatacgaacaggggaatcatgcagacctgaagaagtgcagcaactgttccaaaagaatgccaaagaagtggggccagatcttgaaatatctctcttttctgaaaagaaaggattgaattttttttgaccaaataaactggcttatcatgttaatgactggaacatgaagtctacaattattttgatcaggaaaattacagaactaattaggtacaaaacaaaaatttctaaattagttactacaaagaacatagggttctaaaattttctttagcaaaacattgctgttgacaatgaagccatctgctctggaatatggtaaatctacaatccaggtctgtgtgtatgagcggtaatctgtataaacactttacagcgtaaaacgccttaaagagttaatggaactctcgaaggctacccataataaactgagtctaattcgctattgtgctacccaataataatggtaatctagcgggaagccgggaagtttcaccgaccacaataattagagatgctaatgttatcttgatcaaaacgtagtgtaatagcccatttcatgatagatgcgcatcaaccatacggtaaccctaacaccaaatcaccattcaccaaccctaaaaaaaccattgacattcacaatgctaaggcgaaaccttcccccacaggcagtgtgaattccacaaattaccaccagtgccccagatagggtaggctatagaaccctagaagaacgcgcgctggaccttcgagagctcgaggagggcgttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaaggagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacaaatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggggagagagatcccctctctcgccccctatggcgccacacggacggccaggatcaaccgatcgccgcgatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcgcgttgccatgtgatgcgcgtgttgcgatgtgagactcgatttctcagttctcgtgatttgggctggaacgctagcgatggaaagttcgtgtgatagtgtcatgaatttgttgaggtcttcttgttagatgtggatttgttgaacggtgggtttgttatatcggtactcgtaattctctcgtgttaaattagcaatagaagttttgggttactggatcgaagttttgctgagatattgttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacttcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactattgccggtatgtttgactagcaatttaaattcatctgaatattacagacctgagataaatgctactatttgttttaagtattgaacagttgattaactgcaattctttccagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactatgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttttcatcagaacgtgtttatggaatctactctatgcaaagttttgttaagatgcctgttaatgctcgatatgctgtgatccttgattttcctggctggctatgtgttcgcttgtttgttgtgtttcttcgaaagagtattggtggatatcctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacatttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatatttacggcccatatagagaggggtgtatctgcatcgctagggtttgcctccgcgccgctacctccttcttagcaaagcctcgtctccactcccctcccctcccgcctctccggatcccccgcgcgccgccgccgccgcccgcccgccggtcgatacccctccgcggcagccatggctgagcaggtaaggctcctcctagtcttaccctcgagcttctccgtcgcttgcttagggtcagttctatggtgtccttgttatgtgactcggatcttcttgtcggtgttgctcagtggtattgcgtgatttggcctggaattgtagggagtgaaaactggtttggtagccttgcacatcagtatgttggtcattattgtcgattgtagatttgatttggggttctagcctagtctcatgagtttgttgaggttttcttgttagatatgggagtagttgggcggtgggtttgcatagtaccattctcaactctcacttgatatgttgtgacttgtgagccatgttcatggtagcaaatgccaggtgcagttttgtggttagtgtggagcttatctgttacagagttagatataggtttgttatcttgtttcccatttgttcatgcaaacgagtgatgcaggtggttctagcagattttgtgtagtattgatgttttacatccattcctgttgtgcagactgagaaggcattcctgaagcagccaaaggttttcctcaggtagggttctgctgctccttcaatcaattatgtactattctgtgagcaattcacacgtcttgacaatgtttttctgcttgattttagctcaaagaagtctggcaagggtaagaagccaggtaagggtggcaaccgtttctggaagagcattggccttggcttcaagactcccagggaagcaattgaaggtacaatagagtcttgcttctttgtttagctgttaccagaattccaattcattacattttagattcttgcttactatcttttgtgtgctgtagagaagaattatggtttgttttactgttaccactgaagtgatttgtagtgcattatgaacattaaaaattgtttctgaaagaatcgttgcttgtcatcagttgacagtatttcttaaattcttttgatacactgttgctggtatgtttgactagtaatttaaatgcagctgaataatgctatttcttttatgctaattctttcaagtactgagcagttgattaattacaattccttgcagggacatacattgataagaagtgcccattcactggaactgtttctatcagaggcagaatcattgctggaacatgccatagtgctaagatgaacaggactatcattgttcgcaggaactacctccactttgtgaagaaatatcagaggcaagtaaacaattatggattctacttatgtttcttttccttttttttccccatttctgacttgggttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactatgagatttggttgctgaagtacaatttctgcattttcaacaggccgctgtcgaaaactgtgaggttcaacgtcctgaaggtcatcccagctggatccaccggcggcagcggtggcaagaaggcctttaccgcagcctgagcttgtactctcatattcatgggtagtttataggcagatccttttgcttgaagtcctggcagggcgtggtgttttgaccctttcgatttggatattgttctcaactaaacgaagtcttgtcatctgaacatgttttatggaatctactctatgcaaagttttgttaagatgcctgttttgctcgatatgctgtgatcccatggccgtgtgactcgagaatacttgcttgttcagcgtttgcatgactgagattctgaatagggttctctataacctgagcaaaatcaggtgttcaatgacaaggggaccagcttgagaagtttatcagtggacctgacatcttcctgtcgcacctaatctttgcaaggaaataagatactcccttagagcaggtacaatagcaggctataaatcagctgcaaacatattttaagcagataaatgaggagacagaagggcagcgggctacagatttgtagccagctgtagcatggactccaagacgcagcgtgtgtatgacaggtgggaccagatattaatagtgtagtatgtaactattctatgaatgagctaatggattagctatagatgaattggagctagtagtgggctatactattaaacttgctcttagtagttccagaatatagcaatcatgcatgctattatcctagtatttggacgtgtctaatctggttttaggttactatattttactaggatagaggaagtatgaacttgcgaatgttgacctgctaggctgctactcccccttatcaaaatataagcatttcaccatgagatcaccattactctcaggataaaaaaaactgagattaccatttcaccatgaaaaacacagctctgaaaattcgtcaccttttcagtaagagttcagacatgcaattctcgtatgatcgcttccctccactcctggcaccgatccaagacgagaaatcactgccattttaatttgcatagcgtgatgatccatagtcaaatgccaaatgcttttccagtttgattcgcgcgatgtgcaggttgttgtgatgattagttgggtgttggtatagcggctaattaagctgcaagaacaccgcactgagcttctttcctgccggagctcccggtatcctgctggttccctgaatattcagagagttggacagttcaaatgcatgtttctctgaaatgaaatcatgggcattcaaagatctatattgttttgaagggggaaaaaacatctacagattacatgggagcaacacaggactacaggagaaaccaaaatggcactgccacacaaatgtttttgtgtgaaaatcaagatggccttagaattttgggggctacattacaatactcacagatgacacaacataaaacaacccggccaatatctgaggagctcactgaactgtacagcatccattcatcccatgacatagggaaaatggaaaccctgtgatcttttttttttttctgtttgagatgaaatcctgcaatcctttctctgccactgttccacaaatttgaagttacagagctgtttgtgtcacaggtcacctagaaggaaatctcactcggcgcatggaatgtccgtccgcggcaaatggcttccaagttttctccagcataggagctaagtggagaaacttccacacctacaagcaaaatcaatcatgacaatattagtaaaagaaaatatcatttttccttgttttttgttcttggcaagtttctgaatgtattggacaggagaaaatttacctgtcatgtacaatgggacagaatgggtcaagaagccaccagcagcaactacccatctactatggagacgaagcagcatcagctttgcgctatcaggggtatcataagacgcgccattcgcattctttacaggcgcaaattcctcctcccgcaaaacctgaattttcagatatgtataccgatgagtttctcaaaatcataacaaaaagacacagcatgacatctagaatgttataagagcataggcgactgagaagttgaacctcaaaaagtgctgtggatggggagtaactgaacgcgtcgaatatatactgttcaagcttcaagcccattgcgtacccatggatggaagggatcttcttctcagcaagatgataactggacacaaaagttttgtaaatttcatgtgctacaaatacaatagaatgaatgatggagcttgcagttttaaacatggctctcactttcttaggaagagtaagaggggcataacgagaaaatagataactactgtaatttgcaaagaaagtaaacacaatgaattcctactgcttcagacttaaaacagttatagaagcactcacgtactgtccttctcaaggctgtttgctacttgattcaaaaaatccaaagtgaacatatgcaagcaaatctgcagtgagataagaacatgcggttgttatacacctcaagagaaagtgcaaccaggagggattgagaaacaaaggatagaacatacattgctccaacaataacgaaggcgtcccgttgactgattaatttcagtagccatagctgcgtccatttcactatactcaactacagagagaggtccaccacgtcctcgtcgaacaaatactccaacattctcttgtgggtaagcctgttcagcatattatttactatcaacatggtgcatattggattaatgatatgaagcatgagaagtatttgactgtaccttcctaacaacctttgcagcagaagatacagctttgtctatgaagtaacctaggaacgtcggatcagcaacgcggacctgcatacataatattgataagcgaatgaggagaaaacgcagaaggttatatggattatcctatggggaagttaatgtcctcaccagtgcattgtcaaccccgtagcaatctacatactttacaccccgtgaagacatatcttccagcaaccttctggacttgagggctgtaggatgttgcagtagtgaaaaccaggcatcagaaatgaccatgcaacactacaactagaaatacaatacatctttttgggagattaccagcataaactccaccattgccatcaggagcctttgctacctggtttcgaacagagcatgtgaaaaaaaaaaagaatgccatcatttaacattttaaataggcagcatcaaaacaatatttgtaggtatcacaattgcacttgaattgtgagatctcagaccatgtgtcaaactcgaaaatcaagttgttacaaaccgcagtatcacctcctagtaatacaagatcaatcagtggaagattagaaaaataatagaagatggtaccttgtatggtgtctccataataaatctgccatcagcagaaacacatggaagggtgccttgttggaaaaatgtcacctgccaagaaaatgttcagctgttcaaacctacctattaaacattactagtgaatgggggatcctgttggatcttttgttgaaattccattggaatagttaacacaaatgaaaaaaaaaagtacttgatcttacttggtctgcctctaagccaaagtatttacggctttcgaagaatttgcgagtgatgtcatcggtgaaggggctggtcattatataccaatgaataggtacggtgttatttggacctgcaagttatttcaaatttcagggtaaagatgtgaaacgaaattaaaaaagagagtaaaattgtggttaaaagacattactatcacttgattgagcagcaagcttttgaacacacaaaatccgttcagcttggagttggaaaagcgactttccagacggaagtccgatacctaaagggcagaaataagaggttaaaaataagccatgatatatacatagacagagttggaccaagaattatcgaaaagagcaactgagcaattccacactaatatggatggatagagataaactagaatatgtcatttcctttgattaaatggcattaaggtgatgtagactacatttatcattattattacactctaaaataaacaatctgagagctatgaacaaaaaagattgtgtaaaacagaaataattcagagcacctcacttctttttttggctcaacaaatatccatacatttgtgcgtacaaactcaagtactaatatacaaagattgaagtggaatcaacttactgaaacatcctttaggatcagagctaccaagccgagtcccctgcacatacatgaaaagaaattaaaccataaggaggctgcttctcaatgcacaaactatagaaattgcaaattcaggtaatctttccatcagagcacctgaccaccggctaaaaggacgacggctagcttcccctccgaaatggccttcagccccttcttccaccaccgttctttgtcctccggcaacctctcctccaccttggacacgctggactccggcaccggctcgacggtgggcaaagtgaatcctgcacttagaaagagcataatcacaccataaaactaaggcaattactgataaagtgttctcggtacagttctatcatcttgatgtaattgactgagttcatcaaaagcttccattatctataaataaactaaggcaagtgcgatgataaaaaaatacaattaactaatgttctacattggaaagataattgttctttcccttcaactgagagacctctcaccttgtgatccaagggagcgccggatgatccgatcaatccttgaaagatccaggctctgaaaaaaaaatgcagtatatgtagctccattggtcactgtcgaaatggtaagctcaaatgacaataaaatcatgctgcaggtttctcttgagctattgtacagtgtaagcaatgcagattaagacctatggagagcagataaataattggtcacactggcaacaaagctgtgaaagcgtgaagtaaattatcactcaaaatccaaactccttttccccacaaaccgcagtaaaaaatttcaactgataaatcaactcctgcagaattcacacttagaccaaaaaaccacattcaaagaccagagcttacaggcagaattccggccaaaaaaggggaaaaaaaatcaaacttcttatgcagagttcgtccctgacaaacagaaacggacagagagctcccgacagaaaacacaatcccaacgaaagaatcaaacattcgacgcgaaattccggcgcaaaaccgaatctctctctctctctctctctctctctctctctctctctctctctctctctctctctctctctctctctctctctctctctctctctctctctctcccaaccctcgcagccgcattgagctcactcactcgctcgctcacctcgatgtccctgacgagcagctcccggtcctcgggcgagagctcgtcccagagcgcgaacgcgccctcctgcccgtaatccttcatcctctccagcatcgcctgcggcggcgccgctccccacctccccaccgccgccgccgccgccaccgaccaaccactatctccttcatccctccccctcccttctcctcacccaagaaagaaaatggtgggactagagagagatctgtgactgcagcaatggcgcgctgcgcaagaagaggagaagagatggaggaatgccaactcggacgaacggcgaatcggatggatggattgttcttggatcgccgccggcgtgtgcggtgttcgcgccctttatatacctcctctgattgggcgtgcggtgttccaagctaattttgcttctcttctctcctcgctgacatcgaaagcacaagttttttttttcctttgacacttttttagcagttttttcatatgtgtgtcaaggattaatcactattacttaaaaaaagaattggtgggagatacgaatccctccgaacatttttttaataattttttcatatgtgtgtcaaggattaatcactactacttaagaaaaaagaattggtgggagatacgtcgctccaaatatttttttttaaaaagaaacttataagtatgttagggattgaacaccagatcttagggttaaaactacgtatcacttatcacgatgctatcaaaatgtatctcactactttatctattaattatttcatctacagcttatcagcagtcaaaacaccactaaacaaaaattgtagttaaattgtatttatagatttaaagctaatgctgaaaaatgaatgattataaaacatcaaagcacaagttttttttttattttttgagcagcttctttttttttaaagatagtagaaattttaagaaacactgccaatgatatcacaagtgacaaccataaacgctctcagtctatgcgtgttaaggatcaatcgcctcgtattttgtctattaattttttttctcgaggtactttgtgatctactacctccatcctaaaatatttgacgccgttgacttttttaaaaatgtttgaccgttcgtcttattcaaaaaatttaagtaattgttaattctttttctatcatttaatttattggtaaatatacttttatgtatacatatagttttacacatattataaaagtttttgaataaaacgaacagttaaacatgtttaaaaaagtcaacggtgtcaaacatttagggaaggagggagtattaattactccatctacttcagaaatcgccggattagaggagaagaggggttaactagccggacatacagactgtcggtcacacgggttcaggcaccagcaaacagtgtcaaacccctcgtgactcctgcagcaacaacaacaaagaagaagaaaatatattttataatctatttatccatttcgttattaagagcacctcttgtttaggacataaacacacatgtattatacatttatacccccattccatgatttccatcttgtacataaccttcacaactcatatgtgggaccccagcagcagcaccctggaatgggcccacatggcagcgacagggtattgcagatcgtccgagctttgaaagcgagcagcgaggctgaagctagctagaagaatggtacactctcactcacaggtgagcgtgccactgtactgtgtgtacactaattgtcctggcaaagtcttctttggaggttgctcttgatggcccagacctacctctcccagttgagtgctctgaatcaaatcaatgtggcattcatgatctcctgtaaaaatcttaacaatacaggtcccatatataaataccccatcatgtatatacatcaccatacattttgtattaattgtataaaaatgtataaatggtatgttcctctcaagaatacgttcaatcgtacttgttcagatacatagtcagaaatatttatattttaaagaagagagcattatgttttaagaaattgatcggcatgcggatgaaacatcggttgatagatcatgtaagaatcaatcaccgactttatatacataacaaaaatatttatattctggaacggagagagcagatcatgttttcagaaaccggttggcatgcagatcatcagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42034 - DNA, 5727 bp, Oryza sativa
  unsure (1)..(5727): unsure at all n locations
atcatctttggtgggacgacgctgtagatggcatccgacgccatcacatctcgtggagctcgatgcggcccaactcgatgataccctacatgcaacacgctttgtagcttgatcttcatcaacaaagacatcattgtagtccgactttgctagtaacagataattggagagcctctcgcctccttgaccacgtggtgtatagctagcccatctgcctatgggcactctagctgttacccgaggggcggctgccggagcctctaggagaacgcccgatcggtgacgaggaccgctagcatggcgagtatgtgtacccatgaggcattaacacgctctcaagtacatgttatcgagtccaagccttgaatcccactttggtaccatttgtcaggtttccctggacaaatgatcggtgagaacctgagctagaacacggacactcaactcaagaggaagaacaatgagaacacgagaggatttgtgatgcaaacctttcggggttttctcctctccatttatagttgtgcgaagtggaacatgctggaacacgcaagatagaaagcgtttccccggtttgatcacccacgccgcggtttgatccgcttccatccccacgatccgcacgctgcgagcttatcctcacgctgcgggcactaggcgtccaaacagaattaactaactaatgactacatgcgtacggagacttaaaatatttccgttatctcataaaagaaagagcaggagatgcacttgatagtgcagtagaaaggggtacgtggtttcaaccctaaggtcccgtgttcaatctccaacacgttcacagtttcttcatccacgatcacatctctagttcaatttcctcacgagtcacgaagcaggaatgatatatatgggttcttggcttgcgacgacggcggcgagatcgagtgggtcgcggatcaccgcgtccacggcggcggacttcgccgtcggcgagctgaagccgtcgccacgggagtagaagaaatagcagaccttgcacatcttccagaacagctccttgcacggcccggggacggcgctgcctctcctgagcaccagccccagcagctctctcctgcatctctcgatcggcttcatgatctctcttctagcctcttcgatggacactgaaccgccgctctgaatgacaagcagcgacacactgttcaccttgccctcgccatcctccctctgcatcagcagcgaaagaacaagatcaattgtgagtgccaattagaacaagatcaattgtgagtaccaattagtaagctttatgtttgtaggagcttaagattctgataaacatttataagatgttttgactttggctaaagttaaactattttaagtttgactaagtttataaaaaataggtatattttttaccaagataaatttattttatatatatatatatatatatatatatatatatatatatatatatatatatatatatatatatataattattaatttaataaaactaatttggtaatataaatattactatatgtgtctataaacttagttaaacttgaagcagtttgacattgaccaaagtctaagacatcttataatttgaaacgaatagagtagtttattttatcgattttatttggaatgtttagggagctggagagattctaaaagaagccataacagctaaaagcttcccaaacagtcgtaaatactgggtcataatcatatagttaaatggttgcttatgtatgttgttgatctttttgtgttgggagtaatggcagatcgttgcatatacctcgtatgtctgaacatcattcaggagacgaccacatgtgctcatcagtctgaacaactcgttgtactctgaatctctgacgacagattcagggatctttggtccgacaagatacaaagctgggagcacaattgggcccaatgcaaatgtcatggccgcattttccatgtactcctctggtgtaggcacgtagttgctgatcctccattctacctcggtcatcatggacctaagcaaatctagccactgcagaagaaatttgaattgctctaacacccaaaactgaaattttcttttcagcaaaggagtagctgtttggtgatagtttaccttgtcataaatactacaaactgaagattttggcaaaagaaattgcagacaaaaacttactatttctattaggtgtttggtcacatcacggccttgtacagcagaaacctttgctccaagctgattaactgaattgaagatggcaaaaaatacaatctctacttgttcagagtagagctcctctttgtgatgctcatcccacctgtgacaaccattggcaaaatgggcaaaaattgaattaagcctaagaaaatggtatttaaaaagtaagctaaaatcatggatgtaaaggattgtacatctctactagtgaaatgaggttttccaattcttctcttgatcctccaacgtcaaagaaatcgtcgacgacagttgtaagcaccccgtttatagcccaccaaatgcgagcatcagacatttctggatcaaaaaccgttccagcagcagagagatagaaataagcagatttctgccgtgcaaacttcagctcatgaagtctgttctctttcacccaactgttgcatcaaaatttgaaatttgcagaaataagctgaatgttactggtttgtacaattgtacatgaaaagagagagtaactgtcatatttacctgtctatacgctcaagttcatcctggtaaatagattgagtagtactgaaatttctggcacccaaagctacaagatcttgagcggtttgacaaggcctgtttcagcaatacatttaagaatgttgtactaaagtacactagattacctttttgtgaaacaggaagcttacaggtatgttgttttgagcatatgatatatagctcatcgcggcaaaatgttcgatgttccttttatggactagacgatccaatgttgcgtagaacggacagtcaagagcatgttccaccttcaaatacaaaatcatggtatcaaaaacatgtaagaagaacttagctcttgtagacacaatcacacaatatcaaaggagtatttatgttcttgaaactacctcttcaaatattgatgaagttctttgcaacgcaccagagctaagctgttccttcagtaaccgacctgaccaagagcctattctatctagaataaactcattatctgcaacactgacttctgaagccttgtatagttctagtaatgttcttgtgtcactcaaatatccttgatgcgaactatggaaatcagaaacttcagcgatatgacacaggtcatctgcaccaaaattttcatatggatcattgtgtcaactagagtaaaataataataataattaaaatagagtaaaataattgtgtcaaaacgatcgaagataacctaagattaaacacggttaacgaggaaaaaaatccagaattagaaaaataccagaagaaacatcatatccattcatccgaagaatacgaaatgccattgcacatgttgtgatgtccagcataacttcctcatctctctgtaaccaacaactgcaaactggctgttgtcaattgcatgagctaagaaaaaaaaaagcagacaactgatccttactcaaggttacttgggctgatacctgtatgtcatgtccagtatactcttgatctcaccatcaaaatgccgagatattcccatattttcaagcgcatcaagcatggaaagttggcgatgtatatttttcgtatacactgcactcggtttcaaacataaatgaaaaaataaaaaaaatggcattagttactaatagtatgcactttaggaagaaattcttggcaacttggaatggagaagtgttaaaaccaacctgcagtgccaaatttgttcagaagcaaatttaagtatcggtgagctttagcatcataattatggactaacaccgcagctgttatggaaagggagttgaacaatgatccgttcttcctctggaaattcataacttcattccagtcttgggcattccctaatccttctgacacatatgccatatatgtgtttctcccacgatagttctcctcatattctctttaaatcaaaataggaatttcagtcagttacttagagatgctattaaaaatttcaaagtttggaatttctagactagtttggtgaaataaggtggcccattttactaacaattatggttatgaaaggggactatttacaagaagaagactactgtatttagtttagatcatgaggataaaaattgccaatctcattcaggaaaaagaaagaaatgccaaaataaaacacaaattgttgtggcatttatttctcggagatgaagtatcccgtggatatcgttttgtcagatataagaaattccaaactcatcatagtcacaaatagacaataatggtaatatggcccacttccctaaatattatgattactggaaaaggaaacagcctacaacaagaaaagtgctacaatatgtgcaccaaaatccaaaatgacaaaataaaatataattttgtggaccttttcaattccgtttcctggagatgaagtactctttcgacgtcggtttgtccaataggaacctccaaacccatctcaattacagagctaagcataccaggaaaagttatattgaatccaataggagcagccagctgctcatccatagcaatggagaaattccttccaataaaaagcagtcctgttatcatcaccaccttttgtcaaacatttccaaaacttgatcataacaaccaaattaagatactctctccatcccaaaatataaacattttttggacttcgacacagtcttcgagatactactttgactaacaatatctataaaaataaaatgttttaaataaaaagagttacatattataatattttgattaatgataaatttaataacatcaattttacatgattgatttttttttgctattaatggttaaagttaaaaatagttaacttggcactatgctaaaaatgtttatattttaggatggagggagtactaaacaaaagaacttgcaggtaaaaatacacaactttatcttaaaaaaaaggtacgcgcataaaaagaattgtcactcgcagtcgttcaatctgcaaactttgcagtagtcggctatagcttctttgaaggaaagaccaagatgatttccattatcttaaaaaaaagatatataaaaaattgcatatatatggttgttacctctcctgagtgcaagaacacaagccagtgtggacaagagagcatccttggtgattgagtccagctggttgaggtcccaagaaccattgctctgctggttctgtagtatccactcaacgcattgtgggaagcatggaagctgagatgatgatccgggcagaggcaccatggccacccatgccgtgtcgtagggagacggcaacatctcgaatttgtgaagctgctgcttcttcttcttcctcattgtatcctctattgctttcctctggtgcatgacgacgttcactaattctaactgaaacatgagcctgatcttgtcatattcagagtttcagacataacaggggaagaaaataagagatcaaaagatcaccagggaaactcataccatgttgtttgnnnnnnnnnnnnnnnnnnnnnnnnnnnnnnnnnnnnnnn

SEQ ID NO: 42035 - DNA, 852 bp, Oryza sativa
tagcatgtgtatctcatcttctaaattctcatgtgaattgggtagcaaaaatgtcgaaacaagatttcggcaatacgaaaagagggtggctatcaagctggaaaagtgaatgggttaagaaacaaggaattttatacaagttcaggccctctctatgagaagtaataccatacttctgtccggggattgatccgccgagtatgttattgatcgtatgatctgggagaaaagttatatcctaagaggcacccagacccctccttatatagagggaggagtccgtattatattcttaacggaataggcaagtaaattttaaatacaatcgtaaacgactaggatcccgggtatttccttgatacacaagttaggaatttaacccgaatcccttaaagatattctatctacatatagtacccatatacccagtcggatatacatgccatgcgggtatggggtatccataatctccaaaaaaacaactagatgattagagaaaaaaaagtggctaatttgtttgtgtatttaaaatgtgtataataagtttttttttctaaaattcagttgtaacataccgacattcagctagtaattccttaaaaaaaattccaaccagcggtggatcccgctgttaggcgcctgcttcaggatccgccacaatgttgccactgtcaatcgctgaaattcctatgaacagttacggtaggaggttaggcagtagagtgatcttatcgttgggcttgttttttgggacaagttaaaggctgtatgatcccctgttattcttcaattcctaaaattatttccttctttcctacttggtgtggaatcttggatttaaggggtggacat

SEQ ID NO: 42036 - DNA, 4577 bp, Oryza sativa
  unsure (1)..(4577): unsure at all n locations
aaaatgaatgcccgtagcgatgattaaccagcgacaaaataaatgctcatcgtcagcattggttgatttggctccactgctaaatccaacaaaattccctcattccacacgacggttttttagatttacttggaataacatctagccatacaaatgtgcagagaatactatgtcaaaaaaaaaaaagatgaaaatgagacagctaacatttcctttattgccacggcagttttttctccctattgcaaaccaagtggctgatggagaagaaattatgaattttctacgtccgtgcatggacagtgaatggcgtgtctcttctgcatgacgctcctggttgagtgtgcttccctgcgaccagatcaatggagtctggagttagaattctatggaggcgatacaagacaaatggatccatatgtccctgctatactactgctataaattatatatattgcttcattaggcacgcttttctatcatgcttccttgattggggagtttagttcgaagtgactattttcatcttaaaatataacaacggttagctatgtatttaatatacctttttttaatatagaacatactccttccgtcccaaaatataagcatttttactataatgacaagtcaaacattttttaattttaactattaataataataaatatcaatcatataaaattgatgttactagatttatcattaaacaaactatcataatatgcaactatttttatttaaaacaacttacttttatagatagcatctcggagaccgtgtcggagaccaaaattgcttatattttgggacggagtgagtatgtagtaattactacataagtttattttaaccaccactatatactccttccatattcgtaaaggaagtcgtttaggacaatgtttaagtcaaactttagaaatataaatcatgaataactctcaaattgttgagtttgaaaaatataaaaattatataaatagatttgtcttgaaaaatacattcataaaagtatacatatatcattttttaataaatatttttatagaaacaagaagtcaaagttgtattttggagatcatgtcactgtccaaaatgactttctttacgagtacggagggagtataagacatcggtttatgtgatccctttttataacaatggtgatacaacgacgattttgtagtaacggtgaaatgaggaccggtaggctttagattaagcacatacgtggactcttcagagtactaatagttaagaggggtaaatgaccaaatttgtacgttgatttggacgggtagatctaagacgttttaccgtagttctgatgtgcttctaaaaacaagtttaataatatagaaataattgacatatcgtctacgaccaacctaatatcccactcatatgatagttaataataaatatatactacattattaatatctggtccacctctctcatatagtttattataattcgtgtgcttaattttcttccctctcattttctatttcatccacgtaaatacaaataatatgatattattacaacctatataacccttctacatcatatttgtattccttgtaattattcattatagtggtaatcatgttttcgggcttttttcttttttctgctagtgttttacacgtaaaaccatatcatatcccagcacatccatgaccccttcacttggtattggcaacaccggtgatgctactacacggtagagcatccttcgccgccgtgtcagcatctcgccggcgatctccattccacccaaccgccagaacaccggcgaggtgatgcgctgccgatccctcgcatatcttcggtcttcaccgtcgcacgtatttgccaatggaaatatctagaaaactacagtaagttttaaggttctatgagtgaaaaacttatatatatatatatatatatatatatatatatatatatatatatatatatatatatatatatatatatgtaattatagtataattaaaataaaactacactataaatgcactctaactatactctgtactataattatgatataaattatataaaacgtatattcatctatggtttgtttggttagtactgggattttacggtaacatgtgtaaaaattttgttctagcaatttttttctcttcatacataaatctcaagatgatccaatgatcataaatttaaaagttttaagggaaaaaaaacttgtgaaaattttctaacaattccgtttgcggataccacacatgcgccgcgtacgttctggtcgtcagtgatctcgaacctgtcaatagtctgcacaccgaaccaagaaaccaacccgacaccctgctcgatcgttttggacttggtctgcgtccacagaaacaataatgcgatatgccacgcgacgcgacgcgatgcgctgcgcgctgcacatggcgccgtcgtcgtcgccgccatcgctgtctgatcgtcatccttgctccgggggagaaagaaaccgcatgatttggggggatccggaccggttcaaaggcagaggctaggagagggaggaccggttcaaaggtttggccgttctaacgaaaaaaattgtgctctgaatttgcagccagttgcaatcagtatcctagctgtggtggattttgaagagatcaaatttggagctattgctatactttaactccatgtgggaaacatcttctggcaacatattccttgagcttggcagaagctcaaggtgtcgctcttgtgacagccaagttcttgtttggaatggggcagacttttccccgttttctgcaggaactaaacatttactacggcgagaattcttgggtttcaaatgagccaagaaaggttttgctcaatgaattctgttcatggtacatagggcttgttatatagaaacagttggttggtagctagccaagaacctagaaaaccagcttctaatttctagtttgtttttttggtttcgtaactacagcttctcagttactgaacgtattgcttgttttgatggtcagaaattacatgctgctcagtgttctgctgtgatgcttatgttaaactgatcttgcctgacactgccagccaatcaactaacaacgcaacgaaattattcataaattggataattactgcaaatccactacaatcctaacaggaacaaggatttgacctgaatactttccaaccttgtttgcaaataaaaaatactactccctccgttttacaatgtaagtcattctagcattttctacattcatattgatactaataaatctagacatatacaatgtaagtcattctagcattttctacattcatattgatgtcattctagcattttctacattcatattgatgatctagagcatcaatatgaatgtagaaaatgctagaatgacttatattgtaaaacggaggaagtaacaagttgtcgcgtagaaagagttactactactgaagatatctgcttttcaccgaactgatgagcctctgaggccattggcactttggcggaaagaaagctacaatttgggactttgttgctcacttcagtcatgtccgtcactctctttgcaggggcaaaggggaaggcttgaagctaacgtttggaatcactgaccaagtgagtgtgttcagatcactgtaatttcacctgcttgtcttcaaaaggtcaatcttctttaagactaagcagaatctgcctcgtgatcttaagccggaaattttcggtatgcaacaggtgacctgtgatctctccttcttttcttgttcttctttacctccctcactttgtgtaagttgcattttttaatttagtgatcaaggtttttgctataataggttagttcaacgcggaataatgactactaactttaccgatctttcctactattgatctgctaagacatgtcggataacgacatagaaaacaatcatctttgtggccggattagtgtagcaacgactaaaaacttagccatgtttaccgtgttcgacagagaagctaaatgtgacaagtgcatccacttgctgtcaagtggcacgatggataaccagatataaacaaccaaggttctttcactagttatgttccttttcctacagggacaaattaaggaaatggctgggaaggctgacctggtacaagaaaaagacagcaaaaagagtagatatttatgttgactaggaaccatggatagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42037 - DNA, 914 bp, Oryza sativa
aagaactttcctgtggcaggaattcaggaccaccatacgtccctacaactgtcctcgcctcctcggcattcaagaggagcaaccagtggcaaaatcatgaaatagacaagaaaaggaagcaacatcacaactgcaccacattggcactcatgaagctaccaccaacacaacagaagcagccaaataatcatttacagggacgccttttattgacgacgaagaagagtgaacatttacatggacgagtttgatactactattgtacagcattggctagcgctatacagaaacctatatttcaataaatcttcagcatttacagggtcgtcagttcaaggctatctgagacgcagatgtgacgatggaccattcagaatttgtaatactggaacatatggtggccaggaattggctatttcatatgggatgttggcccctaagctgagaggaaggaagacattgctcttctgaaatccagagagttcagagcagatcctggtaaagggttaccttcgggaacccacaaaccacctctgtggggaagcataatctgtttgttggtactcttatcaccaccacttgactccgcagaaggatcttctttctttttctttacaaattcaaagaactccgcaacttgtcgggcatatcttcatggacaagatggaaatatcagacacagaaaatttgaactcaagggcaccacaggatgttcagctgaagctatagaaaagatccaaaagtatgtagcattctctaaagaaaatgggcatcgcaaaaatgcgggaatgaatagcataaatacataaactccatcataaggttcggcagaaaaataatactacaacagatgaaacagagcgtattggataccaaatcaggccgggaaatgcatggataccaaaactagggcc

SEQ ID NO: 42038 - DNA, 14170 bp, Oryza sativa
agtggaaagagaccttaggagcagtttaataacattttaagtacaagactcttcatataaatgaactataatgaaaagtgcaaaaacaaaataattgagttcctaatatgtcataaaccatgtcatatacggatatgttgctagcagttgagttggtactaaacattcgatgtaaggaatttaagcaagaagtgtcatgcaactaaactagcagaaagaaacttcataccaagtactacaaaatacatgtatgccatacacaaaggaagaatgatgcatgagctataggataatagttgtactctgatccctcttaacttgaagccacatacaagaaaagcatttcttttttgtgctcctatagtctttctagcatttcaacagttgtaaagttgaactttgaaatcttgaccactatgaataaagatcaaggtagacctaccgtgtgactagaacgcagccactatacgaacagggttgagttcaattttggaataaatataatgtttgtgtttgttaagaagaatgaactagtaaataaatacaggctagcactagatgttcttagatgttcttttcttatgaaataaatacaggctagcactagaagaaaataatataaggttgacaattgtcctatggacaaaataaaggttttgcaaaacttactgtcgtttggcttcaatatccttgttaaaatcaatgtcatgttcgcagtcgaggaccagagcaggaacctgattgagaagaaatttcgttcatttaaccaaacaaaccttactaatttcttttgaaactaaggagaacattaccttctggatactagaatgcatatgatctccttctaagtagaatactcgttctcttatatccggaggcaaagagccctccatatggactggaacttgactgaccgataatacaccaggaccttgtcctttggaaggaagcagccagctctcatgtttctcatgcaaacctcgaaggtaatcaagagtaacaccaccctcttcagatcttttccgaaccatcattcttttgtggcaagtgtcgggactagctcttagataaataaaaccatctggaataagtcctgggagtgatgacaccactgggtcaaaccaggagtcatagatgctgatctccatctcgttcatccagttggcttcatggacagcacgaacaaaaaccttcaaaaatttaactttgaaaattttaactaggagaagaaaataacaatgggaaatataaagactgcaatcgtatcaaagctctagattcacaatccaagcggactttgacggaaagatttacctaccattctatcactgaaaacacttctttccatcaacctgagaggctttatgccacttgaagattccttctcttgcatgacccttgtaacaaacacataattctggaaagtgtatgcatacctctgtggctcagcatagaaagcatcaagtatgttgaagtgatcagggccaacatcttgccatttagcaataggttcaggcactatctctacaaggtcacgtaattcgatggtctcattggcaattctttgaaggaatgtagtttttccgacactgatgttcccttccacacaaaaggtcagcctcttatttttggaaacatttggtgagtcagttcctttcagctcttcatcaacactttctttaatgaacaaagttatactctcagcatgattcttgtgtatgatgccaacagaactttgcaagaactcaaccattttctcattggacttgccaaagaactgcaaaaactcatgaagtgtcagtgtcaggtatgcggaaattaggataaataaagagggaaaaagacatctaatattcgtgcagtaaggtcgccacaatgaaataaatatcacaaatcaggcctggaggagaacccacaattgtactctgttcttttcctgacactaaggtttttcttttcaggatcttagttgtgttacaacaagaaaattaactttcacccaaaacagtttcaacacaaaatttgacatatatgttgaacacgggcatcaatttcaccaattcttctgtcatctctcctagcgagcacaagaatgcaagatctcctatgatgcagaattggacatcagcatggatcaataattcaccaatgaccacgaaacacacagttgcttgcaagcgcaacacaacacctacagtatccttatgtgtcagtcgactcacttacatacaggtatgtgagtgtaggcaaaggcatgcaaagtacttgacttaagtgactacaactaagcatatatatttctcacatgtttaataaacaacaacaaaacagatatagtactactccctccaggttgataatatttattgttttgaacaagaatgatgttatgattttggatatgaatcatttctaaaatatttgtcagaccatatgcacagattagttttaaaaagtactctaatcaaagtatatatttgttgatactatatatattatagtagaaaataaaggttatgattgtttcctagagaccgtgctcttgttgaaaacgataagtattatcgatctgaaggagtacaagctaatatttcacagttcacacacacacacaccttatccctgtacagctgcttgagctgtgccacgccatcgaatcccttgtccacgagcttcctcaggttgcgcggcccgactccaggaatcgcgagcagctcgccgctccccatcgccgcatcgccccgacttctctgcctcctatccaccaccggacggctcccacctcccccggcgacgctctgctcgccatcctcctcggcatcatcatccccgcacctcttcgccgcatcggcggagcaggagagccccctcctcgagcgcagcagccgccacggggagaggcggaggcggaggcggctagggtttggtgggcccgaacgcgcggcgagaagcgggcccgcctgggtggtgagcagcggcggggcgccgaggaaggaggcggcggcgcggggtacgagcctgtgcatcgctgcccgcggcgtcggctgcagggctcatcaatcgcgcctccagcacccccagtaggccgccggccaacgtggctgcggcggcggcggaattgcggctgcggtggttggaggggttcagggttttgctggcgctatcacctcgctgacttcactgaggttgccgcgaaaagtgaggagaaggaaggggaggaaggggaagcggtgcacgagcggtccacgggattttttttttagtaaattacagattggaccatgtattttttgaccgtagtttcacattgaactggttcaacattttcatttaacaccagatctttttacccaaaattacaatttggactagtggcccacctatcaatgacgattgaggatgaaaagagaaaattggagctaccgatagagcaacaggaaaaggacaaatgcactgatccatttctgaccactctcaccagctccgtagtttgcgtttgtggttgtgagtatggtgttagatgctagggccatgctgccggcgacgacggcgacggtgaccgtctctgctatcgatgttggcgacggcgaggaactaggaacgacagcagttgtggcgggccgacggcaactcatcgccaacgatggccgtggtgtcggtggacttgccgatgatgtgggggggacgagagtaggatgaagcgggaggccgggagctaatcgtctaggcaaaggccgtggcatccatggccatcaggggttgatgcaattcaaatgtactgcacctatctaattcctgagccatttctatttgcagagtgagatccatgttttttaaagcagctcgtatagtctgcttgaatcttaatcgatccattgattgatgaatcggcctctgcatgccccctttcttttttcttttctcctgcaaaggactctaatctcgtagtaatgcaggtggagagatgtagagagtcgtaggcgctagtaagtgtgccactagtccaatttgtaactttaggtaaaaagatctggtgttaagtgaaaatgttgaaccatatgtggttcaatgtggaacaatggtaaagatatatgtcccaatatgcaatttactctttttttaagaaaggtccacggaaattgtactctgttctgcgctggtttttcccctatgctcgtgcagcatggaccggaccaatgaggtggagaattttatttatttatatatttttatatattctaaaaagttacaaaatccatttttgtttccaaaaattacatgaatgtagtactcctgtaaatttctgtaatttttaaaaacaaatatatatttctgtaaatttaaaaaataaataaatatataaattcaaaaaattgaggtgcgggacttaggttgtatgggcccatctctcgtatgactcgtgtggtgggctgtggtctagaaacggggatgcgaagggctattgcacctttcggccctaaatcgttaatacggcccatcaggggaaacagcggtccacgaacaaatctacgcaatagcccataaatacccgtgcatgactgcatgtgaactttgttttaaaaaatctccttttttttttaaaaaaaagaggaaaacttacgaacgaacagtcgaacatattgtgcatgacgtgccatttttttgcatgatcgtccaggtaaatcctggtgcaaactggagttactgaatttgacaatctcagaaaaactgagtctcacatgaactgaatattttgactctctcttgtagcagcctcaccgacccaggagtatccgtgttttctttttttactctttttagacagggattcagtggactctgaccgtacgtcgtcggtacgtatttctctgaacgattctggtaaatggcatatctatcagccaatcaggtaaggcaggacaccgtccaaatcagatgacgtattaagaaaacgaatgaagcttcacgtgccgatggctttgacggcaccgttcacctatcaggaattcaggatacaatactcagaattcaggagcgtggaaaacggagtagtaaaacgcctgtagattacacccaaaaaaaactgcacgagttgactcgttgatcttgcagaaaatcagacatagaatctccagctgttttcagagcctcttgctgaaagagtcagttcagttaggctagctctgactagttaactacccttacatactgtaatcactaatctcttctcagtcattcagctgagcttgcaagcgtgcgtgtgggaaatgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaagacagaggttccggagacctgctctcccgatcgccggtgcacgccggcgagcgggatggagtagtctacgagcgacgacgcagtacagagtaggagacaaaccctagattgatctcgcaaatattgcgtgaagatggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggatgccaatttttcggaccattcgacgcgtacgtcgtgcacgcgcgccgcctgccctgccaggcgagacgagcgagcgcgcgcatgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaggaaaaagtacacccataagatacgactcggtttatgaaaaaaacagcattcttaatcatcctgcacacgctttgctgttctttggaaagtcttaacaaatctgtcaacgtttgggtgaaagccatggccgaactgcaacacgttaaactatgggaatgaaagctacagaggtagaacaggtcgtcttacgatattaacgcagcctgttttttgttttttcagatgtgtctggcacgagctgtttttatggtagctctgactagtattactagtaattaatcatcagccatccaactggtccttgcatacacgttgaattgttcgtattttctcgttagcccttgctcctaatgttgggttcttatagtctttcttttgtttactgtactaagatcaatgctgataggaaagcaggtagagatcaaataatgcgagttgaaagaatcggcttgaagaccttgcgatgcaaaaagaccttatctaaagtctctctatattttggtgagatcattgcaaagaagataggaaggaaaaagagtatatattggcaataggtaaggtggttatgagctcccatttcccatacgaaatactcttctatactcatatcatcatggatttaaaacaactgcaacattaaactagaaaatgttgttaataaacaaaagaacaaaaccagcatatacgaaaggttgttcaccaaattctatttaattacatgcataagcagatctttccatccaactatacttaaaaccttcacttgtaatgaagcaaccaaaccattaattcaagccatcattatactagaattttgtaggacctggatgcattcagtatgaataaatataagtagctggcctagcggaaactaaacaatgtaactggtatatctgattaatttggtgaagatgaactgtcacacgtcctgcatatgtaggacagccttacctgcatcatcccaaatatgagttcgagccaacgaaacaaacaaaattccatcagcatctagctaataagattgattagagagcttccatgagaggaaaattaataccggcagtgctttactggtgcagaaagattcttggaacagaacatttctttttcatttgagcaggggaatcagtattatctttgccaatttatgtcacacactgtactatcctaccaattaagaattaacacttatcaattattctctattaaacctgaaaagttcagggaatatttattgctgagagattaactaattcactagtcataacataatcatagataaggcgcaagttgtgaggacaacatcaggtaggttcggcaggctgtgctgcgaagcacgaacggagaaaagatggatggattaattgtcattagctgccatacaggtcggtaggccttaacatcctccacagtccatactaatcacattatcagaggctatgtagcgcctccatttgcagatatcattatggatcaagacatatgctgctggctagggatgaaaacgatcggaaatcaaaaaaacagcctcaaccatttccgtaaccatatttttctcggaaacgaaatcggaaacggtaaagtcggaaacgaaaacgatatcggaaatatcggaaaaccggaaacggaacaatacggacggaaacatgtcggtacagatcggaaaccgataacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctgtgggtcaagtatagacatgtcctataatatcgacatatttagaatacggtaattaccatattataagaaacggtaatttccgcgagaatacggtaaatacggaaatgatcggtataacagcaaaaccatttccgttttcattttcatattttttatcatttccatttttgtttcggttgattaccatttccatatggctcggccggtagaaagtcgaaaacgaacgccggtcggccggtaattaccgttaccgttttcacccctactgctggcgacttgccactcgccataattcttaattccatttccgagctgtacgcatgcgatcgaatccttacaaaaaaaaatgatgtggtagctacaaggtaggaggatgtatttttgcattcacgttccaacaactgttgcctcacgtgttgtttcaaactaaagtacttaatgatctttcatgagaagaagaaaaaaatgctttgtgtacttaatcactgtgaggtggcccaggcgcagggacaactctagctcatcttacctgatgtctaaagtgtctaacgatagagagtggagatataacacaccattcctctcctaattaagcaaagcatatgcgtgcatctagatcgagcaattggttaaaccaagctagtgggaaacaaagggaaggaaaagaacatcataccatttcatgacttcttgcaaacgtaccttcagtgcagctgcatggctgcgattgacaccgagaaaattaagaaaacccacccacgtacgtctatatcgagcccgattcatgcatctcaaaaccgtatgtttctcgatcaatccttgacaattacgccaaactcaaggcaaactgtacatgaatccccaccccgtacaagaggaatttttggagctaatccacacattcatccagaaaaattaaacaagtctggttcgatcgatcagggagaagaatgaggacaatggtgtggcggtagaggagatagcgtatcggctctgtccgccgtggacagtggacttcctctgtctgcacatggtgatggcgaccttaattaacccgttgatgatccatgtcagccgcgttgcttaattcctccgtggaattctggaggttccggcccggactcccggtcgggtcctgcatttcatccgcggctgctaatgtgcatgtcatcctgtggttgcgttcgtgacatgacacatctgcagcttagctagctagcattttgttgtcaaaactacaaccacatacgtccaaagacgtggtcactcaacaatggttggaaaaaaagtagagtgtattaaattgagaattttactgatccccctattacatggccctatggggctatttatagcctactagggttttggttatacaggggaatttacatggttgcccttgtgaaagggaaatttacatagatacatagcgtaatcgcggtctatgggcccttagcgggccgatgggttattgtcgacccaattgacccctaggcttgatgggccaggatagcttcttcggccctcccggagccgaacttgctacggcgaagtcatcccccttcggcttatgctcttcgccttgcccccttcgcccaggaggcctctagcttggttgtgattccctgcctctcgccgtccttgctctatagtcttcgctattggggggggttcgtcttgactaaccctgacgtctcgggcttgaatcctcatcggtcgcatgctttcggcaggtttggtcgaagggccccatgccatatcgccaacacatttgatcgatcgtcggtggagatcaagtgccaaatctagctaggtcgtgtttagttccaaattttttcttcaaattttcaacttttccatcacatcaaaatttttccacgcacacaaattttcaacttttccatcacatcgtttcaatttcaaccaaactttcaattttaacgtgaactaaatacgcccctgtgtcggcatatcaaacttcatcataggatccatggatgcatgcatgctttcatgcggtacagtgctagagctgtacagtgcacccctcgacgtggaggtggaggtacgtacgcaggcacgcgggactcggcaacaaccaccaccaccccgaccagtcgagatcgactccgtaccagcctcctctgactgcatgcgagcatgcgactgctcctagcatagcaccagtagaagtctagaacgtacggccgcgtcgtgtggcggcagttggtgcggggtacggggggcggcgtcgccgtcggcgcaacagtgtcacgcacagtgatatctcctcgcgcacgcggtcgcgggcgtacgagcgcggcgcgagctgagctgctcccttgttggggagggggccccggcgttcacggggcgcgcgcgcggcgcggggcctgacaccgtaccaacccgccaccaccgagcgcgcgaacgcctcacctacctatacacaccgcggggtggtggtggtggacgcggcggtggctcgctagctcgcgcttcggctggcgatcactttagctagcgatcgaagtgcatgcacggatgcacttcggtgagagcaacgtccgaccggcaaatggatccgaccggaatccattgaagaccgggagttgactggcgcgcactgtacacgtggataacgcatgcctttcgggccgttggatggaatgcaagcgcatcaaaagtagagtgagtaattgggagtgtaatgtaaactctggatgggacattgtaaactctcgatagaatattctctcgttatttacatgcattgaaatggttataatttttcttaaagaaattaactagatagattaatatgtgatatattacttaacaagcatgcaggttaaaattcagcttttacattttaaaaaaataaattatgactagttaacgtatattaatagtcaaatttgtttttttcgttacaacttgtagattttaaatttgactttacatatttatgaagtgaattatcagttatcacatattaatctatcttgatagttttttttaaaaaaaaactcataaccatttagatgatatgcaaataaacgaggggatgtcaccaaagagagtttagctagaatagtttcccgtgagtagttgttgctagattgtggcattgagcttgagccactactagatctttatggttttggacgatacggttgctagctaggcctaacagctgcaagccaccattttatatgctgtatatataggtcactttcagctccaatctcagcaatctgaccacataattccatgaaaacgaaaacatattttttttaatactatgaaaattcgtacgggcaaaataaggtgcacagatcagtgtcggtgcagacgcaatgaaggactgatggcgaattggccatcacaccacacagcactctctagtgacaaagaaggaattgtcgccgcagagttcagccctctagctagccctctcgtaattgaatggaaagaaaagaaggtttcttcaggggcatttaacttcttcagaccgcatctaatccgtctaaacgcggcaaaaggctaattcatcgtataatctagctagacctgactcgcgcgcactgttccaggccaatggcgctcgctaacctggacactgccgagaacacgtgagtaccttgcagtgcaaatactagtactagaagtacgtagaaccctagaaccacggaccatgtgtgggttcgtgttcaagaaagacgagagggagaaagattttggacccatgctgtggccctgtttagttataaagtttttttttccaaacttttaactttccatcacatcaaacttttcatatacacataacttgcatggtggtccgcgcagattgcgcggctagcatcattatattttctcttatataaaatcatatatgttttctcattatattattaaaatatattacaatgacaacataattttgaattttgcaataacttttcaaaactactaatgtgtaataactactctagtctcctcttctaattttccttattttttaattctgaatttcagctatttctaaattgtatttctatatggactctgctttttttttctctgattaatgtgagaatttataggcaatgagagcgaacgtgtaggctcctttttattccgaatttcagttggttttaattcaaatatgaactctatattctacttctaatattccttattttttaattccaaatttctatttttttttcttaattgtatttctatatggactctatactctacttctaatatttcttaattttaattccgaatttcggttatttcctaattgtatttctatatggactctatactctacttctaatattctttatttttaattccgaatttcagttatttcctaattgtatttctatatggactctctagtctcctcttctaatattccttattttttaattccgaatttcaactatttctaaattgtatttctatatggactctagtctcctcttctaatattcattattttttaattccgaatttcagctatttctaaattgtatttctatatggactctgttttttctttttctccgattaatgtgagaatttctaggtcatgagagcgaacgtggagggtctttttttttccaaattttagttagttttaaattcctatatggactctaaactctacttctaatatttcttattttttaattccgaatttctattttttttcttaattgtatttctatatggattctatactctacttttaatattccttatttttaattcagaatttctattatttcctaattgtatttctatatagaatctatactctacttctaatattccttatttttaattccgaatttctattatttcctaattgtatttctatatggactctatactcctcttctaatattccttatttttaattccgaatttcaactatttctaaagtgtatttctatatggactctagtctcctcttttaatattccttattttttaatttcgaatttcagctatttctaaattgtatttatatatggactctgttttttttttctccgattaatgtgagaatttcgaggccatgagagcgaacgtggaggctcctttttctattcctttaattatataatagatttttctatcacatcgtaccaatttcaaataaactttcaaatttagtgtgatctaaacttcagtgtggatgaaagatcagccacaggttctctccttcatcaaggcgtagcactatccaggttgacgcttgacatgacaagcattcactccgccgtacaccgactctctgtgtgtgttcagcacgcggatcccccggacgcgctgactccacctgcaaatcctcaacagtgcaagggggatcgctctagatgcgaccgcaatctaccacactgacgacgacgccattgctgccatcaaagagatagcttaattaaaaacagtaaccactcataaatggatgtgtttcagcttagcttcttgctgcagaatcgtctgaacgagaaggaaaaatgtccaatttgatcatcgcttcagtgaactttggaaataaactcgagacttgttagctcgtgtttacacctgcgccacacgtacactagcctctgcctttttgcactgatcaaatctcatcgaatagccgaccccaacactatcaatccttttccgttgtcaaaccgtgcagattcaatcgactgccgctgctacttgctaactacttccaacgatccaaggcaggcacgcgcaagagcaagcatgcctggagatctcttcttggtagttagcttggttgacccattaataccggccatttgtgccccccaaaagtgctcgatctcttcattagtgactagtacttggccacgacaaccatctttagatctgtaactacttctataaagtgttcaacttcttctgtctcgatcgatagcaacgtcgagttcgatggcctgttcaccagaaatcaattaatatgagaggttggccgccaaactggaaggaaggttaagagagtatagtttaataggagtacgctacgattcggtatacgctactcgtctatacgcctctc

SEQ ID NO: 42039 - DNA, 31101 bp, Oryza sativa
aacgaaaatcttcgggcacagtgccgtcgttgtcctatgatcctatcatcctacccccaatctagcgagtggtactatccctgttccgacaagtgaaaacgactcgatttgatccaaaaagatgaacttttctcgaccagctagctcatcagccacgaggtatacgtccaaccaagcgggtgtgtctagttcacgctaaaattaaaaattaaaagtttagttgaaatttaaacgatgtgatagaaaaattagaagtttatgtgtgtagaaaagttttgatgtaagttgaaagtttgaagaaaaagtttagaactaaactcggccaatattgaacaaaaacatttggacggtggatgttgcgtcggagctggtccaatattgaatccgagtagttcccaacgcaaaggggaactaggcatgttagttttgaccatgagacaccttgccccaattcgttaattaacatatggctaatcaaaactcgtaaggcccagcgtgtgcagtgcagtgcagtgaggcagcaagctaaggcatgcaactacctaatcagtgctattaaattgtggccatgtggcaaataagacaggggaaggaggattagagaaaacggtggttagtcacgcacacatgacaaaacgcaagagacacgagagacagagaacagctcagagggtagctagccaatcagtggcggttgctccaccaaactttggaaacgagtaccaaaaactggtcgatgattccgtttcgctcatcatcaccggcttattttaatgggacattcccccactaaaaagctgagcggctttctccgatcgctaactacaatcaggcatccagaacgagtcgttgataactttaaaaaactactcctagtgccgtgctgtgctaccactgtaaaccctaaaaaaaaatgccacgctgtaacaaagttgttaccggttacttgaactgagtaaaagaaaagggaattgctatacgttatttgaatgaaatttgaatataaaatcttctagattttggttcattggatccatactaagattcatgcatcggcttctcttctctaactgtagtgggctccctttcttctccggtaccggcgacactcccaactccgatagggaatatacggattagggtttagggttggggtcaggataggagaggaggttggggagggggaagagcgggtttcctcggggcttaaagggatggcagtgggcggtggacttcggcgggcggcgaggtggtggcggcaccgccgaagccgtagggatggagaagggcggtgggccggcgttggcggcaggggcaaagcaagcatgcgattaggaggcgacgactaggtgatggtggatccggcagctgggagccgccggagacagggaagatgatggggcgggggcatctcgccatcaccaccttgagaagaaagagagggaggaagggggagcggggagggggagggggctcatcgaggggcccttatcggcgccgttgactcctttcggccagtcggcgaggcgggtgatagcgcggtggggcggtggcggcggtggattgggcggtaacgcgatggcaatggtggatcggaatgctcgaggaagcaaagggaacatgagaagaagaggtagggttaagggcttgcacaaaacttaaagcaaatttgatggtctaaaaatcgaatgatataaggtgggattttatattagaagaggtataggcatcaaagaaaaaaaattggtaaattttgtactcgtagctagtactggttccaaaatttaactgtcaaggcaagtacaagggaggtcggggaggatgattgggttgggtagagcggccacactattgcggaatttcgcgaggccaagtgagggtacaccaggacaccaggtactacaccagtactgggtctcacggcatctcgcatcgcgatcagcggtcaaatcccacacacacgccgtaggatccagtcaatggagagaggaaaagaaaaccaaccaacacaacaacacagaaaagcttcgccaagtgaatcacccaaaaaaaaaaaactcctctctacgactctaccaacacgccgccgtcgccggctcgctcgctcgctgcccatatatacgcgcgcctcgcgtctccacttcccctgctattactactagtacaaaaccaacgcgaagctctcgtcgcgcacaaccaactcgacaccgcggcgaggcgaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtaagttgtaaacggatttcaatgcgctgtcatctgttcttgtgttcttggtgctgatcgatcgtttggttggttggcgcaggtggtcgttgattgcggggcagctgccggggaggacggacaacgagatcaagaactactggaacacgcacatcaagcgcaagctcctgagccggggcatcgacccgcagacgcaccggccggtcagcgccgggagcagcgccgccgcggcgagcgggctgaccacgacggccagcaccgccgcctttccgtcccttgcgccggcgccgccgccgcagcagcacaggctacacaacccggtgcacgccgcggcgccgagcaatgcgagcttcgccaggtccgcggcgtccccgccgtcggaggacggccacagcagcagcggcggcagctcggacgcgccgcggtgccccgacctcaacctcgacctcgacctcgacctgtccatgagcctgccgagctcgccgcccaagacgccggccgccgcgtcgtccacgaccgcgtcgcgccaccatcaccaccagcagcagaagaccatctgcctctgctaccacctcggcgtccgcaacggcgacgtctgcagctgcaaggcggccgcgccatcgccggccggcccacgcgcgttccggtttctcaggccactggaggagggccagtacatatagcacagcaggctttagggaaaaaaaacctgtaaaaaacacaaaaaaaaacggtgggcaatagagttttttctaagttctaatggagatgactgatgttgattagtttgattcttgatgtttatcattaaccaaaaatctgattcttttcctcttcccaattttctgatttgatttagcagaatcttacaaaaagtaattggagatcataaaacaaaactaaaatggaaattataatgagcgagactgtgagaaaatataaagtattgctgggttgcgcatccagttcgggcgtcccaagtgccgtttgtgtcatttgggacatatcgcgagaatacagcatgtggtgtgttttcggtaggtaggtacaaactactcctgcttgggttatccgatagcaaataaaatccattaatgactcatggtggttaggcaccggagaaagtgagactgacaatgttacattttggtgttaaggtttggctgttcgtttaacaatgacaacgacatgagattctaaacgtggtgatatatagtggtagttagccaaccaaccttagaaacctatattggtggtggtaactaaaatttacttttgtttctattggaatagcatgccttaaaaaatactctctctgtctcaaaatataatacttcctccatctatttttgatagtcatatttctaaatctgaaaaatttatttttgaatgacatatttcaatccaacaacctatcatcttaatgattttcttggatttaatgcgtgactctccattcttccacacaagattggctacatgggcatcgagaaatgtaaatattaatgaatcgcttatttacaaagaatgactagtaacatatttaaatagatgataagtagaattgcttatttttggtctgtgtgccaagatgaaatatgactgtcaaaagtagatggagggagtaacttgtagctctcaagatttatcctaaaatataacaatatctccaccaacattatcttcccaactaatcacaactctctaccattcacttctacctactttcttaataaccgtgtctaactctaaaacttcttagagcaggtacaaaagtaaactattagccagctgcaaacatattttaatgagataaaagatgagtgagaagagcagcgggctacagatctatagccagttgcagcacggactccaagacgcaatgtgtgtatgacatgggggactatatattaatagtatagtaagcaactattatatgaattggctataaatgaattggaggcagtagtaggctatattattaaacttgctcttatattataggacggatggagtaggcagcaacatcatactccctccatactcattaaggaggtcgtttaggacagcgacacggtcttcaaaacacaattgacttcttgtttctataaaaatatttattgaaaagtgatatatttatatttttatgaaagtatttttcaagacaaatctatacatataatttttacattttcaaactcaacagcttgagagttatttatgatttatattcccaaggttcgacttaaacattgtgataaacgattttttttatgagtacggagggagtatttctaaaataaacaattaaaatcgggtataggttggtcagtacagagcatcaattatgttgcatatctgttttccatctgatatataaaaagaaacaattatacatgtttttggctagaaaagatttcgttcacaagtaatactaataagaaagctataaaaagagccattatatttgagcaaaatggctccttctcgttaattgctaccatcgataatcttgatagggtgtttgatatagttggtaggaaatgtccaaactacgtatctctctcatctctcactattctttttctcaaatttagccatagtcttaccaaaacccatatcttgtgctttctctgtcaaaaaatattgcaacttaggatagagtttatattcctattcatattctatgtttcaatatttttagatagaggtagtaacattttatagtagtttcctgagcaatatgtactttatgtagataatacatggaagtctggaaccaagagatcgatataaagtcttggcatgcttggcctaatgtgtctcatgaaacacatggcttatggaaaatagctgaataatcattcgaaacttcttatgtttttgttacttttgtcaaaactacgaaaaggagttccttgcaggtaagttcgacatggacatggatatgtttattcttctcgtgactatggatatccactcgattaccctgagtccctgatccactctttctgcgctaatgtttgagggtatctggtttaattttctactttgtcaaatgaatcaaaagaaattaggcaacttttaacatgacgaggcaattcgttgattcataaccgatttttttgttcggcaacttcttaatactgcagcccaatgtggcgaatacttagccaaacacgtgcttatttttttccgagctggcatgtgtcaagtacccagtggatcttcttagttttgggaagatggaccaactccacagatacctggaagtttcgtgtcagatttgtagtgtgacacctgaagcaggaaagattgattatggagtccccatctttaaattccattaattatagtaatgctagtatgtgtcaatgtgtgtaaggtcaatgtttgattcatttgccatcatatttgaaacgagaatatttgaagtcagacgccgaatcgattgcccccaatacaaaaacggtcagagcatagatgatggtccgtggccggcgacacgtatgctgtccgtctcgtgactttaccaaccacctgtaccttgttgctgctgctcgttacgcttccttgttgcaagtacgcgaaatgatctgtcagtgtgatctctctcgtggcgcggctgcaatgtgaacctacgaacaagggagatgattgcctgattacctcgttccggattcagctaaaaacgtggttttcaagactatatgctgttgacaaaagagtgcagaaactaaaactgtatagtcatgttactacctcacgaacccgtaaaatctgcaagcttcctttccagatcagtggactttcatggctaccgggaggatttttctctcgaggttccgtaccatctactcccacaaaccacaagttgtttgcatatactcatcacgggttaactaaccaagggggcacacgttcttttccgacgttttttttattcttctcccccttgttcttctccatgtttatctgcagcaacaagctgtagataccgtcacaagtgcgtgacagattccgttacgtgacctcatgggataactccctgtaccaaaccgctttttttcttccttttttttttttttgccttcaccaaaagtcatcgtcgtcatcgccttgtttgcccatgatggcttacgtacgcctcggtggcgaccggcgccccggggttcctcgcgccgtggcgcgtctctcgccacgtacgtctcgtcgatcgcgccccgcggaaactttgagagattttacgttctctccctagccggaatcggctgtcgccgtcgggcgcggctagcgatcgagagataccatcgcggagatggcagtggcacgcgcgagccgcaaggtggatttggatgaggggggaaacgtgtgcgcgaatgcgcgatcgcggcaaaagctgcggcgcagtgcgtgacacatgcgcgataatcgttggagactggctggccggtgctgtgcgcgagcgggatcgtgaaaggtttccgcgtgttacaaaagttagttgtagttgatacgttgaaacgacgactaacctttctaatcattttagtcattaatcaccaaacatatattagacgaagacatacgttgtttagataataaaatgacaacacacgttatatatcgttaataaatattgtgtgttttatatcatcatctgacgtgttttaggtgatcaatgactaaagtgatggggaagatgaactgtcgttccggactaacttctccaacatcgcagaaatcgtctcttctaccgttcaccgccgtccggaatgcgtaatccttgcttgaaccgaactgaaaaacgtcgcccgtcatccgaccgaagggacccaaggtttggtatcttcgtttgaacttttggcatgcttttatgtcttatgctaacagaagatagccatcgcgtcgaatcaagaaaccaaaaatatcggctcatggtgggctaataccaaaaccgctaccaccacagtactactacctagtatttagtatcacttgactgtcaagacatgaaagcaggaacagcgactcatcctcggggggtgatctgatctcatctcatctctaggccggcagcaagtggtactactaactgatgcgaccccacgcggaggcgcaaagtgctgctccttgtgctgctgggcgtcgtggcgccgtgaatccccacacaaaacaccgttcaaatcagcgagcttttagctttggaggcgatcgcatctgtgtgctgtgcgtggggggaaaagaacaacgtgggatcgatgtggttgttgctggttggtggggcgatgacatcaccgacgaccgcctcgcaccggcgcgccgcacctaaccgggcaatccaccggtggatccatcgaaatcgcgagctgtagctgttcccggcacgcgttcggccttgggccccggcccccgcgacggcacgcgatttccgggtcgcgtttggccttggcacgctgtaacttggaaaaagaaaaccggccacttgggcacggatgatgcatgcatggatggaggagtagtgatctaatgatctaatccatatcgccaacctaatcgtcatcttcttgatgaaggccgcaactggctaattagctcgtgacaggaaagaatgttcagataacaggtgatagatgcgagaagggtccagcaggtcatcaggtttgcaagtttgttttctccagctcagtttgtaatttggtcgagaattatatgtcgagtttatcatcagtttaataaatgtcctttgaacatagtacagtggccggtcgggccaagaaaactggctttcgaaacgaattgcttcacgctggtgccgaggcaaagcatcatggtcatggaaaggtgcctgcccggctgtcctactgcgtttgtgttgtttcttgatggatggatcatgatcactcccttttcagtttagaatcatacgtgcaggcgtccgagaagagaatttagttctttgattagtttaggccttttcaaatactgcacagtactagtttccacacaaactgatggagttggcagcaccaatgtcaaaaaggaagtctatgcactttgatagtatccgttttttcatatttaaggataatctctgtcttgatcaatcattgactgaaaaaacaaaggtgaaaggatcattagtactagctttctaataaaatcagctaataaagctcccaagtcgacgtgtgcatgcttaacagaaacaaaatcagctaaaagcacttcttgtttaatagaggttggtcatacctactcctaccattttgcccaaacagtgagctgtggtaggccataagcccatgataagcagcctgtcctcttctccgcatcttcctggtcatgtgactttgggacctcttctcagaagtttcaacattctttaatcacaaccgccagtgagttaatggcagatggcaacaaacagaatttgggcttaactgaaggcatttggttgcagaggtaagccatgtgctttgaagggggcaaaaccggcaaagactatgctgaaaccaggctaacctgctgatatctgaccatttttagagtgtttgatactcctacttgactgtcatttgcagcgacggtccatttggacaaagaaatgctcctagagtgtttgactacttgttgtaggagtatgtatgtaactgtataagaatgtgcaactgcagatcttgtggaagctggaacaaataataaggcgtggaattggccgtcttgcttctgcattacaggaatatggaggccgttacagcgtcgacaacagacactttgcagcgacatctgcaatgtcccatgacaagtggaagaacacactgtagaaattcctgtgatgaaggctccagactggagtactctgttaaaaaaaaagccaaattaggtgaggattttacatcacatagtacaactaatcaggatataaggttgtccagttttgttgtttcagactttcaggtgatatcaaatccccatgtaaagtcccttttgattcgtagcaatgaaaaaaaatgaaggaacagaaaaagacgtgattctgacaggaatataagtgtaaaatagggagattgcaaaacacagaaaaaacataaaaatgatcgtttaattgagccgtaggaaaaatataagaatcaaataagagagataaactcaaagattttttttttcaaaaggttggacctcttgcaatgaaccattccacaggaattacttagaatttggaaaactccaatcttttgattcaaatagaaaaaattttaataggatttcaatcgtataaaattcctctgtaaattcttagattcaaatgggtctaaattgttttttctgtgatggagcgagtatagaccagtcggagtcaacaagtcagcttgcagttagcggcatttaatcggaccagtcctaaaattccaacgtttcaccggcattgtgcagtgcagcgctgtgtcgcagagggagcatatcaaatccttcttggaggtgctatactgcgatgcagcagcggcccctcttcaaaagttcaaacctgatgagatgggagtgctgtgccagcatttatttcctctgtttacaaaatcaaatcagtatagaacgtgacatatttaaatacaatgagccctctttgattcaaaggaaattcatataaattttagaggatttcattcctataggaattttttctatatatccctttgaatcaaagtaatggattttatagaatcctatgaaattcctatggattgcctaatgccatgcaagttttggaggaattctaacatgaggtaaaacctcttgaaaacttttctttgagtctttatctctcttctaattcctgtttttttcctgcggtccaatcaaacgaccattcctgtattttgcaatcatctgttttacacttacattcctatcaaaatcctgcgttttttctattcctatattttctcatttctgcgattcaaaggggccttcaatctgaatagatatgttcagattcatagtactaggatgtatcacatccagtacattgattttttatgggacgaagggagtagtatggttctcatcagacaagaaacacttaggccccctttgattcaaaggaaattcataggaattttaaagtatttcatttctataggaatttttcctatatagccatttgaatcaaaggaatgaatcctatagaatcctatgaaattcctatgaaacgcctctttccatgcaagttttggaggaaatttagcatgaggtagaacctcatgttaagaatcctttgattctttatctctcctcaaattcatatatttttcctacggctcaatcaaacggtcattcttatgtttttcctgtgttttgtaattctctgttttacacttgtattcttgtgagaatcatatgtttttcctattcctccgaattttcattcatgtgaagtactccctccatccaaaaaaaagacaaaccctaggtttccgtgtccaactttgactgtccgtcttatatgaattttttttataattcgtattttcattgttgttagatgataaaacatgattaatattttatgcgtgacttgtctttttaatttttttcataattttttcaaataaaacggagggtcaaacgttaaacacagaaaccaggtttgtctttttttttatttttgagacggagggagtaggagtaaaatgggactttggaagtagaggtaaaatggtcagatgctcgaaaagctgggacatcataggtagagtctgccaaaaagagtgggctagtactcttttgacgcactccagtcctttggtgtcagttggaccggtatgtataggagctggtacaccatggtagaatgacacccatttattccttttcagtttatggaaaaggctgtgtttagttagcgaaaaaagttgaaagtttagactgtatttagttcgttgaaagtttgagaaaagttgaaagtttgaaaaaaaatttagaagtttatgtgtacataaaagttttagatgtgataaaaagttggaagtttggggtagttagggtgaactaaacacggccaaaaaaaacttctattacatgttacctccttcaaaaaaacgaatttagaataggatgtataaacacaccctacagaaactaggtgccgtgtgaatacattttcttttttcttttgttgaagacgtgaatacttttgtcttggcaaaatgcaaacaaactaatgagtagaccgtatggttttcagacttcaggctagtatgccctttctactccttccatgtttctcactatccttgccgtgccaatgtggtcactgtctatggcatgtgcggacgtgccgattaaccgggccacagtgccattttgttaactgaatcaggtcggcgcgatataaagtcttgctctccccatggattcacggtacagcgatggctccacgtcgccgtcgtttcgtgccacgcgacgcgacacgcatcgccggctgctaacctcgagattgccttggccgcggtcagctctccagctgctttcagtttaatcctgcaaattttcgtcggggtgtggtgcagccgtgcaggttaggttcgcgggaacatgccctcattgactcttgcgagtatcatggcactgtgtgttttctacacatgtgtttctattgtcgtttccgtgtctggataccagctcgttgcttgacttgctaggatcccttcttgtctgctggttgaggcagggaaagatgccaccaagttttgcctaccggagtactcctatactgtaccttgtcaaacctactgtctgacgacaacgtcgttgttatgtactccgcgtcagtagtgctggtgcacaacgctctgctcctttcgtcaaataccgacctgtttttattcctcacggcagggaacggagcagtaatggtccagtacagtgttgcattgactcccttgaaaacttggacgagcccgtgacctcgcgtgacgctgacggctgaaacctgcaggctttgggcacgccgcccttgaaccaatctccgttattccccatgagaaaaagattagaggtgatttattctacacttattatggagtgaaattattctcctcaattatctcctctccaaatcgaaccaggccaatttaagtactaccttgtattagtcgtattcgtacagtactcctgtataatacggagtacgggtaagtagcacgcgtactcgcggcctgcatcctcttcgggctttggtgcatcctcttcggcctgcatcctcgcgtaccaatatgtggcctgctggaccacacacggacctagcaatcacagtgcagaccaattattgtgggccgcatattggtcacaaggccgacaaataatacggccctcaagtaagtagcaatgcggagagacaccgttgtttacgggctcttcatgccgctggaaatctggtccgaactgaaggtgaggggttgggccacaagacggcggcgtaactcggtaattgagctttcgagagggtggcgatgtacgtttgggctgtgtgatttacacaagacagtttttcctttttaggagaaaggctttgtgtacttggcgagtgggctggatttccaccggtggtttccttttgtttttgcctttttttttttatcatggtgtccttttgttttttttgggaataagtttattttagatcccttaacttgacagcaacttcgattttcgtccttgaagaaaaaacaagtacaacgggacccaccgttgtcaaaattggtgcaatataggttccatgacagtatagtgggtgttttttatctgatgtggcaatttgacccgagtcaaccgtgccgagtcaatgtgggtcccacattggccacagttcagttgttggaggacttggagctggagtaggccaattgcgtcgttgtgggcggttgcggcgaaaggttgggacatcgggcggcggcgagctcactcgtgacaggcggaggtgatggcacgttcactagtagaggtggggacgacttcacaggtgtttgggtcgatgtcagtggaggcggtgaaggcgtcactagagaaggacaacgtgcaatgaggtggacgacaaccggcatccatgaaccgttgtgccccctactccagcggccaccacggtcgcctcactccagcaactcctccgctagtcctcgctcccgccgcatctcatcgctgacaagctctcttcatcctcctcctctgtgtggccgacacagtggcaatggggatatggggttgcgccattgtgtgggagattgtgacgagacaagccaacgatgacgacgtcaggcgcgaggaagatgacgacgtcggagaggaacgatagcgagagaggggcctacagccaccgccagcctagccgccaccggggaccagcttcgtctagggcgatgctgacatcctccccctccccgacaagcgtccctcaaccctgcttcatcggctggcgggattggactcataaaaagaaggggagagaaaagggcaaagtgaaagagagagggggaagaacaagctaggggaaccctgacatgtaaggcccacgctgatttagattgccacatcggacgaaatcaaatcgaactgactgtcaagttaagggacctaaaataaacttattcctttgttttccgtaacacgtatgtgcaactggttcttctagtttgcagtttgagacaactcaaaagcttagaagtccgagtacagcggaaatagaaatatgaacagaggaacaatcgtatgcaaacataggtgatgttcttttctttttttttcttttgaagataaagatgagaataaagattaagtttttttactaaaacaatatggtattaacatatgattgattgagttttaattattataaacttgaaaaatatattattatgatattttagagcaactttcatatagaaagttttcacacgaagcgcaccgtttagcagtttgaaaagtgtgccacgaaaatttttatcctcacttttgttggagaaaaaaaagacctatgaaaagaaaagtatatgaaattgtgcagccttgttgcaggtgttaatatcgcatcaggcactggcagtacagctactccataccatgaccgtttcccatctatgattatcccataaatatatgcatgtcaagttgacatttgacaacccaagtttgttcccacccaacgcggaccaatcaaataaggccatgtttaattcgcgaaatgaaaatttttagatgttacattgggcgtttgattcgatgttggaaggggttttcggacacgaataaaaatactaatttcataactcgtctgaaaaccgcgagacgaatttattaagcctaattaatccgtcattagcacatatgggttactgtagcacttatggctaattatagactaattaggctcaaaagattcatctcgcgatttccatacaaactgtgcaattagttttttattttatatctaatgttctatgtatgtgtctagagattcgatgtgatttttttttaaaaaaattggaaactaaacaaagcaacaagacataaacaaaggcagaacaaaagaaagctacgccaggtcgctcgactccatggctgtgtaagaggtcgaatttatcctattttctaaaagaaagaagatcaacttcgacaagttgatatgtggtaggaccctagttatcaacggatcaaccctacacagatcacctcgaccaatcgataagtccgacgacacggcaacacggctacttgttcccagactggcacgacgactgtataatatatgcgaccgtataacgtgcgtaattgatgctcaattcggcgaggaaacagaagaaaaaaaagaaacaaaaacgaatggaatccagatgggataccgatcatgtgccggccgtataatcttcagacttgaggacaaacacgacacatgaacacagagacgttagaggcaccatgcatctccaggtcccacgttttcaggaatccaatcagggatggccgagtcagtcagtagtggaggtcacattttcagtttcaggttagagacttcattttatttttcttttcattttgattagttgaggtagttcagtgctcaattaagtcatttacgattaaattaactatgcatcaactactactaatctatcaccaattggagctttggaaaaggagaggaaatgctagtacgatatcgaagaatgatgtggtcaggttggtaatggttgtctacagaaaagaaaagagaaaagaaaacgaaaagggttggtgatggtttgtctgtcccagccatgagcgagctgtacaccgcctaatcacacctccaaacaccggtttaattcaatcgttgtcccaatcaatcatcctgggggaccttaattgcagcattggtttatgcctggatcaatcatcgatccattttctctgtattagttgggagctaatccatctcatcttgggacttaatttggagcaaagctccaaaaatatattccatgcatggggtattatattattgaattgtgctactgcaaatgaggccatttttctgagcatggaactgaaaccatcatgtagaaggggacctggctcttttatggataccaatggttgatcacatcctacaggtgcccgtgtcacccccggaaatgagggattagctttgctaattaggtgttgcttttggtggtacgacattgttgccgtgcatgcaggtaagcgtcgtggaaatgaatgcgctgagttagtggcatgcatatgcatatgtactgcaaaatgctagtatatatttttgtatatgatgattgttcagttgccaaccaacagttggttgcataaagaacagtacatgatatgacactgacacgcgagattgcagttagattttcggttcgatgggttgtcacagagattccgtttagtttaggcgttgtcaaatgttctagttctaccaacattattccccttttatttgaggtttcaatgtctgaatgtctgaatgcgtgcttcaaaattgcccatgtttgtgccgttgatttggtagaggaattcgcatcggttgtgacgaagaaaacatggtcgagatggttaaaacgacaataggatccggtagccttgatccgtcggtttcatagaaaatgaccacgtggaacttagggaaatacggatcatcctccaacgtctagatcagcagcggctttgcataggattctcatggcgaagagataccttctctgtttctttaccaggtgagaaaaaaataaaggtacataggatccgtgcaagtttcggtcatgcatttgacatgtcagtgagccagtcttacatgtacaaagatgggttttctgcctctaaaaatacagttctatttcgtcagttgcagagatagcagccaatcggactgcaataagacgcctggtcggttgcccaacgggcggtgaagtgaatctcctccatgaaagtatccatgtgatcgaatagaaacagatttgtcgattgggtatttggattctttttaaagatgatatttgaactagtgacagtagtagatagagagtcgaaccaaatttgtgaagtctagatgaaactcaatacagttattacatgcctattctatttcgcactcctggggagtatggctgtatgggtgactgcctagagtgatggcgtacattagacatccaatgttagagactcagaggtcactagatcagtacattggacgaacaggtttcattagcaacttggttagttggtctccatccgaacgtgttgaaatattacagtgaaatatctaaagtagtgaaaacactaatgtttctccaatcctgattgagccacgttatccgttcactatgaatattacattggagtatgcatatgcatgcgttctatataattcaacaaatattaagttcatttccaacgttaacttttaaatcgtatgaatacatataaaaaatttacccctaaactacttttcattgattcggtttttttttcagccttggagcaacgatgacgctgcatgtgatggagggaggacggaaatttcgagcggtagagtcgggtaagattggctaaacctgattgcgacttgctaatacaatatttcttgggtctcgtcttcgtttccttctctttggccgagtcactaacaccagtggcgctaaagtctgcagctgcagagactatggcacactgtcttgggttaaaatatcatggcacctagacacctgtttccaaagttaagatcttaggaagaatccaagatggtttagaaaacgctaattataagaaaaaaaaaccgttctttctagaactcatctgcttgtcctgtgcgatggatcgagatgagatgacggagagtttctgatcgatcgatgtggccctgcatttctggtgaacaccaatggatgcctggcaactctactggagtgcttccaaaatggtgttgacaagaatacgttgattagttcatgtttgctttcttaatcgagatcagatcacagagctttcgatccgttaggtacaaagcatgctgagcataactctatggccgtcatttgaactgaactttaaaactgaacagacagtcagatttgcaatatattcaaccatgccaagttatgctagctctgaattcctattgcttcttcagctgaaaataaatcagatctctctcctgagaaattcagctatcagggacctgcagcatgtaaggctgcgtttgttccttcagtatgatacgtaaaacgaaaagctcatcaacatataattgattaaatattaattataacaaacttaaaaatttatttgattattcaaaaagttatatagatttttttaaaatatattgttttatagtttaaaaacgtgttaacaggaaacgagaaaattatactacggagttgaaaaaaaagaacatgcactaaatcctccttattccaatataaatctaatcgtatgcattcaaaactacatttcagtttttgtattttgtagtttctatcagcattggattctgctaaagtgctataaatcggcagcccccttccgatttccgccgtccatttcatttttacccaaagaaacaaaaaaaagtacaaacagaaattcttaaaaaaaaacccagcaaataacacgtcattaaacggaaactaatccgttacatgacgtgggccccacccagccgcgccagcccacctattcgttcggcttctcccccgcccccgccgcccgcctcgttcgcttctctcttccccttccttccattccagctagcaaccgcaagtccgcaacgcgagaaacgcaggcagcaaagcaagcgaacccaaagctggcctcgcactcacactgacagccttgctctcctcctccccctatatctctcctccctccctcgccgcctcctccccaatcctccaaaccctaatcccccacctcactctctctcgatctcgtgctctcctcctttcgcgagcgcgttctttggaggggagatggcggaggagccacagccagaggccgcgcccgccgcggtggcggcgacgaccgaggtggcggtggcggagaaggcgcccgtggaggcggagaaggagaagaaggtggaggaggagacgccggcggtggaggccgaggcgaaggaggagaagaaggatgaggcggcggcggcggcggcggcgggaggtgatgaggccggggcgatagaggggaccggatcgttcaaggaggagagcaacctggtggcggacttgcctgacccggagaagaaggcgctcgatgagttcaagcagctgatcgccgccgccctcgccgcctgtgagttcaatctgcctccccctccgccgcctcccaaggcgaaggttgaagccgccgttgaggagaccaaggcggaggagaccaaggccgaggaggaacccaaggctgaggagccggccaaggaggaggagcccaaggccgaggtggcggcggcggcggcggcgccgccggaggcaggaaccgaggagccgaaggcggaggcgtcgtccgaagaggccaagaccgaggagccgaaggccgaggcggcggccgacgagccggccaaggaggagtccaaagctgaggcggcgccggctgaggaagccaagccggccgagccggagccggaggagaagaccgtcgtggtcaccgaggaagaggcggccaccaagacggtggaagcgatcgaggaaaccgtcgtgcccgctgctgctgcgcctgctgccgccgccacggaggaagccgcggcgccggaaccggaggtgcaggcggcggcggcgcctgagcccgtgttgatctggggcgtgcccctggtaggcgacgacgagcgcaccgacacggtgctcctcaagttcctgcgcgcgcgcgagttcaaggtgaaggaggccatggcgatgctcaggtcggccgtgctgtggcgcaagcgcttcggcatcgagtccctcctcgacgccgacctcgccctgccggagctcgacagcgtggtgttctaccgcggcgccgaccgcgagggccaccccgtgtgctacaacgtctacggcgaattccaggacaaggacctgtacgagaaggcattcggcgacgaggagaagcgggagcgcttcctcaagtggcgcatccagctgctggagcgcggcatcctgtcgcagctcgacttctcgcccagtggcatctgctccatggttcaggtcacagacctcaagaactcgccacctatgctcggcaagcaccgcgccgtcacccgccaggccgttgctctgctccaggacaactaccccgagttcatcgccaagaaggtactaatgatttcactgccattgattagtgctatttgcgtagctatttctttgcaactgaagcaattttagagtagctatttgtgtttgtaggattcaattcttaattaatgcatttgtagtttaacgttgcaagtgaatgattgggctaaaactttgttctttaggcaatgtgataaaggttggaacttttagggtgtcactgctagctcttttgcaccaattttagtactggcctgagttgactgttgtcttttggcgtgtgctttgttgttaatcatagcgcgagctgggatcttttccttttgttctatctttttctggtacgatcagatgagggagttctgtaaggctgttaatataccaatttgtagttcattccaatagtttcagttaatgaaatgtgatcaaatgtttttggttgggtcatggtgtgcaggtgttcatcaatgtgccatggtggtatctcgctgccaacaaaatgatgagcccgttcctcacgcagcgtaccaagagcaagttcatttttgccagcccagccaaatcagctgagaccctcttcaggttttgcacacagaaaccattgagaatcaatgcttttggtattttcgatcttccaagtttaatttgctcatgtattgctatctaaacgcagatatatcgcaccagagcaagtccctgtccaattcggaggtctcttcaaggaagatgatcctgagttcaccacctcagacgccgttaccgagctcactatcaaaccttcatcgaaagaaaccgttgagattcctgtcactgaggttggtccttgtgtacgtgccaaattacctagaacaatctttagatgcactgatcgctgatactgattatttccctatatatgaaatttgcaacctttgtagaattccacgattggatgggagctccgggtgcttggatgggaggtgagctacggagcagagttcactcctgatgccgagggtggatacacagtcatcgtgcagaaaacgaggaaggtgcctgcaaatgaggaaccaatcatgaaaggcagcttcaaggttggcgagccaggaaagattgtgctaacgatcaacaaccctgcatcaaagaagaagaagctcctctacagatccaaggtcaagagcaccagtgagtccgtttgaggttgcagctgcctgatcaccagattcaccacaatggcagctgaactcattccctgatggaagagaaaccttttggttttggttctttaatttattggttttgctgttttggttcacattttgtatttgtttaattaaaaaccaaagtgagcttgtttttgtgatagttggaaggagagggttgatatgatataatgacatcgtgatggtttgttgagggcagaggacaaaaattgtggaaggactgaagaatatctgctgctttgtatatctgtctgtacattgcatctctggattctcatggacatgttaaatttagaagtacttgtcatcattcaccaatccatgttaccctttatatttctcctcttaatttccttgtctctcagaatctgagggaattatataatcttgatttccattctctaaccttttgcttgcccatttcctgcaagtaaggatcaattgcaaaatgatcatggtttcacttgcaaaatgagaactaccctccatccatttcttttctgtatctcctgttgactgaaaagaaaacatgttttttgacttctcccttttgtaaattacttactgcctgacttgccttaaacgaacaaacagcatgaggacaagatgtgcaggccaagcaggaaagcgattaggcatcttccaggtgtttgtgctgctaatgatggccataaactaagcgtgggtggagcaacatccagaaccttgttccaaggctgtcatcgtgtccctcaaaacaatccgccagcgccaatcagccacaggagaaacagctgttgcagataaacaaggcaaaagaacaatgcagcagtgcaagaaactctctcctctcctcctttgaccacgacagcaaaggaaagaataaaaaaaacatagggccaaaaggcctcatatccagtttggccatgtgcagtgcaagggagctttgaaaaaaattcccttggaggacgagcagaagagagctttcagctttgtgtgtgtgcgcccgggcattccggccagccatttcgacaggtttggttttgagtctcaagtgttgacaccctgtgtgttgccctcttgtctttgcttgaaccaatgagactggctagaggcaaaggtcccatacctgcatggctgcatatggctgtgtttttaatggcgagaggaagaagaagaagacgacctgatgattgatgattagtggtggcaaggcaatggcatcgacatgcaccatttgtcatgtttgacgtttgcgtgcccatttattcagcggccacaggacgtgtctccggttgtaagaaaggttgccagtatcaagatactactaggtagcatcgttttgcttaaatagtatcatatcgtagaatcatatcggaatattatgagattttctttttttacgtttaattaatacttaaattaattgcatatagccattctatataaaaaatatagtaataatatatgtcatgcaaatatagacatttatcaagagaaaccacgttggttttgatatatttaactgatttctatataaacttgagcatatttatttacattatttttaaaccatcttattttaaataatattttgtagtatcgtagggatcgtacaatcgggatatcacctaagatttcgtaggatcgtatagtaatgaatagtaggatcgagatactatgaaatttaggatactatgtgggatcggtatcgttttcacatggtagaatcgtagtatcgtaatatactattataataatcgggatattgaaaaccttgtgtaagtagggactcgcccatatgccagacagacagcaccatgagtttatttcttcctccgtgtcaaccggctgacggctggcctcaacctcacctcgcttgaggagtacttcctcctttcaaaatgtaaagtggcccactttacattttgaaaatgaaacggagtgagtgctactgataggagttgagatgagcacggtggaagcctcagtaattccgtcctcgcgcgcgcgcatgtctgggtccccgccggcggcggcggcggcggcggagatcgctctcgcgtcgtgggctaataaattggaacgcgacagagttgcaacaaggcggtgggaagtgcgcatccatgggggcagttggaacgatacttggaccagtgaccagtccggattgggctcgccgcggtgcagggaccagctatagctaagccagcgacaatctgggggccaccgattaggcgccggtccacggccacggccgtccagactgccgtacgtacaccggactccccctcccgtccccgacgaggacatggtcggtgagacgctaatagtaataacttttgaggtattttgtagtactacgttctcagtgacagtgcatttgagtagcgggttgatgcgtttgcccgtacacggacacagctcgtgcatgcgtgcgtgcgtgctgctcgctcccaactggcgtccgcgcggaccggtcacgccgcacgcgcaaccggggagacggacggacagagcggcaaggcggatctgacacgcgagcacgcgtgaggacggcgcgcgattaaaacggctccgattccttcctccctcctgcgttttttttggtcgttctccgctgctcgtctcgtcctcccgcgcgcgccgcagagggtatcatgtggccgcggactcgcggtcctcctaaccgggcgccgggcgcgtgaggcgacggggtcgcgcacgcatctcgccttgggctgggctgggcttcgcttgcagctcgaacgtgttggtgtgtgctgcggggggtttcgtgactgaggtgtccctgtcgtttctccagttcagctacacgacggatgccgcggctccactcgctggtgctggtcagtccagccaatgcttgcaggattgcggccgtgaatcacgcgcggcgtatcggcaatcaaaagactcgtactcctactctgccacgctgcccgcacgcgtacgcgatccacagcgcggtcggtggcctgagcagtgtaatcgtggatgggattcctccgtaacttggcgatgcaggtaaattaaacctgtgttggttggtgaccccatatcgtgtggctacaaagctgtttggtttatgatttgtgcaggattaggcgtgtctggtttatgcttcgtgctgcagcagcagcagcagcatcggtgcttcgtcagttcaacacaatgcctgacttgtgcaatgtccagagagcatatgagcagatccagtgctatgtcgtctagagattaatgtgctctagtacctttttttccccaagatatgacatgaaagtcacacagactgtttgccagccggtcggctgcgtgcttgcattgcaccacaaacccgtactgttaattgctaacagatgtaaggtgagcagaagccagcaattggcaatctggcatgacaaaggagagcgtcgagttatttcggctgccatcaaacacaagagctaaaaacacagcacatgatgaggataagtgagccacttcatttcaactatcagtagaccaggtacaaccagatacatttgggtacccaaatctgccagccagaccgccaacaagtagcgtgtttcgcattatgcataggtgctaaaggagatgttttcagtgctactcctgctcccaattaggcaaccgcaattaggattagcactccatttggcgaggtataaaggcgagaatataacagctaggaaatgaaagtgaatcgttttgtactccagctccaaagttgtactagtagtgagtgaagaaagaaagcagggaaaggcgaaaacctaaagcataccatgttttcgggaactgcaaaagttctgttcggtgctcgctcgctctccagttcaactcttgcatcctcactgcagattgatcatcatgaccgattgtaaatcctaaatctcctgtcgttaattatgtacctgcagatttgacagtactatattttgtgccagagcaacagaagtaccactcatcgactcaagagctgggttaagttagacagtaaaacaacattctgaaacaggctgaaaaaaactgactcacgattgcccgagaaagtgaggaaacagttgaaacctgaaagcgctgaattctgtatacacaagtagtagtactggagtactctactgaagatgggcatgacttgaaggctgaacctcggattccatttcatggcaacggttgcaaaaccgatgcccactatttgggctattaaccctttttggagccttgtatgagtatacgcgaccaaagtcaccgagattcaggccacgtgtctcggggcaacgagatgctctttcgaaaaccctttacaacgttcggtgttcatccgttgattatccttgcaacgtttaaggttgcagaattaggatatccaatgatctttttttagataatgtggttgattaataaaagaagaagcgacattagtcgcttaatgatgacagttcctgttgaagaaaaataaagggttctctgtccatgggtgttagcagatttcacaagccaaacatattactctttattatctaaaaaaacaagcatattactccggtcatacataagtgacattttagataatgacacaatcatcaatgcacttgttttacaatatagaacttatactacaacaagtatagcaaagttataatattttgaaaatatttttgagacgagtctaaccatattacttttgaatgctgaattgaaatatttaaacagaaattgacaatcaaggtttaaacatattggttgtacgcatttcaaaatgttatttatttgtgaccggagggagtagtaccctaaactgccgctacaccttaataacattgcagaatgccagaaagaaaaaaccctgaagatccaattctcactaaaagcatcggaggacacttcatatcaatatatcatcacgactgcccttcagaatgcacactttgctacttcttgaatcttcttggtttaagctatgttgatagtgtgacagacgagaagaattgagtaggcagctgtttgatgactcagtatagcttgcacataaccacgcacttggtatcaaaatgtgggttggtacttggttagatactactccttgctcttctagaaccttgaacggctactgatacaaaattacagtcctagcactagactacaacattaaccaaactgaagaggcagtacatctcacgtatgctatatctagcccagggcatgagtgacttgggggaaaacgactgtaatgctggcaatgcgatttctactctgcatctataatgaactgcatttctgaaatgatactacaacaataggccgctaaaagaagaataacttatcaggaatcccgtagcaaggagttatttgatggatccaagaatacactaatttcctctgcaaaaagaagaagaatatactaatttcagtttactcctagaaccaaccacaccaaaaagattgacttcacaagtttctgcatatagccaaggtgatccaggtactctgagttgggcaagtaaattcatctatttaatggccagtgtagaaagatttccattttcatatttttaccagaaaggatatgttacaaaattctctgaaaaaaaaactaaaaaaataccaaaacaagtgaacggcacaatcagagtgacaggaactagctatttctaactaatatttcaactaccaactcctcgtttttattgaatttacatagagattgtgatgaagaaacatggtcggtacagaatttgagttttacctgatattctgcccttcgttaaatttaaggatgaagtcagacaaaacactgctgtcgttgcaagagtcccttgtggataaccatctgtcatcaagctgaacttttacatccctgtgctaggagaaagcataagttcatttgctattaggagtgctacctacacttcaagatagacttgataaaagaaactgtaggtaagctctgcagctcagtagggcattaaaccatctatatggcaacaaagaatgaagacattaagtacttataacaatgtaggacaaccagacataagatttgaatattcatgattactgaaaaaagcatacctcttcaagctgagaacttcataatttttccgcaggtaatctgcatgcttaactagagcatcctgggcatagtccttgccaacagttctaactgcagctgtattaagcaaattttccaatgaaccatgtttctttagaagtttcactgcagttttccgaccaaaaccaggaacaaggtgctgtattcctggaataccatctgcttcatcacctatgaagcaccctgtgcagaatagcttcgatgcatcagttagctagatttcctaataatgataaaattaactttacattgtaggataatacataaaatatagacatatactcactgaggctcaaatctgcggttgggtcacacttgtactgtgcaacataatgcctcagcgtataaaaggaccaacggccaatctcaggaatgggcataactaactgaacatcttcagatatcagctgcttgaagtctttatctggtgagccaatgacaactctaaaacctttctgtaaaacttgctctgttaaggtagccactacatcatctgcctcatacccatcgactctgacgacctgaatttgccgtttgcagatttgttcagcgtcagaaactcagagctctacctaagaaaacgttgccgatttctcgattttagtaatctgtatataaaagatctggttcacctaccggaacattgcactcgcgaagaacatcgataacgcgcgaatcggcgcctgtaccagggccacgaggtcggtgcgccttgtaggacggtagcagccgccgccggtactcgttcccgccctccccgtccaaaacctaacacgaagcagagataatttcataagtgactagctgagaggagcatgtaaggacgattccttcgttggggtctgggagtgcgtgctcacggcgacgacggggtcgcggaggctgacgtgcgcgaagaagagcgcgagccagcgcgcgaaggcgccgaggctgcgctgggatccgcggaagcagagagggttgacgtcgaggaagaacacccgaggtttcgcgggcttcgcgggggcgccgtccctgcccaccagctgcttgcgggaatgcctcgctggaggcggcggtgggatggagacggcgaaggtggaaggggaggacgacgaggatacggaggcgtacggggtcacgcggaggcggagcgagcgaggtctacggggcgccgccgccgccgccgatgacgacgacgcgacgaccggagctaccggcgccgtgctcacggcgggaggtggcatcgcgatggcgctcggtttggtgggaagcggagatggggatgtggataaagggggctgaaataaaaaaataaaaaaaaggagagatccaaatattgctgggctttttactaaacttcatctaagttatgggccaaaagcccatttgctaataagctctcaaggccatgatgtatttggcccagtactgcttcctaaatacctacttcttccgtcccaaaatataactacctagtacatgatgagacattatcgtagtactaggtaatgtcccatcacgaatctggagtccagattcgtagtactagataatgtcccatcatgtaataggtagctatattttggaacggagaaagtagtataaacaaggctgagtaagttgagttgagtgagagatgtgcatgtgtgtacaaggaagatcacggcacagcagggatcaagacatgagtgaatttatgtaaataagtccaacagtgtatttacaaacagaaaataatatgtgaataaatcttttatatatgtgttcttagcaatctaaaagtaaaggctgaaaaataaacttcaatgagaaaaccctaaaatcaactacaaatttaaggttaaaaaaatcaaattttgcatgataagcataagcataagcgaaaagatgaagcttttagataaaatgaataagttctctctctaggtccctcaatttatcgtccaatatgatttttttttgtcctcggtctagaaaataggatacaaagcatcttccaacttataaaactgtacaaacgagtttcctcatcagtattgactccggttttagctaacgtggcgcatacatggatcatttgactagtttttcgttgccacgtggcattaacatagtgtttgcatggcaattcaatgcggaaaaataataaaatatgtggggcccacatatcggttacacaaacaaaacaaaaaaacaagtgggcccatgtggccacacatgtcatcatcactacttccctcttctctctatatttctagttttcttttcctttttgttttttcttgcttcttccccgatggcatccggcggctagccgtgagcagcaaagagaagggcggccaatgggagcgccgcgccgccggagtgggagatgtcacgtggaggtcggtgttggtgtcagccatggagcgcgcaagctcggtggcaaagatgaagccgttgtcatcgcggtcaaaggcccttcctgtcaacgatgtcatcgccgctaccgacctcccaaccccctcaccagcctcgccaagaggaggtcgagcgagtggatccgcgacgattaggtgtgaattttttgcgcgtgacgtgtgtgaaaatttctttctagcaatttttcccttcatgcataaatttcaggatgatccgatgatcacaaatctaaaagtttcgagggtaaaaaacttgcgaaagttttctagcaatatatggaccgccataaagtatatgggtcgaaacctttattctcatctctaacctaccccgtcccaaaaaaaaaagactaaccctagtatgtgtccggatttgtttgctaggattgggttttttatgggacggaacagtaaaaactttgcaaccatgtacctctactagtgaaagtattcagagggagacatatcacggcgtgacaaaaccgacaagtattcatgtactatcttttgaaaataactttattcttttagacattgttattatcgtttcccggcttgaatccaaccagtaatacgctgaaatatcctagacttgatttgtggtacagattcactgaacctggactaggttgtctggctagcaacaacagggaaagttcagtgtatctatgacctgtgacagtgaagaccagaagctagacttcttttgatgcttatgctttgccggcaagtctcttttgcccgttttctgtggtaagtaggagtacaaaattctattaatgcttattttacgttacaattccattaattttagtagcgaaaaagattagtcctgataataaacattgtttgatgtaaacccagctggtacagtactgtactactgctaccacctttatcctaaaatatagaatgagactcactattggactatgaatctggatatactttatgtccgtattcatagtcgataggtctcatcgttactatattttgagtcggagggagtatttttgaaaggatccctcctggtacttctgttttcactgaagcggttggtacg

SEQ ID NO: 42040 - DNA, 932 bp, Oryza sativa
tgaatttttcccaaaaatgtaagctgattcatcattcatccaccatatccatggtgtgcaagaatgcaaagcgcagggatgtcccaatctgtgacatgtgcaggcactagcacatcaaacgcaagcttatccaacttaaaaaaaatggacactaactcataatatttttattgagttcttaaaaaaactcataatatcgcaacgaaacccggacgctttacatgtgcatcacgttggaccgccgtgatcttagaaacagggccaaagttcttctgtacagtactaccggtctactccacggtgtcactgtcaccccagaaacctagtaaaagggaagaactgccttgttttagtttagtgctattctaactttgtcatttttgtattaaaaaaattgtcatttttagtagctatagaaagaatttggttattgccagaacttttggcaaaaaaaaaaaaaagattagcccttcgtttcgttactaccaaagctatacgttatagaatcaaataagtcaaataattagcaatgccaatgtcttagctaaccaagcagacggctaatatttggaaattatctatgaatttacctagtttcatcgtccaaaaataacttcgtagcaatacaaagataaaataataagaatgttttctactttgttcataggggtgagggtacgttcgttgtgagtgtctacgttgtactgtgtaattaatacaaagataaaataataagaatgttttctactttgtttataggggtgagggtacgttcgtgtgagtgtctacgttgtactgtgtaattttttttaaaaatatactatattaaaattacaattgatcccactgtatcgagtttaatttatccttcatttttactaacttttttttcttgtcatgtaacaaattttacctgcagtatgtcggaagtc

SEQ ID NO: 42041 - DNA, 13405 bp, Oryza sativa
gaggcggggcaggaggtggaggaggaggaggaggggaggcgtcctcctgctcgtcttcctcctcgtcgctgcacccggcgaagcggcaggcgacggcggagcgcggcgcggatctggaggcccgccgcggcgccgtccgcgcgtggggcaaccaggcgctggcggaggccgacccggacgtgcacgcgctgatggagctcgagcgcgaccgccaggtgcgcgggatcgagctgatcgcgtcggagaacttcgtctgccgcgcggtgctcgaggcgctcggcagccacctcaccaacaagtactctgagggccatcccggggctcggtactatggcgggaaccagcacatcgacggcatcgagcgcctctgccatgagcgcgccctcgccgccttcggtctcgaccccgcctgctggggggtcaacgtccagccatactcctgcacctctgcaaacctagctgtttacacaggtctcctcctgcccaaggaccgtatcatggggctcgagccgccttccggtggccatgtcagccacgggtactacacaccaagtggtaagaaggtgtctggagcatccatattcttcgagagcttgtcgtacaaggtgaatccgcagactgggtatattgattacgacaagcttgaggagcgggcaatggatttccaccctaagattctcatatgtggtgggagctcataccccagggagtgggattttgcacggatgaggctcattgctgataagtgcggtgcggtgctcatgtgcgatatggcacatatcagcgggcttgttgcggccaaggtaaataactaccataaaggatcatttatttatgttgtatgaaatgtagcagaattactcaaatcacgactgaaaagcctagttgttagtatggtttgctgctagctgcccagaaacgtgttgaagaagagtttcaatctttggctaccttcattacctggctatctgttaagtcctgttgatttgaaccattcaacatcacaatgcaagattttctttatcatgtttctaatgtgacgattaggctgatactatagtcctgatgaaactattttgcagtcagttatcaatgtatcgtattcaaactgagtttgagcatagtaatcatagaacatttttatttttagagaacctaaggttacatttctagtcatgttcacataagttaaagataactactacagaattatattttctgtgagtcaacgttgatccatgctagttctgggattttcccctggtgatggaaatcatgctgatgaactaagttactagcacatgttatcgctattaaccacaatattcaaactgagttgatactgtagtcctgaagaaactattttgcagctagttatgtatcatattcaaactgagtttgaacatagtttatcatagaacattttgatctttagggaacctaaggcaggagtaacatttctagtcatgtttacatctgttaaagataactatataactatattttctgcgagtccacatcgattcgtgctagcttatggggttttcccctggtgatggaaatcatgctgatgaactaagttactagcatgtgttatcgttattaaccgcaatatcttatcaatattcattccattaagaaactgcagtctccatgtacgtcttactgctgttttaatattaatacacaatataatattttcaaagcatttttcaatgtcatttttatatggcaacttgagatagtttcacatatatgttatgtcaaactttgagaatgatgactaggttatacatttagaaacatatagaatagcttttgttagaattatccttaatcagtttgttgcatttttcatgtttgcttagatgctacctacacttgctactcttcagaaatgttttatttccttaatgtgtggcatcattgtgtgaagccgggggtctgccccctgaatcaaaataaataactacaaaagttcttagttggttctactgctaaatctagctagttcaatgttcttgatgttcatattgtaatagtgatattgttgcatgctccttactgttgcgagattcttatttatacaagatgctcatactgtggttgctgagcatttattgactactgacagtttatttcttgttaacttttgcaggaatgccgtagtccctttgattactgtgatgtggttacatcaactactcacaagaatctgagaggtcctagaggtggtataatatttttcaggagagggaaaaacttaaggaggcgtactggatctttttctcaagcggatgagaatgattatgacttccaggacaggataaattttgcagttttcccttcaatgcaaggaggaccccataataatcatattgcagccttggcgataactctgaagcaagtagcaacacctgaatacaaagcatacatcatacaagttaagaaaaatgcccaagctttggcatcagccttactcagaagaaaatgcagattggttactggtggcaccgataaccacttggtactttgggacctcagaaatttaggcttgactggtataattctgcctactgttttcttaattaatctgtttgtaaacttgtgatcagggggtgtgttaatttcatagtgggtgcctggaaactgaaatatctctgctatgctaatgtagcttagcacttagtttttggaaaaaaagtctatacgtacttagtttttcttattaaattcttactaactctgacgtgtgtcatgctatgagtacatctagttatgttataacttccatctagataaacgaaacggttgatatcatcgtttgtaagagttttgtaaaaaaaaatccattctttaattgcttaaagtcatgtctctagtactattgctctttgacactttatttctacaatttagatgtggaaatgcatgtggtttctaatgtattgtgttcaaatttttacaggaaagaactttgagaaggtctgtgaggcatgcccatctccataaataagatgccgatatatggggataatggctcaatatctcctgggggtgttcggattggttagtgcatacaccatggctgttttttcttactgttttgtcatttctacataaaacatagactattgtattctacttactgtcatgttacatacaggaacacctgcaatgactactagaggttgcttggaagatgactttggggtgatcgcagatttcctcatcagagccacccaaatagctagtaatcttatgaaagaacatggaaaaatgcagaaggaattcctgagaggcctacagaacaataaagatatcatagaactccgtaaccaggttgagaattttgcatcgcagtttgcaatgccaggttttgatgtatgagtgtgcatgtatgtgtacatatcttggtgaggttgtccagattcatcaggaattagcaaccgtttcactctttgccgaagtgtttctttcaacaggagcagaatagggaaagatcgttttttcttttgttggaaattggtcttgactgaagctgtacatgcatacttctgagttgtcatttatgtaacgtattgaaccttcatataacggctttgtataggagataattttcctccatgcgtaaggatcttaaatctattttgtgtttatgtctagcctgaactgtattgatccagatgttacagggtagttgtgatatcagtagctgacttacgtgcgccctgcctgcatgttgttgttgataaccagaagccctgaacaaccaagacattacagtgagactagtagtaacactatcagtatagcactgacgcattgacaataatggctgtcaagatctgactatttgttgtactggagtactcctactcgctaaacgctgtaagccaagcacagtgcaggttgcatcatggtactcccctgttcgctgtatagggagaaacccatcatgaagatttggtatagctggcatgttaggtaggagtaggagtaggagtagtagcagcctaattccggttgcagctgagatgggttatcatctcctcttttgacccttgcctgccgcctccctcgctcggttttgtttttgcccgtacttgaccattgatacgcttcttttcggccatgatttgcttcgctccggtttgttgccgatccatggacatcacatcggtttgctccgtttttcctccgtgcaaatgatggtgtgcggcgtccgatccatcgatcgatcgcccgatccggggggcttaaggcgaagaaagccacgacacaggtccttttcttcaatgcggagcagaaagcggcgcagcttccagctgccgttccagaacccctttaatcattgcgaccatctgctctgcttcttgggacatcaatccaatcagacaaacaccaaaagccggaggagtagactagcaggtcgcagctgcagtcgcagtgtgtgttgtgttttacactgatggtgttcagttgctcatctctctgactctcaatcactcctcccgaatcccttttatctttctgggtgtgtttagttcacgccaaaattgaaggttggttgaaattgaaatgatgcgacggaaaagttggaagtttgtatgtgtaggaaagttttagtgtgatgaaaaagttggaagtttgaaggagtttgaaactaaactcggcctctgtctagcatctctcctgattagagacaatgaaacattagttaagctttccttttgttgccttttcttttctcattgagggggatataaggaatctaaaccccttttctccccctattcttgttctagtggagtccttaatgatgacttatgaggaagtgagctcgccactaccagtaaagaactgatcactaggtataagggacaaaaacaattgagagagaaaagagggcgagatcttggcatttcacacttccttttaaggtcttctcgtttctcagtatcaagtttcacagtgattgattaatcacctaacctagaaaaagaagttgctgatagcaaatggatgtgtcttagcatagattcatcagtcatcacaagggctttttaaggtttttggttcaagcctatcccaattcatgatagctgacagttctaatatgaacaagagacaattagacatactcacataccatgtcattttagtatctattttaaaatgagagacataataaattactccctcctttataaattgatcatcatataatagaatctaaaatttctcaaattgatcattgtataactatatggacaaggattttataggaatacaattaatgcagtatgagagaacgtgtgcgtgctagggtatactcttaattgacatggagttttaatcgatgcatacattatgagagaatgtatgcataatatctttattgatgtgatttaaattatacttagttttggtgtataaacttatacgatgatcaatttataaaggagaaagtagtatggtagacgtaattctcatgcagatgcttcatgcttcccatgagaaagaaagaatgggactcttgatgctgaagctggaagctacggtctactgggcgtaggagagaaccaaagtttcggccatttttcgcattatggtagaactctgatagtagcccgacctacggcacgtctgcctccccaggcgaacaaacaaaaggcgaccccttccgtcgtgcaactgcaactgcctgtgctactcctgcaatgcaacaagaaagatttcctttctctctcatccccatcatgcctctcctttcatggcacctttcatggcagagacgcagcaacaggatggaaacaacagcagcagcagcaacaacaacatcatgagcaaaatgctgtgacagcgacacactctgtctcatcgagtaccactaactactactcgtactcgctactgaagattatgcttgctactactacgtacagtacgagtactctaccacgcgaagcatgaagcatttcatgccatcatccatggcgatgatgatggtgttgcagtcgatcgatcagtggctgcaaaggtcggagagctccttcctgccctcgacaatgtcgtcgaggaagtcgtcgagctggcagacgaggccgtcggtgccggtccggagcacgtcgagccacgccttgagctcgtcgaccttgtccttgacgccgccgtcgccgtcctcgcactgctgcttgcgggggcccgccgccacggcgcgctccacctcctcgtgcgccgcctccacggcggcgcgcgcgcaccggaactcgtacatccggatgcccccccgcgccgcgccggcgctaccgtcggcgtcggcctcctccgccatcctctgctgcagcattgcgatggacgccacgaacccgccggcgtccgcggcgccatccgcggagcacggccccgctgcggcggcggcgcaggagacggcgccggaggcgaggacgaggagcagcagcgagctggcgttgtgcagcgcgtagagcaggccgcggaagccgttgaagccgctcaacctggcgtccgcggcgcgcagcagcagccgctcgtcgagctgcagcgacagcggcgcgatcctcgcctccgacagcgcacggttctcctcctccgccgccatggcctccctcctcgacgcagagatcgccctcatcacctgcaccgatcaaacaaatctccataaacacaaaaaaacagagcatccaacaaagaacacatagtagcgatcaatcgatcaaacacacaaacagagcaagaaccactaatggcgtgtcgcagcacagaaacaaacacgtttcgcaaccaaccaacctggcgagtggagagaggggaagggtcctggagccagtcatccatggcggccgcagcacaagacgcggcagcgcaataccgctcgacggcggcaaggccgaccttgacggcgaggcaagcctcccagagccgcgcggtctcgtccatgtactcgtcgagccaccgcccaccgggcggcaggtggagctgccccaccagcagcgtgagctgcgagtgcagccccctgagcagcgccgccgcccgcagcagcgccggcagcgacgacagcccgccgccgctgctcaggtcgtccagccctctcgccagcgacgtgaagaaggcgttcatggcgaaatccccacagcaagaaagatcgaacaccggtcgatcgatgcgtctggaaggtcgagctccggctggctatatatagcgcgcggtgcaagaagggcaaggaggagacgatcggggaggaggaggaggaggcggggggcgtggaggggcaatgatgggtgtctagacgagggggagaagggtgatgatgaggttggggggaggcagaggcacagccatggctgatgtctcgctcgctcgctcgctgctgctcgctgtgctgtgtcggtgctctggtctggtctgtggctccgcgcgcggcgtacgagcggggcgcgtttaatggctgcctcctcgcgacaccgcgcgttgccgggtttccggaggaggttaggcttaaccgccgtctttcttcggtttcactgcggatgttgtgggaaacaattttaatttctagagggcatcctcgtatttttaaaacacaacagaaacataggtaatcataaaacacgcatactcatcgctataaataaacacgcacacaatacatctataaacattttttaaaaaagttactgtatatacgattatgtagcgttacacaaccaaatcccatggtattttctagccgtttctaacgaagtaacacgtgacattcactatctgttagcaatcgtataattatcgtacatataaatcgtatacatagcattttcgatttttgaaacactagaccgacatatcctcgtcaatcatgaacgtctcactatcgatgattacgtcgcctgcaccgaaagaatatcacccatcttaagcctagaactttaatgggtgatttggttccgtcacaagaaaactaactagttaaactacgtttagttcgctagttatttacatattatcaaaataattaggaaaagtataaaaatttaacgagatcaaactccataagcctacaatattaatcaagttaaattttagagtggcatatcacatattaatatatcttgtcagttttaaaaaatattttataatgcaaacataatgttactagtagagttcaagatccattccccatgtgtttttagccatttctagcgcgtaccgcaggggggcgttggtgggggaggttgttgctccatggggtggcccgcctacggtaggggggaaaaacatacctaccagattatcagcttttggtgaaatttctccaccggaatattgcgctttctgcatagttcagcggtcaaaatggcatggcatggaacgtccagtccttgactacggaaacaaaacaatcgagcactagaaacagtcttggagagggacttggtcgtgtgtggtttgtatggttcactgaacttggagagtatagtagtagtagacttttttttttggcattgaatatttgcaaatagttcagctgctctagcgatgccattgagtggttatgttggctaaaatgtcaaaccaactgcacattgtagccacctctagttacagttaccaaggattctctcatccatcctttagatttttttgttattctttcaacatttgttcatttaaaaatttgaaaataaatcgtccataccaaccaaatttaaggccaaatgtcatgccaaagaatttttgtagcgcaaaaagccaagatgtggcgatggtgatttactatactattgtggagtaaccaaatcattaccacaccatagtttttaacccatgtggtaacattgtcttgtcatgccactaaatattgtcactttgattatgttgccacctactgacttgactcttagcatctgcagccccatcgtttggctttttccctataaaaataaatttatattttatatatgtgttattggtggcctaaaagctaatactgaaaaagaaactataataaaaaaaatctcaaaattaagtttaaaaatttaaaaattgcctttttttggctgattaggccatccgataggagcctatttgttggtttgcgcagccaagatttaaattttaaacttaattttaagttgaatttgggatgttttctatcattgtctatttttcaataccgtcttttagtctgtgaataacataatttttatctataaatcatttctgattgcttcgttcatacttctataacaaccaatggcatggaccaggataacaaataagcaaaagccactatatgaagcggcaaaatagaaatatcctttttaacattatacaaaaacatcaattttttttaaaaaggctcttttccatagaggaaaaatatattattgctgtgaggaatatagagttttcagttctctcagtaaaaaaaactgtttttctatagcttggtaggattaacttattttagccacagggacagatatgatgagtgatggtgcaatttaattaatgagttaattttactttgggctatgttttattgccaaagttttattttggaccaccatttatctaatcttttcactttggactaggtaactttacctttgtcgcataatggaccaccccaaaacacattttcatttcttcgatgacttcgagcaaattgttaacgacataccagcaaactttcatatctatatgcatgatatactttgtcgaaagagacgctagacatcacaagcgaaaagagttagggttgtccattgtgcaacaaagataaagttaactagttcaaagtgaaaagattacgtacagggtggtacaaaataaaactttgataataaagtacaattcagtcttaatcttatttgtcacaacaacgcagatagtacaaagtagaggcaacttgttctgcttgcgaattgtgaactgcatcagtattctgcctggtactacaaatatcatcagaaaaagcagtttcctttttgtaggttgtggatcacgctccgacaacacagcgtagggttaaattaagctatgcgatatttagtaccatcaatcccatcagtccatttgacatcccaagcatgcgttattcgattcaatcttatacctccctttcctccccctttattccctttccaactcagagatgcaaatcttatcctgccaaagccactacatatcatagctcactcgaattctcttctacagttcatcccaactcccattagcaaggagctaaagatcttcactacttttacaccaacgaaaaacaattatactcattctgtatcttcagacaagatcacaagagtccagagacatctagtcgaaattattgcaatacacgaacagttacctaggtaaggctattttgtacttttatagaattccagtagaaaacatcctgagctttaaatcatgcactattctcctgtttattcgggttgtcaaattgaccccttttttgtttcccctcctttacatgaacagtggctaatacttcctccgtctcagattacaagacgttttaactttagtcaaagtcgatcaaattgtttcaagtttgattaagtttataaataaatatagtaatatttataatactaaattagtttcatcaaatcaataattaaatatattttcataataaatttgtcttgagttgaaaatgttactatttttttctataaatttgattaagtttaaagcagtttgattttgaccaaactcaaaacttcttataacatgaaatggagcgagtagcaaattaactggcgccattgtgtggcatgatttcagcgttgtctgcttgccatttggccgtctcagtaagtttcagacgaagagttaactgtcagggctagtgtactcagatcaccactccctgctcagagagggacaattacccgacatgcatgggattagcatggttttcggtctgagcagcgaacttcttgtgatgcgcctttgcgcctttgtgttcccatcttgtcaagcactgaaagatgatcaatcctaatcctgctctttgtgcgcgtaaagcctgtggagacacggcaaaacagcctcgtcgagcagggacatgaatgatgataccagccatggaaggtggtcatggcagctcccaagcaagaggacaaaaacggaaggctttttcttcagaaatgagaactctgaactctgaatgtctgaatggaacttctttgtatgctgcataatttcttttggaaacatctgaaagcagggttgtggttaattaaaaaaccggtctactagaccatgaacatggaacaggagcccctagctactatgcttaccgtaaacgcatgcaagaaacacttttgtattgtcacctgctgtaatgagacatctttgcaataactacagcaatttgagctaaaattggtcaacactatcatgcttagggtccccaaattaaactgcacttttgactaagaattggcagaagctagcggcagcaaattgttcctttccattggacatattccccaactcattatttaacgacgcttttccattccacttgatacgctagaagaaccgtgtggtttatcatatctgcaaaccaaacggatgcaatcgctaatcacatggataaatcttcgcaaaagggagagatttcgggtgtgtgcgtgcgcatgcgttgttagagctgctactcgtgggatcttggagaatgtgatgcttgtagaaagaaacagttaaggggtataaacaaatgctggagaagcaaacaggatcctaaaccgtgatctcgcgtaatctaatcacggtctattgtatcgccaacatgtgataggtgtctagaagcttgcattttaatactaccggcaaagcttgatttgcctctgctaatgtgatccaaacatgataaaccggttttgtatccatccctgaattaggtattctcttgccttctgacagtgtgatccaaacatgattatccggtctgtatccatccccgaattaggtactgtcaaatacagtgaatacactattgtcatgtgtatgcattctgaatataaaatagcccaaaatgtcatgtgtgaccaagttttttatgaagaacacatgagcaaatcagcgtgcattatacagtggagtacacttaatcctgcatttattttgtttgctaaggagacagggagacgatggagttggaaggcatgagatttgcgctgcaccaacccacatggatgaaggattcaagggggacaaagactgctgctgagcctcttgagtgagtcccatcatggtcactcatggcagtaattatggccgcaattatgcctgcccaaaagcccacagggcgggcagggccaaatgcaagtatgcaaccgaccctaatggaggggattagcaataatttcctcgtttgatgcttttgaccaccgatgatatcagcactaatcacaggggtggattgtacacaacacactacacaaaggccaaagggatccatgcatgatggtgctgcgtttgtagggcactcggcctagacagaacccccgaaaaggctgcaaaatctgctgcagctgcaatgtgagctgagagtgaggccgatcgagctcgagctcgagctcgagctctcctctccccttcgattctttttggacagtgcgtgagctaatggccccggcctaagctctcctctccccttcgattctttttggacagtgcgtgagctaatggccccggcctaattcaatagggccagtatttaatagtacgggcagtctctttttccctgcagggcttgtcttggccggtgggtaacacaatctcagaatcagtactgctaatgatccgcttggtttttaataccgctacaactactagcactactattcctagttgcagaacggagagttgagctaggctgtaaagatcgcggagcacgagtaattcttgcttggatgcatggacagatggatgcgtgtgtgcatgggtgcagctgcagtggcgccgtcatcatgtggttcaatattggggcgagcgaaatctatcatttgtcgggccgacacgccagcatggacggatcgacggacgctggctggtctcagccgttgctcctgcagcctccgcgtcgacggggcggaggaagacgagaacgagacagcgagtgtgtgcgcagccagccggccaggcaaggcatgattcggtccggtctggctggctccgatcggcagcgcgcgcgcgcggcgctgtcaaccatgtggcgctgcgcctcgcggggaaacgacacggcgcgcgcgcgcgctgcgtgacgcgttcgtttcggttgcatgcgaatcgcggggcggatcgatcgtgccggatttgagtcatttggcgggggggggggggggggggg

SEQ ID NO: 42042 - DNA, 8714 bp, Oryza sativa
gggggggttggggtgctggttatggctgcccgctcggcgccggcgttggtggattcctcgtgtgcttctttcggattgatcgatcttgttggctgcccgctcgggaaatggcttggtgcgtttgcgtcaggagtggtcgccggctcggccgggtgggtcgatcgagttgtaggggccgccggccgcagcatcacatgctcgcctgctgctttgctttcatctgctgcgcagaggtaaaggggttattagtgaacggacaagatctacaagttttcagtcatgccggcacggactttccatcgggcctggtccagtaaaaaaccaaaaaaccgcgggcctaaccgcctaagtcatgtatgcaatcgttgtgtgggctagaaccaaactcctgcgctttcgaagcccaataccaaccgaatagcagcgacgacgtaacgcggcccgtacgcatgcggtccgctctcacagtcacagcgtacgcgagcggagcacctcgcggcgcggcccaaaccaaccaagtgcacgttctgcctgcgtcgcgtctcctacacgttgccccagctgtagattggcggcccacacgcaaccggcggccgattcggtgtcacccgccagttcgccaccgaggaggcgtcacgagttgcaatgaacgatgcaatggatgttgacgttgcaggctcagaagatgcaacgagttttgaagttttccggtcgcgttgcagctgctccggctttgctgacgcttttcttttgctactcgcctgatgatagaaccttataggttgacaacaacgagagcgaaacaaggtgcattgttgtcggttgtccgcttccggttgtctacgacgaacaggcgctgaaccgtggtggattcatcaacacgactacagtaccatctcacttcccttacgcactgcacagtggactctgccggcgctctctcgcaaagctggactttgcaacagtcgcaaactcgagtacaaatctggacttcagctggtgcaccgctgccgctagatctgtgaatgcaagtctgcaaccacaacactttaaggccctagctatcggtctgaaacagagagacgctcattcaactataccctgttactattactatatgtctcaactctcaaacttgcgtaaacttatcaaggatgtgcccacaggtgaacaggccacagtctacagattcttgtctttgtccggttaacaggccccgtatcacaaacgggtcccggtggggacaccgccgcagccgtcgatgggagcggatgaacggctaaaatgcatcgtgatccggatctcggccgggaccgctgctgctgctgcgagagttgtagtaaaatccagcggtcaggagctcaagaagcgaaatacccgggcagcattcaattccgctgtacgcccgcttggcagcgccgctgctgcaccaccccgcatccatccgctgcggccacgagactcggtggcattgcttgctggctcgcgcgcagatctggtccggtacgacgcgtgcacggtggtgggggcgacgcgtctgcacggtcgcgcgggctcccccaccacgacgcgcgcccgcgcccctgcccgatcgagcgccgggacggggacggagacgcgattggctcgtacgcgcgcggggggcatgcgtgtgcccggcgccccggcgcgcacggacgcggagacgcaacattttgtcccggggttcgggacgtgacgtgctccaccgatcggggttcttgtcgctgaatatcggtgaagtgtcggctcggttggagacgagtagccccggtgtcgagttactgttcctctctttggatttactctactggctatatataccgtgttggctgtttacccgccggtaattggaggtttgctacgatgcgtacaactactcaagcgagtaaaaacaaattcttttaccagtggctgcatccatggttgcactgcatcaaacgttcgtgcataaagctgagctcaaatcattacgtactccctccattcaaaattgatctacatatttcataggtacactaagaccaaaaaaactaataactctctcatactatatttattctagcaacaaactctatgcaccatccctactattttcctagacaatagcaaatcaatatattgcatgtgttataaatacttataaatacttgtgtgcatagatgcatgtatcaatgttcatttactccaatgcacaaataacgaatagacttaatgaatgaacacaaatatatagatcatttagtaataacctcaaaaaaaactatatgtagatcaatttggaatggagggagtagtatgtaccgctgtgaaactgtgaccactcctcatcccgagaggcgagagtcacggtcatcgtagggtacaaaaccacaaatcacgatgaaaaatgcgtgtgcatgtccgatgaaaaggaaagaaggaaaaaagaacgaaaatgatatacatatgaccctgttgtccggctactgtgtatgactctggtcacatggaaagacacagacggtaaaagtctcactccgtaatagaatctgacatacgtagtgatgccataacggagtcggacgctagtcgaacgctggattcgtatgtatagcagcgttcaacaaagaaatgcgtgtgcacgttcgattttaatcagcgaattattggtgtggaatttccgtgcctgaaacatgggcacgcatctgttaaataattaatcgactctcgggctcaccgctcacgcgaatgcaatcaagcgccaggtgattaacaccgtacaggggcagttagcacagcggagtacgtcacgattttaattcagggcttaaatgaggttctgactgccagcgtggaatagtactccgtgcttgtgagttttgacgtggagatggaagcttcacaagctagccttcgattgcttgtgcctggaagagaaaaaacaatttcagggccctttgaatcgtaggaatgaaaaaacagaggaataggaaaaacacaggattctgataggaatacaattgtaaaacagaggattgcaaaacacaggaaaaacacaggaatggcagtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggattttttttcataggattgaaatcctccaaaattcctacatttttcctacaaatcaaagtggcctcattttttggccttcaacctcacaagagccacagttacgtgacatttcctgcccactctctgccttgatttgatgttttattcgttcttggccttttcttaatagtactagaaacggttcctttaatggagtagtatagggtgtgttcagttgacgctaaaattagaagttttgttgaaattgaaacgatgtgacgaaaaaattaaaaatttatatgtttagaaaagttttgatgtgataaaaaaaattaaaagtttgaagaaatagtttgtaactaaactcggccacagccgatcgatcaaacaaggatctcgtgtagtagtgttgaatctaattatacattctatacacgccaagtaggaatattgtatagtgtagatccacggctcaataatgtctccatacacatatataaaaatcgattagtagtactaggtgcaacgaatttccacggcgcaacatttacacctgatgttcatttgtaacattttcccggtccacagagcagtaaaaactcaggctatgcacttcatggcttctttatttccttgctccatttgggttgccctcgcagcaaaaccggcaagtagcaacagtaacctagacgagagcagcatgtctccctgtaataaattctgcaagcaaactaagcacaatatgggctctctcgcagtagatgagctctgtggcttgcatgcagtagtatatttgccaattgcaatgcaagcctgcccatggcatgcgatcatcttgtgcagatgacacaaacaatatcaggtcgcccttgaagcaattgcgtgtactaaaaaatggcaaggctgttccgtcgaggagcgaggaatacgtaagaatctactcctacgtacccagctgccatgctgctgcagccatgcagagcaacagaggggctagttgtctcgtccatccatattcactgagcggccatgaagtactattcacttctcacgataaattacacagaccgtagagatatgcgtgttcatccagctagccttgcgtgcgtgagaattgtcagagacatatagtagtactattaagttatttaagtgtgtttttaggtgttaataacttgcagactggtcccaggaaatctatatggttttagggtgtgtcttagcagtattgaaaacagtgcgcttcttcttcttctcttcttggctgaccctaagctagcttcaaaaacaaaacagtggaaaggggcagtagggctagcatagcacatgcatgtataaaaacaggagtttaatttgtatcattttccaaaggaaaaaaatgcatttggaatgcttacggtgcatgatacgtatatgtggatgtcctgccaagaatcccgcacattacgattgatgccgtattgaccaatccatctcttggtttttggagctaacaataatgccaacgaaaaccggcagattctttttgcgcgcccgggcatgcacgaaacatatccgtaagcatgtgaaagggtatagtataggccaccggatcaacaacagtagatagtacacatacgtatatacgtcgattcgattattactgtggcattaatttaccacttcagcctcagtgtactgcaacagtgagtaaaaataatctcttcacactgagatgatcaaaggcccaagattaattaataaacacgagcatatgcactttgaggatttgaaaagtctggattttcagtttgttttccttctagttcattatttggatataattatgggctctttgaatctaagtaagaatatactagctagtagattatttaggttgtgttcttttattgaagttaccaactcaacaactctcgcctttcttgtacacgctttttaaactactaaacggtgtgtgtttttataaaaaaaaaatacgtaaattgcttttaaaaaatcatattaatctattcttaaaaataactaatacttaattaattatgcactaatgagtcggtccgttttaacgtgcatgaaagattagttcccaacgccttaaaacgaatacagccttaaagagctaaaattctaggagaatttgaggctgccagagcctagaatccctctggacacggcctatgtacttcaggaacatatcctatcctatatgtacacaagcattctcgtgcacactaactaataaattcccaaaaattctttaaaaaacacatatgtatttttatagtattacatctacgtgtaaagtttcatctttaaattcatcatacataaaatagacttatagtcttaaaattgtcagtttttcttaggactaaaatataataaatttaatgttaacatattttacacgtaagtataatattattgaaagtatatgcacatatttttctaaatttttcgataatatttattagttgatgtacgcgtgaagcttatgtatacatgatatattatcgtgtcactctgcacagatatgcagcagtactcttttgtctgcattaagtttttttctgcacgtatatactactccctccgtttcaaaatgtttgacgccattgacattttagtacatgtttgaccgttcgtcttatttaaaaaaattaagtaattattaattcttttcctatcatttgattcattgttaaatatatttttatgtaggcatatgattttacatatttcataaaagtttttgaataagacgaatggtcaaatatgtgctaaaaagtcaacggtgtcaaacatttcgaaacggagggagtataccactaggagattactgtgccgagctagaaccttaaagatgagctagagtaagtaatcagtggaggagtattcactaatcagctagcacgggtgcaacacgctctcgtgaccacccccccatcccctctccttggctcccactctttaagcggcccttgtcctttcagctcctcggtccctccccctccatctcactcccttatatcgctcgctcactcgctagctcgcaccgcgccggccgggagcacgcacgcacgcattgccatcgccgtgcgcggaggaggagaggagatcgaggtctcgaggtcgttggttggttggttgcatggcgagcggtggcggggagcacttcttgcggcagctgagcgcgagcaacgggggatacggtggtgcggcgcagtatcagatggggcgaggggtggtggcggaggaggaggtggagctcggcggaggaggcaggaggaggggctcgaagcggtggtcgaagaagagggcggggaggggcgggtacggcggcggcggcggggggaagggggacgcggccgcggccgcggcggcggcggcggcggtggccgggaggaagcgggtgatggtggtggtggacgacacctccggggccaagcacgccatgatgtgggcgctcacccacgtcgccaacaagggggacttcctcacgctgctccacgtcctcccgtacgccggcgccggcagaggcgaggagaccccctccctcgccaactccctcggcacgctctgcaaggcctgcaggccagaggtagcgtatacgcgtatacgtacatcatacgtgcatgatgtttctttttttttctttattttttttagagggatgcatgtcattttgtgtgctgtttttacttttgtgctctaatatgtgttttcaaattacaaaattttaggcgcttcgattagagaatcatgtgtctgatctctgctgtctagctttggtcattctggatttggaagcatctgcttggaggcaatgcacgagggaattattactgctagctcacaaagaattagaaaaaaaagcttttgttagtgtactggctcatgagaacttgactaaactgaaggataaaaataaagtataatttactgtacggtttgtagagttatcaatcctgaaggtcacctgagagggatagttgtaaagtattatttgttgggggacatcatacagtagatcagatcagatatcagaacatacatgaaaaggggatcgtattccacttttcatggatgaacggatcttgcatcttggcaggccaaaaaggttcgagtctttgataaaagttaaaaagtactacctccgttccataataagtgcataagtgcagctccgttccataataagtgcagccataagtttccgcgctcaactttaatcgtccgttttatttgaattttttttataattagcatttttgttgttatgagatgataaaacatgaatagtactttacttgtgacttatgtttttaaattttttcaaaaattttttaataagacgaacggtcaaagttgggcgcggaaaaccatggctacacttattttgggacggaggaagtaattagaaaagaacaatttgtggggctcatgctcatcccaggttctaaaaccattagtaaaatgcatcagtaaaatcctacctaaaccggccgtaaacaatggcattatgagatcatatcatcattccttccttgatttgcttgcattgcttgaatcaaaagtcagcacttcaatgtagtagtgtactactagtagtacatccctgcgtaagagcaacagtaccgtgcatgaagccatgaactattcctttgtcctactatagcatgtgcaaaggagggctcatacgaaatgggtgtgaatgtggtaggtggaggttgaagcacttgtgatccaaggaccaaagctggccactgtcctcagccaagtgaagaaattggaggcgtctgtgcttgtgctcagccaatccaagccatcccatttctgttggttgagttggtaagcatttctcacctcctaccactgtagctctatctttctcatccctattggatgtgttaaaaatgtgaggctcaggtcaactatgaatggaaactggcggggagaatatagtatcatggtgtcagtcagtccctagtgttattttaaaacaatgcccagattaatgcatatggctaggttccaatagaaacctttagttgtacatcattttttatatcgtacaagtatcagtttatcaggatacataattaccactagatctaaatttatggggagagatctggtcatcttttatgataagcaggcccactaacaagcaatgagtaaactgtttgggaaataatcctccttcaccaccgttcaatagcagggtcccctgcctttcgggaaaataacaccaggcagcagcctccatgtgctatccataaatcacagatgctttccttgtccttttttggtcacaactcaaccaaatgaaagcaagactcctacacttcactcacctaatttttgctacgttcacgtggacaatgtaacaatcaccatcaccaacacattgaagttgagtcaggaaaagttactttcatcttgtcgtaaactatagctatggtccttgttgagcaaatgcaaat

SEQ ID NO: 42043 - DNA, 6993 bp, Oryza sativa
  unsure (1)..(6993): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttttagatacttaaataaatgaagtggggttagtaattaattaaatgggccattatatatggacaaaaagaagagggcgagatctcatcaaaataaacccatacagctcatctggaaaggcatgtactatccacagaagacttggttttcatcatatattatacctgtatatacaagggcatctctctttatgtactcattctgattgtttaacacaaggctgagaaaatttgatacacttggaccttgcatttcaatctcatcaatcccatgcacatcctctcagaatttgagcaagaccgtcgcgttgctcgtcagtaagctgcttcgggaacgcgatctcaaacttcacccttagatcaccccgtgctcctttctgatcggcaattggcatcccttcccctttgatgatcttctcatatcctgggcagatgatctcatcctgaaatgagcagctcaccttcttgccactcaggagcctgaatgagaaggaccagccggtgagcgcgctcaccaatggcacctcggctttcagcaccaggtcgttgcctaccctcttgaagacagggtgtttcttctccgatatgacgaagacggcatcggccggtaggcaccctggcctctcatcccccatgccttcaaatgtgatcttgttccctttcttccaccctggtttcaccagcaccatctggctcacctccttcttgactattgacctgtccaagattgtaaatccattgaaggtgattagtccagcaacactgaaagagagaatccaaggaggaaaggtgcttaatagtcactgtcactgaaccttcctagactaccaccaccatcaacatgcaaaagaaaatgtggatagtgcttattgcccaaatggtccactttgctagatgctagatccaaaactactgtattctaagccctcgacaaacacgtatacgcataagtggcaacgaaagcaacttgagttgagattttatctcctcaagattggatcttaacatgtactaaaccctgatcaacactgctgttattatgctttgtgttaggtaggataatgttgcaagaataggatagataccccggaagagaaaaggtacacaccaaagggaacttgtgtaaaaaggttttcatgtgttccaaagtaagctaaatattccactgacaaatgcaggctataataaagcagtcaccctccactgtaaaaaagaagtgcgccatagcctggaaaggaaggaagtggtcgtgctgtttcactgttcatggatcattttgttccgaacagtgcagagaattggggaggcacaaagcggaatggatgtcgccatcagaacaaattctgaattcttgcctactctgaagtttccaagcatcgatccattaaaattggcatgcaagtgagcgaatcacatcagggttgttccggttgcatcgaattgttagttttaaaagaggaaaatggatggatggatgacaagcgattgctcgccagaattcaggtgaaagctccaatcaatcttggctcacggattaggtggaggaagaaaggggtatacccgttcttggtgacgacgtcgcgggtgaacttgacctccttcttgcagccgtggcagagctcctcgagggtgcagtcgagcttgcgctccagcggcggcgccttgcgcatgattgagctggagaactcggcgaacgcgcgccgcccgccggagttgccggagctgtacaccttcttgaactccctcgccggcgtgccgggcgccatcctcgcgccgaagtcgtcgctgcgcgtcctcgcgatgtgtgcccctccgccgccgaccacgccgcacgccatggccttctcgcccgcgcggccgtcgttgcagcacaccccgaacaccgccctgttctcctgctggtcaaggagcgcctgcgcaaccaagaatcgcccaacatcacgacacgacgccgtcgcaatctacagccaacgcacgcacgcaacgcacggctaggggctcacctcgtaggcctcggtgatggccttgaagcgggcctcggcctcgggcttggaggacggcgggtgcttgtcggggtgccatttcttgacgaggctcttgtaggcggcgcggatttcctgcggcgaggtctccctggggatgttgaggatgcggtggtacagctcgggagggttccccattggagagggaagagaagacacggtggatggatggatcggtggtggtcgcggaggaggaagaagaagaagaagaagaagaagagcaagggaggggagcgaaatgaggagtttgttacggagggaggtggttaagcggcagaggagaaacacagcgagtgtggctgtgtgggtgagtgagtgagtgagagagaagagtggcttttatgtaggggcatttatttgaactggtgtttagagagagggagggaaaaaattgcatgtggggacatagcggcatgaggggtgaattggcaatggacaaggactggagtggagtggactgcctaccatctacttctccagtggaggagaaaaagaattttgatggttacaaccctataaaaaaattcaattctgagcattatttgaataagtgcatgtctatttcgtaattaggattgtgtttttttttacaaaaagagtatgttctaagctatgggctacaagaaataaaaaattagcagattcattagtttgtttagttacaaaaattggaatacacaaactgatctaggggtactactagtactacaaatataattttagaaccaaatccatcattaacggatttttgccgtaagacggaatcgtaaaaagccgtcgtaatgttttttataatatatagtcctgaagaaaggtgccaactacagagggagaaggcgccaaagacttactgcgtgtacggccgacgagagctggagtgttctgtgtgttgcagtagtgcatgattacaagatggttttatctgatggaggtgaatgattggggaataagaacggcacggttagcaattattgccttgtccgtaccggcccaaatgaaaatgctttgctcgtgcatatgatgtgtgtgtgtgtgtctctacttgatccccccattcagatcaagtggctctcctcgcactgtgctgcctgtcagcctatcacgctggctgagtcaccacaacacatataaaattttctttgtacactatcagacagattgtcatataaaattatatgagctactacgcgtactcgattggattttagaaactgcgagcggggcacgtacgcttctagtcaatggccatgcaaacgccttggattcttctgttcccgagcgcgtcgtctcgtcacggccgtgtgcgcatgtgcgaagctggtggtggagatggcgatcgatcggtcggtcgatggccatcgccacctggtccatctctgtgcagacgcgacgccacgtatacggacgtgtaggcgggtacacatacacgtaccgatcttgatcgtccgggccgatggaaattgaatgagcacgttgtgtagtaagggtggcaacaaaatttgccagcggtgcgtacgtattctgtcgcagggtctggagccaaggtgcgtgacgaactgaccaccagtggccactggggcgttggacatgctgtagttgttggtgtagtggtagttgcagtaacttcttcggatctggagcgatgcgatctcacgtggtagattaattttggagttggttgtaaacttgtagtaaaaaatatactgatctctcgattgatggggtgattgcgaggatgcctgcgatcgacgaacacgtgcagtacagtagagggaaaccgaaaaccggatcgattcgcgattcgagggacaaactgtccgttattagcttctcgaatctcgattggggtgggtgatcaggatcaggattcaggatgcaatccccggcgaattaacaagccgccacgagcatatggtgaaccccccaccgaatcgtccgtgcggcgggcgccgcagcgcgagcccaaagatgtttgtcccacgtactactacgtagtgtaatacagtcgcacacgccgcgctccgcaccgcacaccgggttcgtcctgcggacaccgcgcggggcgagacgttttgcgccccccgcttgcgcgcgcgagattcgcccaatccatcgcggcccggcgggttgtgtgggcttgtgagagcacggcgatccccgcgtttgccgtcgcgcgctgcggctgcctcgcgggcctggatgtgggaaaaggctatacgtactaactttttcttattaaattcttactaacactgatctgtttgtaattttatctacttaattgctcatggatgtgttacgcatcgggtggatttcaccacgtacgcgcggggtgcgcgcgggtggcggctaggctcggcgcgcgcgaggagccacaggtaggtcgcgcgtacgcggcggttgctcgtccacgctgtgtcgcgatctttgtcacgtactacgtctcggctcggcgccgctagtttgggtcggttccgttctgttcgatgggctatcctcgtttctcgtttctcatgttcccttcccggagcgtaattggacatgtggcatcgaaacaaaccccgatccgtaactcatggaagccaatgccgaacagaacggacgtagtaaacgatccgtaactcaaccggacgtagtaaacgatcgcagttacaatactttgacgcgcccgatctacctgccaagaaatccttgtacatatatacagagatcgagcaaggagggtaccaggagactcactcactccactatgttcagtagtaatcgcctcactagggacagtcacgtgaaggtccaagaagccataacgttgcttgcagttggggggtcacttttggccgacaatcctgccgaattaagaccatattactacccaacgattcaatgcaacgcattccttggaaaataaatcatcggctagctcacgctagcttcacccagcaaagcagacatccacaacaaacctacagaaaacagaaatgagtcaatcataccagaaagactattcgacaggggtagtagtagcgacgaagtgacagcgagagaggctgcaacatgggcgtccctgtggctgagtgaaacatgaaaggtgaactggtttgacccccatatgacaagtctaaatcagatcaacatttttagataatgaaaatggattacatctacggcttctgttataagacacacagctataagtttaatagtaataaaaatataagataaaagtaaatcaaaatgagaaataaggtgataggacaaatccccaactcccctttaattattgactagcgtgaaccacataaaatattttagctagcaattcttatggaactacgccacccatagtggaataagagacccttggctaccgattccaagagtgtagcaccattgcgcatagtatcctgctcctcctgtagtagcattgtagaccaaaagtggagccagtaggaagacatgaagataacctgcatagggttagataattgtttaccattaaaaactttatcattgcgacaacgccaaattgaccaacatacagcactagctccaattacaatcatcttcttaatggacctagatacccctctaagccaattaccgaaaatgtttctggcgttacggggtgggggatattaaaagcaaaaaacacacatctccaaacaaactgagcgacatgacactcaaagaaaagatgttggattgtctcttgtgcatagcagaaagaacaatgtttgtctccccccattttcttttagccaggttatctttcgttagaattactttctcgtgaagaaaccacataaagaccttgatctttagtggaattttcaagtcccacagaattctctttttgatccgaacattacagttcatgattgcggtatacatagatttgacggaaaattgaccattcttatggagcgaccatacaaagcagtcattttcatttgacagagttatattagctagcctgaggatcaaatcgtcccactcgattagcttttggtcaacaatagctcttctaaaagagatatttagcggcgttgtgctcatgacctctgccacagtagactgcttctttcgagccacattagataatgtagggtattgatctttgaaagcacgcgatcccaaccacgtgtcttcccaaaatcttatgtttgtcccattgccacatctaaaagaaccaaacctaagaaattggtctttgactttcattaaaccggctcagaactgagaaatacctatcttgctagacataccagaaagagctttaccctttaagtatttatttcgcaaaaggtcttgccataggccttcaccattaaacagctggaaaagccatttgcttaataagcagctattttttatatcaaggttatggacacctagtccaccttgatcttttggtcgacatatgttttcccacttagttagtctatattttcttttccggtcatcattactccaaaaaaaaacgtgacccaaagtaatccagtctttgaagcacacctcgtgaaatttcaaaagaaggataacataaacaagggaaggctcgaaagaactgagtttagaagggccaatctcccaccatatgacatgtttttgcctttccatgtgctgagtttcctctcaaatctatcttcaactcctttccaatcaacattccagagttttcgataatgaataggaataccaagatatctaaacgggaaagatccagaattacagccaaatagttatctatattgatcctacacttccttggcttt

SEQ ID NO: 42044 - DNA, 1603 bp, Oryza sativa
aatgttagttacagaagggggaagttggggtgaaattgtgtagacccagtggaaaagaagatccgaatcgcttagctctgtcagcggtgagtgagcaatcatgtgctatgtatctttgttagttgtgatgggatcagcatttgcatccatgctatttcactcgaagaaatactgggagtaatgtcgagacaagaacatgggggatccaatgataaattgaagccaaaagaatccaatgatttggtcattttctctttagcaatttcgttcttagcatttgaaaacgatatacccaggatcatatatagttgatgatattccccgcaagaaaatatatttaattgatgatatattttttatttgtcaaaattagatctcttcaacctaggaaaaacactggaccatactgaaataatcctatttgaggatttttttagatggagcgaaataagtgtagctcaattaactagttagactagtggaacctattcacttgagttcaagttttaggcttgtcacttgatcgggagaaactgagcaaagagggaaacaacaatgaaatttctagctctcaaacaagtagatgaataaataaattgtttttaattaaatttgttcataggttaacttgaacatttgatatctccatttttcagaattggtacattttctttctttttttttccgaactatcggtggtacaatcatggaaaagttgtgtatgcaatgaagaatagtattttatacttaccaaggacttaccaaaaatgctaaagttgtggctattggctagacaggggacccccccccccccccctccgaaaatatacagatatctctcaagaaaaaagttcacaatatgatatatatatttcgtttggcaaatcattggcctgtatattacaagttgttggagcctatctaggtgcgtagtattttcatctcctttgggcttgccttttcctgatagaaaattaagatatgtctccctagctgatgatgacttcgattttgtcctttgccctcctactggaaactgtataatagtaaatgttgcttagaatacagtcacttgacaatgatattgtaggtcggactcgaagccaggagagcatgattagattcttcgttacgtcatctcttcaaactattaggattatcacaaaagaggattagagcaatgtgatgacagtttggcacgcacactgctggcgtccaaatcacaaataatccatgagctccaaggtaaaccgagcaattaactattggaatcattttctttcttcctttcccttaacttggttttccttcatgtctttgttggtacctgtgaaacgacctgatgcaacatcagtatacgacatcatagttaacagaggtgtctcccactcaagtgtcggcagattggggaaagatatctagctgcctttttgcctagacggctatagaacctccaaactatgcagaagcagaaccactaatttttcttttgttcaaatattgtatgcattccatcagattatctttacaaaagaggctctgattgatctgtgatatattgtttgattgaagttttgaacaagtggcataaacaagaaacttc

SEQ ID NO: 42045 - DNA, 14809 bp, Oryza sativa
ccccccccccccaatcttcaaggatgtgattgataaagtcgccaatctttcgagctacaagggggagccttatctagtcgccgggccggctttgccggccaaactttgtattaagaagaagaaaaattcagagtctgtacagaaaaaagaaaaagagagcccgaggctctcacaccacaggggcaaagcccaaaacatggagaatcacccacgcaccgaaccggacacactggttcaccacagggagccttatctttacttgcatcaatcttcagatgagaggcttgtgttaaaagatagcacaaatcattcatgtcccgggccctgcatatttacaccaaatcatgcaatgcccgctgctattacaatatatatgtacgacacgcttggtctgcaattagtatatcctaatattgctcagagcggagaaatggctgggcctgccttgcaatctattctggatattcttccaatgcgctagtacagtccttagtattcaatacacacctgtatgcattatctcacaagtcataatactgcttaatgtctgaaattaataagtggatgacagatgaacagccgggctaatcttagcaaaaacaaattagttggctagtcttcagaaatacaatgttgaagacttaccttacaaggctctaaatggataaaatcttttgcaagaactttaaattttgcacaagatggttttcgagcctgaaacttattgggaaatgctttttcggcaaatactcttttatctttctggaatgaacttgccggagtaagagaaaagattctgttcgctgagatgtcaccgatcattactcgaatgagtcaatgatggaaaaacaagagagcaatgtgtttaaatacgctctgcctctgctttcttaaatacttgtatgtttcacaaatgatgattccacaaggtacttttctaaattatccacatttaactatacaaaaccatacgcatgtcataatgtcagtgtatgtacacaatatttggagggtattttcgttacgttttactgaaaatataacgtgtctctctccatgacatgaaccactttgcatatatttccaacccaattatccaaacctcgagtccatttttctctaggaaaccaaacatatgatggttactgagtgcccgctggtgcacgtacacgaagtaccaagcgtttcaaaccggtatatggggctttcaaaaattgacaccaacctctcaaacctaacatccgaatattgttcccaacaaccaatgttgtctagtatcctaattcttacatgtccattgacgaacttttcgcgcttcaaatttcaactagccatctatcgatgaattccaatagaaactgtgatttcctattcttcaccagccaaaggggatgcggtttccctgttgttcctgttccgatccatgtcccgtagttgatcacggcagatatcatcagtggtgggccctacatgtcatattcaatcttcttgattggtttcctcatctcgttgttcatatactatacacccttattgcctcctctctctcatgacattataaacaccaagggatcaatcaaatcaaaatggaataattgtatgaaaaccatcgttcaatcatagttttatgtgatttcacgatcaaaccatattatttaaagcggagttgagattactgaaaccaatctggaatcatttttctctctgaattgctttgcggtgtactttcggcggctttggttcacgaaccttactgaaacggcagacaaaaatcactcaaactgaagcactcaacagaaatcactctcatgattgcaagagattggaacaagggagaatgaaatctctgttttccttttcgatggagatgattcctccaatatttatttattccctgatactgtacaagtaccatggcctatcaatggagtcatgaaaccactacggaagaagggagaagaggaagggaacaggctgtgggtgattaggacttaattcgagggcccctaaataatactcacatgacaaggaaaacatgaagcggcatccagtcaaaggccccggctccttaatccatggctaatcaaagatttaataacatccattccgtacgccatggaatggaatgcagatcttacttaatcttatccagaatctacggccaatggagccacaagctagtggtttcttccgcactgtgatcttagcaacatcacagtacccgcacagtgagcaacttatttttgtctccccaatcataacgagagatgaactactgtgttgaccacctgctgcctcaaccatagattcattcacaggttaatccagaaatatcatgacgcgacacaacatgaagagagcaatccaagaactttctccagtgcgatctggtgtctacatatcagcaagtctaaacacgaagaaaatgacaattatgaaatgtttcatgggcatcgcaatatatcatattatattatatcccattccttttgggctcatagaagctcgttcatgccttcatgtttctgaatcatacagtagtccattgcaaacctgggaatgcagtgcaattaattcctttgctcgggtggatggttagcatccacaatggcgacccgtcaagggtacctggacatattgttgagcaaaagagaagtcaaagaaacaaagtgccaaatcatgctcataacaggtcgtaatctaaatctaggtaggatttcacttcgaagttgttgtagtatgctactgtaccaagcactataagcttcaagttgatgagcgaatctgtagcgatggatctcattgctgagttaaactccttaagagcagtctgcctcaatcgcaagtgttttggtgaccccagggcataaatcttctccaaatccctcgtctgacaaggagacggtacagccattcatgttcagacaggcctgccaagataaagtaaacaacagttcagcacaattataaagtttgatggtcagtaatatcaagatctccatataacttcagtccagaaatagttattggacaactcatagggaactcatggctcctttgaaatggaaagtttttaccctcctatgtgcccaacccagtgttccctggtttggaacagtaaaaacataatataattccagttgctctatggctacaagtcagaactgatggatctaaatccacatgcatcgacgtatatcagaaagtcagaatcaaaggctctcaagttttagattagatgtgcactttttgtgcaagaactgtgcatattaccttctcaacaacagatattgagttcggatggtggcagcttccttgttggtaagatctgcaggttccactggggtttccaaaactcacaagcttaacagaagagatacttttacccttggggcaagacaactgtacttttgctgcgtctctaccatcattttgggtattcctatcccaggattccaagtcaatggaagggtagtgctctgacacgaaggagcacacacttgccacagttcttcttgagaatgtgatctttgtaggatcccctcccttctcctcaaaaatcacaagggtgtttcctgatggatgaaaccatgaccgtgggacatggtaccttgaccaaatgcaaacagaaatgtgaatgtgagaagtatgaaaaaaaaggtattgtgagctgtgccaaaaatcgtcacataccatctttgagttggctgcccacatcctctcctgcacttatttggagaaaacgttcctctatagtcacaactggaagtacacctgtcactgacaggacttatcctgggccaatacctcccaatggcatttccattcaaccaagccaggcctttccccatagactgcatatctaatccaactggatcatctccttggggaacatcaacgtttacctagaagtatgttgcattagtagtttaccgcaagtagtacgatgagaaaaacacgtatggaaaatatagaccgaagaaggctaccttgtaccatgtcattggttgattttttggtggctcagactgtggcatccaccttatgtccttccccttatcagccttgaacaaactataatattccccttccaatccaatctaccaacaaatacataagattcacataaacattacacctcaccttgccccaaatactggatatgtcatcatagaaagcaaacccaagtacatagaaagagaggagaaaaattatagaatggctttgaaggaacagtatactactttatcatcaattgagttcattacacaaatatctgaacaaattcaacaatcttgtaccttgtattcccatttattggaagacaagtcaattattctgttttccattcctgagatcttcacacttgtaatgccggctcctgcccattcgtacatgggtcctccattcttaaaaggcacacagtttttatcaatcagatgattcaagcatttttaacttgaagctaaaatagcaggcttaacaaactatagggtacagttagaactttcttttgacaaaagtgggtacaattgacatgccataaatagcaatttgcatgtaaaggatatgcctcaagtttagtcatacactcgtatgtaaaactcagtaaacgtaggcacttacttgcaaaccaacagtcatactcaatagggaaagtttgttcttcccagccctcaaattgacgggcatttccacgctgaaatttgattttgagccattaccatatgcactacctaagaaagatttgcaagtagtaatgacattaaacagaagaactcaataattgaagagaactgtaaagtgtatatatgcaaagaaagtgctgctgaagatatatatggttgtctttttggggaaaaaaagatgaagaagaagaggtgacaattatataaaactctcatttcagggatatattttgattatatggaaatgattgggcattcagaagattcggctgaactgaaaatggtattggatggtgatttgatgatggtctctcagcaaagtaagggtaagcaacaaacctataagctcattgttcaggaaagcctgaacagcatggcctttggattcaatatgaagaacatggttgccacctgccagatgacttccatctacgtcaaaactgcatattccacaaagaataaagaccacataattaactgaaagttcatagttaaaaaaacttataatatggacaatactaagatctcttttttggattgttacatgcatatctatttgcaatagaagtagtatatatgaaacagactgcagtataccaaccttgttgtgtaccataggtagtcagtagagtcttttgttgtattaatatggtctacaaatccatttcggactaagtcgatattaccccaaatcccatatttctctctgaaaatgctccacccatcaacttttgatgattccaaatttgcagggaccatatccatcatcagagtttgagatcgcacctaaagatgaagagccaggagctacaattatttgggagaaaagaacttcgtgcaatatggcactttttatataactcggattaagcataaaatattctgatatttgccatttattttgctcctttttaattcctttgctatccatgttccatttgttgagaagggtgctatccgttttgttttgacaaggctttttttcttttaagaaaaacattttttgcagcaatgcatgttgtaattcagaagaccattgacatagaaaatcaaatacctttgcagtgttgaacgccacattcttgcagtcaggcaggatactgaccgaccaagcaggaagatcatacgaccggctctggaaagtaacaactttgtccttttctgaatcaacattagaaaggaatgcaacacatcctcctgattgatcagtgtaaacatcagcctgcaagcaaaaatgggacactatcaattccataagttggtagaagaaaataatgatttaatcaggggataaatacaggagcaaaaagtgaatagcagtgtgcattaaaacaccaatgggttacagtatggtagacataagcagcatttaaatgtacaatgctccttacagcagagatgggttgaagttaatatccataagaagttttgatgcaagctttcatataatattgaaaccagatttaggtcaaaggttataacgataaaacctacctcttgttgaggccccagagaaacaaatgacgaattaccatacaacagggtatgctcgcccaatttgatagatttgtgaaggtcccttagatgagcccatttcggaagtctcctaaggcctgcatttcagatcaactaatactactaagaactctttaggcttaatagtttgatggaattaataacagcaataaatccaaaccatattcatcgatcggtgcatcatagtcatagctagtagtaatgaatggccctccagtagtgcgaccgaaatttgttccaccatggtacttcaaaaggatagagaaaacttgattcaactttcagaaatatggagcttccactagttattcatactgacaaattgtattcaaatgactaaaaatgtatcaagatgcttgaacttgactgtaaatctttggtagtgcaatcaacagaaaacaattatcagtgtgcctttatcaaattaaaatgtaacttctgcaacagcaattaccacatagtaattctgaaggctgccacctttcccaaaaaaacgtgcaacagaaaatgcaacatcttcagggggcctgtggggattactttcgccaaaggtctggaacctaaattcaaataggaagaaacaagcagcagcacatcaattagcttctcttttaaaacatctacaatattaactccatattgtgctataaagacatgagaagtactagatggagtctgttgctaatatgtcaaaatcgttaccatcctggccaattctcagtccaaaattttggcttggttggtgaatttggcttgaattgatcacagtagaatgaattgcaagtgtttatctgcaaaagtaaatttgaatgcgtgagtgtaaccgcaaaagaaaagttactgcatatgcaaaaactttatttacatcagtatcaatcacatgaatatgccaagatgttatgaatcacacaatgacgggaagaatacttgaagacgttatggaaagacaatcctgatagctatagcagtacaaaaacaccaattgcgaggttacgatttcaagtgccacagattatctgctgttcactgttcagtttgcctaccacaatctctcagattttgaaaaaacttttcaaaggattttataccatacactgtcagtgacaaaatatagcagatgtgctggtctttcaaagaattttacaccatacactgactgccagtatgtttcatggagcaattcatggttgaaatgtttcattaagcaaaatgtgttgaatgttagaaactaaccactggatcaggcgcatcatactgctggcacatgatccaagggacaccagtattctgagccagagccatactagctgcccacattgcatatggcttggcaccagctccgtacgcttgttccatatctccgtattcattttcaacctacagtgcaccaattctgccgtcaattgtgaagtacacctatctcaaagttgatagaaacagattgatgtttcagcgccccaattaggattagtatgacaatgtccagacctgagctaggatgatgtgcccaccctgcgaagcgaagaattgttctttcttcatcatatccacaatgtacgtcgtgaatctcttcatgtgagactgcgtaagtaaatgtcagtataaccatcaccaaacttgcaaactccccaaataaaacgccacgaaattcacaagcccgccacaccttgaacggctcattgttcgtccggaacaccgtcccgggcgcgtaatgcagccacaccggcacgcccctgtacatccacgcacacataaacggataaacccatcaacccagagaaatcgaatcaccataattctgcacaactacaaccaatcgtgacactgcatcagtataacgaagaggcaaacccgaaggtccattctgcggcgacgaacggcccaatgcgcaggatcatgtacagcccggcgtccttgacgatcttcgcgaatcgcaccaaatcgaaccgctcctcgaagtagtactgcaatcagcattcaccaatcgcacacaaaacacacaggtttatcacggatcgaacatgctaaatccatcacaaattttggagaggcggcccggacctggccctgggcgggctcgtggccgttccagaacacgtaggtctcgacgcagtcggcgccgccgtccttggcctcggccaccagcttcggccacatctgcgagcacgagcagcgaggttaccggtagtaccaccgcaatgcgcgcgtgctggcgttcggggtggggtgcatacctcggggacgctgcgggggtagtggatggaggtggagatgaggaggcggcggcggccggagatgatgagggagcggtggtcatacgtgacgctcgagttggcgcccgctgcggcggcggtggtggcgccgagcaacggtaccagcggcagcagcaggaggagtagcctccgcaacgagaagtaggaggaggcgcccgccatggccgccgtcgagggtggtggtcgatacggcgtatgagcaagtaccacgcggtggtggtggtggtggtataaaatagcgtggggagggagacgccgcgccgggggagtggggacagtggagtgcagttgtttggattggatgcggcacctctctcggtgtgccgcgccgtgcccacagtcccgacgacggtgtggacgccccatctctcccgccgttccgcgcaagcaaacgcaacgcgacacacgcgatgggcacgcacgcagtgtcactcgcggcttgggttgggcagccggcgcgaggacggtgcgtgcgtgcgctgcagctggccgtggccgatgggttcgggggatagcggacgcagcggattggggatggatatgccgtacgcgacgcgacgcggggagggaggggaagccggggaaccgtggatcgcgtcggcgtcgcggagtcgcggggcgcatccgcgcatgtgaccttggtcgggcctcgggtgacgatgagtccatgagagcgaccgctgcttcggcggtggacccccgtcccgtctcctggacgagtgccacgttttcgtgacgacccccgtgtgatgcacagcctgtacaggggtagtggagtgaagatgcgttcaggatctgtgtccagcgaacggcgctctgtcacagctttcaacaagtttgatcctaacttctcaactcaaacttgtactaccagaaatcgacttcaattagggttccacatctactttccaacttcaacatacaaacaaaatccccgaaggaaaaaaaaaacagctttcgatcacaaaaatgaacaatcaccacttttcacatatctagtgttttatttaaatttcactttggatacttttaggaagctccagggcaggggcatgttgaagccaacctcagacatgcaaaatataaatatttgccattatcacattttgacaaggtagggtgtagagtcaagtgtttgttacatttccgaatttcaaggggaaattatagtattgcgtaggtttgaatttgttgctgcgtatttttttggtaagatagtggtatttttaaagcatgtatggtttgttatcttaccaaaatcagatggtgccaaaatctaatagtgttagaaattgcagcgaaccaaatatgccattggaatttgttttgttccagatttaggcgctacaaattttagcaaactaacaaatcatgttgtttagcccttctaacgcgttgaattgtgttaaaaattgatttagttttattataataatatatttattgttatgaatacaattctctctatttaaaattattttagctaggtcgaatattcttacctttgaccgtattttcttttaaaaaatcatataatttaacatcataagatttaggtttatgttttcaaattcattagagaaagcaattttatgatatatgattcacatgtcgttaagctatataaatttctagtaattaatggtcaaaattgaaaatatttgacttagaacaaatctcagataataagtagttcaaaacgaagggagtgacatcataacaaaatcaatgttgaagatacaagtggttgatggttactcaaatgcacaacgtctagattacagtcgcaaatgcaagtactcaggattccatcaaaaaaaaaataatacacaatatttaaaatttatcctaaaagtagtaacatttttttcacctacattctaatttcaatcaatcacaacatctctttgttcaccagacatacagagcacaatctaatttagagcccagtcatcgagccaagcgttgttgggacttaggagaggagaggagcgtggttaggagggagagagaggagtttatgtgaatgatcgatcgggtaagagtgtgtttagttcacgccaaaattgaaagtttagttgaaattggaacgatgtgatggaaaagttgaaagtttatgtgtgtaggaaagttttgatgtgatggaaaagttaaaagtttgaataaaaagtttggaactaaacaaggcctaaattgggtcaaccacatcagttagtcacttataatgcccttataacctatttgataacactctagctaactccaagagcgaaatctcaagtatagctttggagtagtctgaatcccgcttcatctttttagtttatcttttcagatcactctaacatgctcggctctttttaaaggtagagttaaagcctaaaatcgcatggttggactgcagctatagatgatacttttttcgtcaataaaaaacaaacataatacgacatttgagtatatccaaatctatagtactaaaatgtgttacatctaggtgacacttttttcatcccataaaaaacaaacataatatgataatccattctccgtagtattctcgtattaggtttgtttttttataaaatttgtactaaatatgatctgatggcttaaaattgttgatgatgtggcttcttgcatgtcttactttatagaagtaaatgtctcttaatgggtaccaactatataagaagataggatggagggagtatggatctccaataacagtgcaggcagtggcggagccaaagcccggcttgaacaggcaatggccctggctccaccagctgcacgcaacaattcaccagtaaattagtgcctaattatcttagtaatcacctttcttagtcaccggcaagacagtacaatgcaactagtacaacagtaaacgcgctcaacacaaacttttaaaacaaatgttcatactaaagttatctatgaattatataggcttgtatatacctcatttgttgttagacttgcccgactcataaaaatttttgaatccgccactgagtgcaggttagcccatccgttcgctatcttcgatctgctgttcaacaattccgcttccgccttccagtggcggttacgtaaacgcctggcctcctgttattctccgccccgtacagaaggaacagtagagctgtagagcacacatcattctcgttctcctcccccaaaacctccacttgtttcttcagaccccaagccgatggcggaggcgtcctcgtcctcggcggcggcggtcccgccgctggacccggaggcgattgccgccgtggcggaggcagcgccaccggaggagatgacgctggtggcgaagtggaaagggaacgactacacggtgcgggtggtcggggacgacacgctgggggagctgaagcggcgcatctgcgaggtcacgggggttctccctaaacggcagaagctgctctaccccaagttcaagctcaacgagtgcaaggactccgagctcatctcctccatccccttcaagcccaacgtcaagatcaacatgatcgggtaagcgcaataccctccttcctcctcgaaccctacacctccatgtgccgtcccgtgtctactctcgctcgtgttctgcagatacctgactgcgaaaacatttggttactcgtcgttgaactggatgattagctcgtaattcgggggaatgttggatttcggttggtgattcgaccgatctattcgatccagtggcatcgcgttgttcatgatttgaaattgttgtttatttcctatgggttctcagatgctgggaacggtatttgaagtttgggattgacatccagtagcagtatgtggagacgtttgtctattagattagtttcacgaatggacgtggagtaacgtggagtgactgaggttatgtggtgttcatctgagaggaaggaataaccttctcaaaccttgattcctcacagtttgaacacattcgggagtgctgtagttgcaatggaatcatccgtggagcatgtgaatttattgttaaattgatgcattagtgttaccaatggctgcaaaatgattatggattagtgggttttttaaatagaaaaacagcaggatgttgtttttcttaaatctctagaggcccgttatcgtttcttttctgatgtgtttctgatagtgatgcgaaattggatggtggttgatgttatatgttcagttggcatgtttttggtggtgattgaagaacctgaatgatgatccaggggcaaactagttagtctgtttgtacagtaccatttaagcctatgatctgtgttgatgtgttctaatctgaaagtgtgctttgttgaacttgaactttaaagaaagtctgtttcgagtttggacaataccatttaggccgggagatcagatcatttaccgtttagatggaaaattgaggatttaccctcctatgccaatgacatgtttgagtcatctaaggtcatttacatgtgggtcagcagggtgaatcctcaatttcaatcaaaacggagggtatatggtcaaaattttcgtttagggtatagatctgtgtcctattctgaaagtttgctttgttgaacttgaaaccctacctatggacataattcgattagcttccttttattctgttttataatgtgaagttactcattatgctttgccacttatgtgaatgttatttcttggtaaaatttgcaaactaatttatatgtcagtatgttcttgactgttaaatgcttatgtgctatgtggtttgagccactgatgtaatccgatattctgcacatggttggatcatgattcgttattgctaactaaactcatgctttgcaacagatctcaagtaaatataccagaagagctaaacatgaaaagttgtatatgtttctcagagaacatatatacttccaaccataaatcaatgagataaccctattacagcacatgtgcacaaatgagctatccacaaaaacccaattagttcaagaggttccttattatccgcatgaatcgcaccaactcaaggaatagtattgtgatggcagactcaccaccaccaccactaatatgtcccttttatgtagtagagatcttaattatacacagtaaggttgtatagctggcaaattgtaaattgggtgtagattgattattattgttcattcatgtgataaccttctaatggtgtagaagactaggaggatcttatgctatttatattgggacggctgttacaaagaactttcatttgacacacctttttgtttctaatattttgtccactccatagtacttccatttgtaggatcagtagtggatgcttggatggtgagaaaaatgcatgtaattgcgctaattatgaacacttgtaatgtagtattcctctttagggaaaaaaacatgccttatggagggcttgcagaggaagtttgtgaagcatttaccttgaatatactttggtgtgacacttgtggtttttctagtgaggcactgtgaggtgagagctttgatacctttcctgattcagatctgtttttatcatttccaagatgaaccatgggagatggacctcctcttaatattgatttagcactctggctttactcaacagtcaacagcagcatattcaagttttcagggttttttttttcaatggttcaaatcactcttttgctgcgttacatctcaaagataatggttctgtttgaaaatttgaatttgtacaccatgtacttatgtcccatttgaaggtgctttctatttactttgcattaattttgtatatctttcagcactgttgaagatgaaatatttgtggaccaagaagatgatccagagatactcaatgattatgaaataggccagaatgaagttactgctatcaaggataaagatgtctacaagcaaaaactaaaacggcgtgcaagtcaatataaggtatattcccgtgtcattttcgtttcctgtcatatgcttcttccttatccatgcttttatggttccacaatatcctgtttgttctgacagcctgagccacatcttagtgcttgttcctttgacctacatgaagttggtaatatttcctagcgtggttcaggttgttagtatgtcagcatgtcgattctagaaatattttgtggtttcacttgctcatagaccaaagccataacagtgacgagggttattctctctcttgtgtggtgctgattgaagccatagccagaaacttcttttcttagcaatgatccataagtctaagcccctaggggaggtagtttttgtggatagagattttggacatttgtgggcgct

SEQ ID NO: 42046 - DNA, 8074 bp, Oryza sativa
  unsure (1)..(8074): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttagatttcatattgttcagctattttgtttgtttacaacaaaatggaccatatccaaaactgcaacaactctatgcatggatcaatgatgctatataatcaggtaagtgtaattttgatcagtcttttgaattggtatccggaaattttgtgagcgctttagcatctttttaacctcataggtgctgctagatcaatagcattttttatctctctgtagttgtcgaatgaaacttcacaaatgtggatgtgtttttttttttcaaataatgagtggtagctgctacaagtatatcttcctatgtccagatccatcatgtttttcattgtcaatttgagtggaagctattctcaatatttttcttgactgcataggtcccttcttttttggcctcatagatactgctatggcaacttgattttgtaaattactcacttgacaacgatatggtgagagcttaaatatcttttttttacatgtgattgttatttaaatgcttaatatgtttataaggccagtcccaacccaagaaactagacatagtttccataaactctacatcatcaagaaactagtactatacactactttttcaatgcaaacaccactttttcatgcttaaaattaatgctacttatctcacatgatgtcttaaatgctgtgtagaaatcatgtctcatgcaagaccctcatttattcacttgccacatcatcttttactctaggtggcagcttatttaatgctatagacaccatcctagtcattaggttgggaatggcctaagagcaggaacaattgtagactattagacagctgtaaatatattttaatgagatgaaagatgagggagaagagcagccggctatagatctgtagccagctgcagcacggactccaatacacaatgtgtgtatgacaggtgggaccatataacagtatagtaagcaactattttatgaatttactgttagattagctaaagatgaactggagctagtagtgggctatactattaaacttgctctaatagagctgtttgtggaggtggttggtcccgagtgcatcatacccgagggatgagggatatagatcctctaatcttcttatcatcggcttcattttatcaagcgttattatgctagcactcatcaattcatcctttcctcacatactacgtgttttagctataactatcaattttatacatgatgccaatactcttatctacaaaatcctgttattttacctattatattagctaggttgattgtacaaattactaaacagaccgcgaaagtaatcatataaaatcctataaggccctgtttctttcagcttgggattattataatccagattattaggagtaagctgaaagaaacagacaacttattgaagtagcttattataatctggagctcagcttattataatctgataagctcatttaggtaagctttttctagattattgggtgaaaaattacccaccatgccatcccacttcctctttagacctgcaaacccaataatctatgctctaataatctagaaaagaaacaactaaccacttattctactacagattataacaatctagcttatagtaatctgactcaataatctagattataataatcctaatctgaaagaaccagggcctaaagctcatgtcgttgctgtacactgttcactcgcccgcgcggccacgtcacccaaaaaagcagcgccgtccgatgccccgcccagctacgcgttcgccatcgtatcaggccaccgcaacaggcagtcggtcgtgccctaatcccttatttcctctccccttcccacgctccgccgccgccaccgcgattcctcgcattcgtccccactccccagcggcaccgcatccgagccagcgcgacctcctcctcgagccagtggtcgcccgcccgcccgccgtcgctacctcctcctcgagccagcggctggcatagatccggttgtcgatgtggttgcagatcacggacgacgtcggccaccaggtggatgaggtcgagggaggcctggcggcgctgagcaacgatgtccaggtatggtgcttcttctccacctctctccctcatctcaggtcagtcccctctctccctcatctcgcttcttatcctgcttctccacctcgacctctgacgacgaccaccactgcgatggggacaggatgcgtcagatggtgctctccgggccgggatccttctctctcgcgcctcggtgtcgtcgacggcagcgtgaggaggccacggggcacaggatggagcacgcatgggctagcgagaccgcgaggtcgtcttaggtcgtcgtccccgtctcccccgagctgccccgttgtcgcttcttcctgtgagctctgttctttgacccaacaactatttggggtttagtctgtggcaagtgttctgctccaaatcactcgagagattggtgtcgatctgtaggtatgattgactgatttatgccctggattgagagagtaatatgtaattaggtgctttcttggtcattttttcctggggatttaactggcatccgtagatttcttggatttgggattgatttactgcttgattcgaagctctgtttcgttaatataatggcgagaacttgaactccatctatttaagacatttttttttgtttcagctctctggatcaaattaatctgagggtctcttgattccaattttttcatccaggatgctgctgccagtacatgcgttgcagctcttcttttccttctggatctggattttaatccacatgtctgccttttgttatttttaattattttgttcgattgattagtctcatcaacctttactctacaaatgatgatttacatggtcattattccatccagaagaaatgcattgactgttttacatggcaaacttattgaagggttgtgttctatctcgaccaaatgttctcaaattattttgcctgctgctgcattataatactcacaagctattttactatcatcgaatcctcatccggatacccagctgtgtttttgttgtatagtgtccaatggatctctgagcaacccagttatactagaacaaaatgaagatacacagctttgttattatttcgttaaatacttgcagattccatatttcttcacaagctttcattttctttactataatcttacaggcaggacacatgacttcgatcatggtttagcatcatctgtcttggaatctttggaattcctaaagctaaattgatcaggcactcagtgtcctatatatgcagcagatgaaatgattcaaaaacataatatacaagtatccgttgttgattagtccagtgaatattgtcgtagccacacaggtaaccaaaactgcacaaaaagctgcacaacaatttcacttggttttagttttcttattgcttttgcttatataagagttagggcatattacaaatagtaattattagctttaaatcttttttttacctaatgatttaactggaggaaaagttcaagctagctactgcagataatcagttttgctttaattatcttgatcagtctgtaagtgataacctgttttggttatgtttaattccttcattattaactttggttggaagttcaagcgttaattaaagtttcattggttggttcattcacattatcatgccatataatcctgtgacaaggcatatatttctagaggtttgtccaacatatctaaaattctgtatgggtgccgtgttgttcaagagttgtgttcttttctgccttagtaccaacagagttccgctttatggttcacttcacaaaattttctccgcatgttgtttatttatcttaaacgagcaggatggaatgcttcataggctgcttcaaggaatgggaggtaaaaaatgtgactagcaatcctatagttttggttctacatatatgtaatcgctgtacatatacgcagttaacttgctgctcactgatatttgtttttctggtcactgatggatgcttatattatttgtttctcaccgatatatctttcacgtatgatagttcattttagactaatttgtcattcaaattttatttcatacagataggcaagtcctctattttccagattaatacgggggagacatcgaaaagatatgcacctcttccttctttgtacagctgaagtaatgccttatgatagcacaccaaccacatgcaatttcttctaatgaacacacaattgtttatactttgctacatacagtggacagttacacctcaaatccctcctagaataaatcgaatgaaacagttacataccagtctgtactatgacatcagtatggcccttttggtctgtatagctgtcattattgtaaactatgcactatgtgtacatgtgcttaagattactagctacctattcatgttttcatgctatattatggtatgacatgtacattcattgtacaaataccacactaaaacttttttccttccgtgttcaggtacatcttgaacggcagttaatttccaaactgaaatcatgtttcttcaggttcaaagaaaaaaaaagccatgtttctggaaattcactttatttgattatcaacaccctttcacactgttaaattgtttgactcctatcatggatatagtatcaatacatgtactctattattgaacgtgtattactgacactgaaagtttctattatttcacaattcctattatcttcttcgttctaatgatttcctattattcaccatgcgatttttaaattattgcaccatgtattatgctattgaacttattaaattacatgtccttgcagaagaagttgacattggcattgtgcaagctctattgatgctatccaacctccacataaacattgtgccttcttttggtaatatgggcgctttaggcatagacctctgtagggatcttcatcctgtagtcaacggttatgcattcttctaattgttgtatattactcttagtctggtggtatatatgcagaaagatattcatacccttaccataaccccaaaaaatgtaattgttaagataaatgaaaatttttcaagatttattgtgacttagaacttcaattttcactttagtaatgatatctcactttcatggtacaaatctatatataaagatttgtactttggtatatcttttagtcggtgtaatatttcttttgttataacaaatttgttttgcgtggtttattgtaaaattagtgatgtaacaaataatgtgcccgcgcaacgcgcgggccgggcatcacctagttagggcacccacaatgttgtaaaaaaccaggtagtaagcattaaatggttgcttactacctggtattagtcattgtgggagtagttcattcttaaagccaggaagtagcgctgctgccggcaagaagggaataaaaaatgaaatgtgtacagtggagttctgacaaaaaattttaaattgcaagtagccgttgcttcttccaaccgttgctctcctccccagccaaccgttgcatggactgttcttcttgccatcttcatctcctacaaaaacagagatggctcataatttctttgaatcaacacaaacacattctgtgaaacttagctagctgagagcttgagatggatccctccaagagaggtttcatgaacttgttaaaccaaggctctccaagccaacaatctagccaaaactcccctcctactcaattcccctcaactttctcccaatcacaatttccccaatccccacattttacccaagcctcaccacctaatttccaaaccttcaacccttttggtcctccagccaactatcacctatatggtagttctcctccaaactttcaaggttttctgcagcaagcaagctggttacaatctgcaccaataagctttcaaggttttcgtccccaagaaagttggatgcactcaccaaatcaagttgtcgggtccgcctcatctcatggatccaaatcagcctctcagtgccctgcaagacaggaagagaacaatttggttaacatcgaagagtcaagtgacaatagccaagagacagggagaagagggacacacgtcaactggaccgaagaagaaaacttacgactcctcagctcttggttgaataactcactagattctataaatggcaatgacaagaagggagaatactattggagggatgttgctgcagagttcaatggtaatgcatctagcaataaccgcaaaaggacagtcgtgcaatgcaagacacattggggtggtgttaagaaggacattgcaaaattttgtggagcttattctcgagctagaagaacctggagcagtggattctctgatgatatgatcatggagaaagcccatgcattatataaatcagaaaacaatgataaaacttttacattagagtatatgtggagagaattaaaggatcaaccaaaatggcgacggatacttgaagaggacagcaagaacaagaggactaagatttctgaatctggtgcatatacatcatcatccaaccaagaaactgaggaggagaccagccgaaaagagaagcgtcctgaagggcagaaaaaagccaaagccaagcttaaagggaaaggaaaaaaacctgcaccgtctcctttgggggaccagccatctcaagattttgttctcttcaacgaagctgtaaaattgagagcagaagcagtgctgaaatctgcagaagcaaccaccaaatcagcggaagcaaagaaggaacaaactaggatggagaagtatcagacatatttaaagttgttggacaaagacactgccaattttagtgatgcaaaactcaagaggcatgaagctgtcctcgaaaagctagctacagaacttgcagaagaatagaagatccctaagttatgtttgtacccctagtacttagtgtgtcactgtttcattaagtttaacttgctagtaatatttagacttgtgataggtttgtagggcaagtaattgttgtattgtgaactcagtgaatgatgaatgtaatatttcactagtgagaaggcatatgaagtgataatatttgcccacaatcataatatgtctgaaccttcttctctgtagtctctgatttgtcccataacaacagcaattcgtttcttaagcagcctgcagaaaaatatacattgataataattagcacaacattttataatatggtggtttgaatagatagaaaaggaaggtatggttgtttaaaatctagctgttagaatacatccaaaaagcaagacatggttgtttaaaatctagctgttggaatacatccaaaaagcaagacacagttgtctaaaatttagctgttggaatacatccaaaaagaaagacatggctgttcagaatctagctgttggaaactagccgttgcaatggaagcaaaagcaaggcatcaatgttacacatagctagcaggatgaaccatatataaataagacatgcacatcacgaaggcagcattccccttcctttccttcaacttcttaccaacatagcaacccatctccaaaaaagatgtccactgagtcacaagataattctagtcattccgatgagtccatcactagtgagaagcttgatgatatgacatgggaagaaattaatgaccctatggaagctcagcttgaagctcggttggaagctcaacttgaagcgagattgatggctcacctagctggtagctctaatcagctggggggctacacaaggaggtacattagtagagatcatgaagatgaccaca

SEQ ID NO: 42047 - DNA, 1415 bp, Oryza sativa
ttaatgtattggaccagtctccattattcactgaaatgatacaaggaagagcacctcctgttcagtttaccataaatggtacacaatataacatgggatactatttaactgatagaatttatccggagtgggctgcatttgccaaatcaatcaccaggccccgaagtgctaagcacaaattatatgcccaacgtcaagaatcagcaagaaaagatgtggaaagagcctttggggttttgcaaaaacgttgggccatcatacgtcacccggcgcgtatttgggaaagggaagagcttgcagatataatgtatgcctgcattattttgcacaacatgatagttgaggatgagagaggctcatatgatataccggatgacaatacatatgaacaagggcagtattatcctcaaatgacagggcttgaccatggaccaatatatggatttcaagaagttttagagcaaaacaaggctatccatgaccgacaaacacatcggcgtctgaagggagatttgatagagcacgtgtggcagaaatttagtggtcagcaacaataagattagattttaataattccatatcaaccttgtattttactagtttaatttgtctttaccaatttagaatctaaatgtttgcttccaaaagtacttgtatttgtatgtcaaatgtattactttttatcagctacgtattccaatagggactatgtacactagctagttatcttgcaatacctacaaaaatggattgccttttatttctgaagaactatatatatgttctgtatacagctagtagactgaagaaaaaaggagagcaaaactaccaacagagaggcaaaatgtggttcctttttcctgaaaacatttgaacaggaaacaactgtgttgatacatagcaacaaggttacttacaccaacaccaatgcactggtgtcaagtatactcccctgcagctagctgatcgagaatcgagaatcagctagagccctgacaaacatatactccagtagctatatcgaatactattgaagttttcagattaatcaaactccgatgcttacttttgattagtgttgtaagaattaaacataattatatctcatcatcatgtagcttgtatttttgagaaaaaagacagtcggttgctgttaacaggccggcaacatagcaaatagatatattttggatggcaagagagttaaattaaattttctgcaacataatatttagcaagaacataaaaggttagtgctagctacatccgttcgtgatgtagaacagtagaaggttaatgtagctacctgttttaaactgctgtatgcagggctcttatggagtggggaaacctagtgttgtgttctttacttggatagaagcacgaaccataacacagatcaaacggtaaaacaa

SEQ ID NO: 42048 - DNA, 3886 bp, Oryza sativa
ccctctcgccgagataagcattgtggatagtgtcttctcctattaccgcctgtgactgggtcccacactaatactcatcttgataatatacattggtgttgcccttagagaataaaattatagcacctgagtcgtaggctagtggcattccgttttcaaaacggatgacccagatgcctctgagtactgtatagcaattaactatgaaaaataaaatagtacggttctgatcgttggaccatatggtctctagtggaatgaaacgttttgcatttggagggaagacttttttcatattggggcacctctctatgcggcaccacctgagacattgccaataccaatcccctggcatacttgtgatagtcaagacatcgtgcacatgcaatgactcggacacccaacctattaggtaagctaaagtaggacgaaactaccaatttccatcggattcaccctccaagttgtggctcccttgagcaatctcgaaatgacgcgcggctcaagtttgtggttggaggatgtgggaaagactgcatgggggcatccccaaccttgcgaagtacatcttggtactggactgctggaaaagattgttgttgtagattaacttgatcatttatttgtccattattatatttacaggctccatgttgaacaactccattatacaccgttgatgcgatggtatggatattgaaaaaaatatcacgagtaaagtgtacgggcagtccttaaacttgtagtggtgtgtcatctagatccctaaactctcaaaatacatattcaagtcctagaacttatcatagtgtgttatctaagtcccaaatcgccacaaccccttcaggatcctgcgtggcgttgatgtggcatgccacacggaatgatgtggcatcgttttgactgacaaatggattccatttaaaattttttctttttcttttttttcttctctctttttccctttcttctcctttctctatgaccggagcagaagaaaggaaaaaaagaagaatgagaagaaaaagaaaaagaagaaaagaagaaaaaaagaaaatgacatgtcacgtccatgtggcatgccacatcagcgccacgtaggatcctaaaggggttgtgtcgatttaggacctatatgatacactttgacaagttatgagacctgaatatgcattttaagagtttagggacatatatgacacaaccctacaggtttaaagtaccgcaaatgatatcattatacatggcccttttatttattggatcacacaaggaccgagcaagtcttacatcctcaataacagcttggatttgtaactggaaatagttattattcttgttaaaagatggttgaggaagttcaattccaggccttaataaatttatatattcctataaatttctatcattccaaaggatccatcaatgttgcaatttttttcttttactgccatgaacaagccacggcctatttattttaatttctttaataggttgagttctttttattattttctaaaaactttcatagaatatatacatttgtgccaaatataaaaactttaaggtcggacataaatattaaggaattatttgagatattgtgattggttgagaactatacggagaagctaaattagttgagaagataatatatatgaagaaatcatattcaatgctatattttgggtacgtttcggtttcgttggaatggctccaaaatcttcccggtatttcgtcgagcacctgctctgctaccgtcttctccgtcaacatcgcgcgccggcgccgcccacctcagctccaactcctccacaactggccaatgcaacgccgccatcgggggccgcctcgactccggattccccgcggcggccgtatccaccttcgccgcgatgctccgcgccggcgcacgcccggacggctacacgctcccgctcctcaaccgcgccgcagcctccctccccgccagccgcggcgaggccgagctcgtcggcgccgcccacgccgtcggcgtcagggcggagttcgccgccaacgtctacttctgcaacacgctggtggatgcctacgcgcggcgcggggatggtcgcgtgcgccaggaagctgttcgacgaaatgcccacgcgcgacgtggtttcttggacgtcgctggtctcttcgcatgccggtgtctgggacgtccgggaggtgtcccgggtgttgtactacatgcggctggacggctgccagccaagcgccgtgactctcgccgtggtgctccgcgtgtgcacggccaaatagaacgtcggcggcggggggcagctgcactgctacgcggtgaagatcttgacgcacttgtgcaggatggcagcctcggacgacgcggtggcgctgttccagcagtctccgagaagagatgcaatttcttggaacattatgatctcagagtattcttcggaagggaacatttccaaagttgccgaaatgtatcaaaggatgagaagagaggaggtgtgtcctagctgccagaccttaaccacagtagttgctgcattcgccaagtgcaagtgtctccgagaaggtgagaaactgcattctttcgcttttaggagctgtctcagcgatgcaattttggtggagtcctttgttgatttttatgccaaaatgcgacagattagattgatcagttcagtcatttgaagaattcagcgacacaggcagttgcatatggtcagccatgaattggagctttatttgctgttggcagtttatagaagtaatacatttgtttgggcgaatgttaaattctacatttgttccagtgcgttgagctgcaaggattagtcatcagttacagagaacttggtgcactacggctaggtaaagcaactcatgggtacatgataagaaacaattatgaagcacaatctgaaaagagcgccttggtgacatccatcattaaactctatgctaggctgctagctgtgggagcattaatttggcacgaaggtgctttgacagcatccatcagaaagatattgttgcctggagttcaattattgaagcatacacgatccatggctatggtatggaggctctggaaatctggcattgttccacatgatgctagacgaaggaggaaggccaaatggggtgactttcctgagcttgttgtcagcatgtagtcactccgggcttgttaatgaagttcaagagttttttgattgcatgacaagaacgtttggcatcacacctgagcttggccatcacacctgcatggtggatgttcttggacgatcaggcaacctagatgatgctttgcaagttatcagtgatatgaatgttaagccagatgggagaatttggggtgctctccttgcttcatgcaggacatactcgaacagtaagcttgcttcttatgtggctcagaaacttatgaaattggaaccaggtaatgttggctaccatgtggtgttcagcaatacccaagctagtagtgatcagtgggatgaagttgaaagcattagaagctctatggtagagatggacctgcaaaagctgcctgcatggacttgtgttgctgagactggtagcccttgatttgtatattccatctcttcccaaaacttatgttgatttggtcagaaaatgaccaaaagatttgtggaagttgctgtatgactatattggactgaactgtatcaactgttgatctttcagggtgtgagattgaagtttctattgatgggccctgtagccagtgcactgttctttggagccgatcacctcgtgaccgccgctgtcaatgggggttgttcgtggcaggcagagttcagctgcttgctcgagggtcaaatcggtcggattggatgggatgcgaatatctggcattactggccgtgaa

SEQ ID NO: 42049 - DNA, 9004 bp, Oryza sativa
atagctattgcctttttctgatctgaatattgatcccatgttcttcagttttgtcagatttcagaatttataagttccaagtggcatacaaatagaaaaatagacagttcaatataattcccgtagatttaaactcccaacaaatggaaatggaatccgtctgttaaaattctatgcatccaaatgggggcaggaaggaatcagaaatcagaaacaggctatggtaaaaaaattatccccagtcatcatcagtaaagtaaaatatgagaaacaaaccgatgtcctaccagatcaaagtgatgcttaaagccatgattaaagtagcttaaatgctcctttcctgacatagcagtgacttcaatgcataaagtgtaaagattggcgagctgtttcaatcatctacatgtccagcaaatataatgtaatcagctacttgttcttcaaataatatctagtctgatgcctgtctccacttgtagatgacattgcagtgacttcaacgcgtgaagtataaacattgctgacctgtttcaatcatctacatttccagcaaataatatcgcccacagtttgtcttacaaatactgtttgtcaaatagtgtatgatcccaaaagtaataccatccacggtttgtcttaaaaatcctgcagctcacaagctctgaaactggttaatagaaggcggaaacacaaacgggctcactagaaggcgctcaatggttcttttgcgcctgttctcattcttaatcccatctggagctgtagaaccatcaggatgtgaagaaacacgatgagcaacagagtgggtatttcagcatcactcctagtaagtagatttcggtgttacagtaaaatttatgtcggatacacttcagagttggtttttgtagccttctgttgacctgctatgatccacttttttcttacctgtctgcacaagattttgattactggaaatgctttggcgatattggttttcctctatttgataagagaccatgatcttgtgcctctagttggtcattctgactctaaagctatttcaccttttggaccaaacagaggattttattttatatttcccctgctattattttttaaaaaaacattaacaataatagtatcacatatattgtaatttaacatgattgaactattatcttgtatttgtgtttttttatgttcttcactaatgaattagttcacagtaccatcaacttttgtttttgtatgctaggactgaagctgatgtgtagctattgctagtgctttgtgttcttaactaaaagcaaacatcatcatcgttgctatctatataataaccagatagaataaatggctgagtccgtgctccttatcgcactcggcaaaatcacggctgcactgggtgcagatgttctgcagcaaattcggaacctcttgccaacagaagtgtcgctatttgggcagctcactgggcgcatgaaccggatcaaaaaagagttgtttgtgattcatgcattcctgtcacaggccgacttgcagggtgttcagaccagaacagttgaagcatgggtggatgctgttaggaaggttgccttggatgttgaagacgtaattgatgagtacgttcatctattaggccagcaaaagtgtggatggttcacttcagtcaaaggaaaatttggaagatctcaacacctttgtttgtggcttcaaattgttgaacggctgaaggagattgagagagacctttggcacatctcggagatgaaagacagatggattcataccagtactgagctattgggcagaggcaatttggatggtgactatcattgtgcccttccatattcacctcagtgtggttacttcattaattcagatgatatgattgggtttggtaactacaaaatgttgttgatcaattggttagcacaaaaagattcgagtacttcggtaatggttattttgggaatggggggaataggcaagaccacacttgcttcaaatgtttatgagactgaaaagagtaggtatgattgtagtgcctggatagctacatcccaggtatataacatttgctctttgttgagaacgacaatcagacattgtttcaagaacacaaaagaaatcccacctaatgttgacataatggatcaacacagcctcattgttgaacttcgagaattcttaaaaggacgaagctgcttggttgttattgatgatgtctgggatcatgtatgtattggtactattctcaaggcgttttctcacaatgagcacagaaacaaaattatcataaccactagggaaattcagatagcaaagtttgtggatcaaagctatatgattcaaatggaaaaattagaggagagtgaagcatgggaccttttctgcagaaaggctttcctaaatgagaaagaaaagtcatgtcctgaagagttagtcggtattgcaaaggatattatgaagtggtgttgtggtctacaattagccctagttactatgggtggactcctgtccctgagagaaaaaaacaatagcgaatggaaacgtgtctacaacaacttgctttgcagttttgacaatgatccaggccttaatcatttgaaacatgtgctcaaccttagctaccgttatctaccagaatatctcaaagattgctttctgttctgcagcatattcctagagaacagtatgatcaagcggaagcacctgataagactttggattgcagaaggctttgtggaggacagggcaggaactacgatggaagagctagcgcatgattacttatcagaactcattcgtcgaggaatgttgcaggtcatgaagaggaacgagaatggcagggtgaagcactgtcggatgcattgcatcgtacgagaggtcacaatctcgctatgcaaatcgaggggtttccacatgatatggggcaacaaagaatcaacatctgcatatgaggcacgtcgttttgctatacatggaattaatcagtccagttccgaaatcctaactgatctaccacatgtacgcacattcctttcgtttgatgtcacaatgtctgacaccttgctgtcaagaatagtatgcagctctagatatttgacagtgttagatgtatcaggggcattatttatcaaggaagttccgaaacaagttgtatctctcttcaacctgcgttacttaggcttacgtaggactaaggtgaagaagcttcctagttctttgggaaggcttgcaaatctacaaacactggatcttcatcacagttgcataagtagactgcccagtggaataaccaaactagaaaagcttcgacatttgtttgtcgagacagtgaaggactccagttttcaaagtctgaatgcttgtagcggtgttggtgctcctagcggtatatgcaagcttaagtctttgcagacattgttcacaatagaggcaagcaagtgttttgtgcaacaggcaaacaaactggttcagctaaaaagcttccggatcacaaaagttagaggatctcattgctcagtgctgtctgagtcaatcaaaagaatgaagcagttggtgtacttagatatcttagctagtgacgaggaggaaatacttgacctggacatcagtccaccgccaagcacccttgagaagctttgcctgaggggaaaactgaatgattctaatctgcactctttcttcaattccttttgcaacaatctcacatgtctttttcttggttggagtagtctaagcagagaccccctcccattgttgtcccagatgacaaatcttgcattcctctggctccaacgggcattcgatggcccgcagttgaggtttgttctgggatggttcccaagattgagaaggctgcatctgaaagacatggaccatcttcattctttggagattgaagaaggttcagtggtcagtttggaggtgctggagatgactggtcttaatgagttgaatgatattcccggaggtattttctttctgaacaatcttcaagaggtgtacctcgattcaatgcacaaggacttcattaaccaccagagcgagggtgaaaatgttgaagatttcccaagattcatctacggccacagccccaacttttggagaggggaagatgtggcatattgtcaccaatacacatagagttcttcatccaaatttccacaaactagttcagacaagaaacaaccggtgagtttttaccgcatgatgatgctattatttttcatattctaacaagggtaacacaatcgggttacaatgatacacagttccacaaacgtacctaaacaactgattcaatcagaacttcagaagaggtaaatggagaaaatatagcagatagaatagaatgagagaaagaaccagccatttccctctctctcagagtatgttagttatacacgacaaagaagctgttctatatacaccagtgcaatacttagaattcgtccagttggtttactcgttttaaatttcaagaacatcccctgaagctgagatatttatttcaatttttagaattattaaaccacttcaaacaattctaaaaaaaatcagttctaaaatggaggatttagaaactacacaagtttgctctgtagtgaaatgaaactaatttatccctcagatttttattttatttttcaaacacagtgtttactggccaatataattatatttcatttcaattgtacaaaatttgtataggttagaaatactacctagcgcaagtgataatttgtttcaacttgtttgaaatcatttattgattttatgaaatttggaaagtagtccagacttttattctggatacgtccaaggttgaaaggtttttttgacttccgtgaggtggaatttcaaggttatgacataattaattttcctatttttccaaatatattgactgtggttttgatgtgacctaagttacagaattttcctagaggcacaaacgagaaaaaaatagtctaaatctacactaattcagtccacacaatggtctaccagactacctttaacggtcaacactgcactacaccagtgacatttgacaatgatacagctagtgcacacagacagctattacaatcgaaccggtgatcgaactgttaggacacttgttcactggctcattggttaaaccgatcaaacaaccggtttaaagcagttcaaatagatgtgtgttacagtagactctgtggaaacaaggaggtttgggttcgactccttcagttcagcagctttttcctatattctctaactccacgtgacgcccatgcacactgcagcttctgctcctccagcggtcgaaccacctccggtccagttcaattggttttcaccagatcggccgatgctgttctaataactaagcacacagactgatgcttcctactttaacaattttatttttcatgtttgtattcttcaaaagttgatgtgaaatgccgtttctttttatgtgatagaagtgaaaacccttgtatataaaatctatttgatatagacaattgagattaaaggcctccataccctaaccccgatcgagggatagtttgagcaccagatagcagaaaggagatgaacctcctctcttcaatagaaatagcaatgctcccactaattctcgtggctttactacagacacctctggcaactgcatctgtgagaaggcaagggtcaatcacagcctcccgtccatggcgatgcttgtgccagctgccccaagagttgcgggaacctgagcatccactacccatttggcatcggagcaggctgttctggcagcccgacttatcttacctgcgaccactgctggagatgcatcggagaaagaggcattagtgttggttggtaaccctttttttagtcctgttgtgtaatcggtatttttagtcctaattatacaatgtagaattaaaaactatctttaataccggttggtgttattaaccggtactaaagataattttttattttttttactgatggttgtttgctgtacatatatgtatgtatgtatgtactccctttgtttcatattataagactttttctagcattgcatatatttatatgatgttaattattctagatatatataaatttattaacatatatataaatgtgaataatgttataaagtattatataatatgaaagtatgtatgtatgtagataggtacatacatatatctgcatccatgttcttcattctctccatgaccgggtggtgttcgtcgactcttcttatcttggtcaacgcctcgccaccggacgggccctcaccctccatgcgcccgtcgctggcggcgtcgctgctcccgccgccgtagcaggaaatccggcgacgtccagaggaggcgccacgattgacgctgctggtcggtcggctgtgtcacagcaagtgcagctagctagctagcgtccgatgattttcctttagagatcaacagaagacacagaggtatgtttgtggttgctctcatcatcgcccgtggcaaacatacgcgcgcgtctgaatacatgagaagctagcatatgcatgccatggcgatcgagctcgcgtcagattgcatcgaggaagaagaggaagccgcggcagcccacactgcctcgtcttctcacccgccactgcgccgcccctccacatgctgaccgccgccgcggccccagcagcgccggcgaggtcgtcgcagcgtcgtcaaaggtttggatatggccatgagcccatgagcttgtcttttttgcccggaatgaccgcaatgtaattaagataggtaatgtaattaagataggaagaaaaatgttataagaaaagttttacatcgataactggctatcgaggaaggatatgcaccagagcacacgccccgaaccatgtgtcaaccgcccaaacacacgctaccgagagggaaaccaatcaccgaatcggccatcgctatgcgagaccgaccgccaccaggccaacaacaccaccacgacacgaagactcaaaaacgacgccctcacgagggttgcgacgccgaaagataccgtcgtcatccgtccaaagaactggactaggttttcacccagagatccttgccaagagaggaggggtatctcaacaatgccctcagtagggttaccacgaccgaaggcgtagtcactgttggcccaaagaaattgggctaagctttcactcggaacccctaccgccgtggtctgttgcccaatccgaatccaccatctaaacatcggtggcacatggcttccgccacacccgaccgacacctctccgccggccaacttctagtcctgccaacaacaagactgccaccacaccacaccgacgccccgccgtcggccaacttcatcgaaccaccatccctgaaagctggcctacgacccctctgttccaccacctgccggcggcctcctcgccaaatatggccaaaggagaacacgggactaggtggcgttgcttcggcagcctgagcttcccccgctgataagctgccgcctcaatccagcctaaaaacttcccacaaagaaggggggaggagctctagggtgagggtgccgatcggcaacgaggaagacgacccaccgccaccagctccctttgcactaccatctaggcctgcaccgacatcggaaacgcggtcgctctggctccggcgccacccgccagcgccccctttgtccgacctccttgccccacctagcgcgccgcgccgcccacctggccgcacctccaggccagccgcacgccttgctcggccaagcctcatgcgcgtgcaagcctctgctgcggctgccaccgcggcctccgcgagcaccggcctccgctgtcaccaccaccgcagccagccgccaccgtgtcctccacgtgcgccggcctccttcgccggctgccgccagctgccagacgccgccacctccacctcccgtcgtcgccacccgagaacggcttactccggcgtggagtcgccagatccacccgcggagaggccggatctggccgcggcggcgccggatccgccacctccatgccacgtcttcaacctccgctccgcgcaccggcctgccttccacgcgcagagacagggcgccgttgaggtttggcctcgccaccgccatcctggctggccgctcggttcttcagcggcgcgctccggtggcagcgaggggagggagaggaggagagagtggcggtggcggcgctatgttttccccagagtcgcccgcgcgtgggcgacgtgggggcaacgcgtgggttcggacttctcagcgatgagcttgtctcagcgccatcgccattttttttcctctatatttttttcaagagctatttggattttcctttgctgcagtttggggagaagataacggaaagtgtgacggcgatgtatggttccaaattgaataataatgatattttttaatttgatatatttgcaatgatatatatatagatcaaattaacccaaagatatatgagggtgattacttctgcaagaagctaccgaggcagaaattagcaatgttggctgtaacaacatgaattttcaaatttaaaaatcggaataaaatttttaaataatcaaaaatcttttttcaaattacctccatgctagaatttcttttcctttttcctgctgtgctagtgccaaaatagaaaaatgggaatccaatttaatttctaaattcaattatggattcagagtaatatttaaaaaagaaccatgattgaaatatataaattaagaaaatatttgcaaataagagcagataataattattttcctaaacaccccttttatgaattaatatccctttaatggtttattttgcaaataaaacaaatattaaatatttgtgaagatcctttttaaagatattaattccataaggaatcactttacatgtaacctcggttaatacttatttatcaaaaccctacttgtaaactaaatctttcagttttctttatctcaaaaggttttacaatagaagtttaaatgag

SEQ ID NO: 42050 - DNA, 1400 bp, Oryza sativa
ctgtgccaaacccttgccgctgagctgctcagcccgggtgcatgcaaggtgctcgacacggtgccgcaccgcacgtgcccagccaccatcaacccgaaccctgtcgcccgccgccttgccgtggtcgtcgcccggtgtgccactgccggccgcttaccagctgccgctcggtgagaacttggtcgtcctcccctctcctcatccctcgcgtgccgcgttcctatgttgtcgcagcccgcaagatcgtcggcgccgccgcactcggcatgctgccgcgcgcgcttttgtcgccggtggccgcgctcctccagtcacgccaagcgggggaaacgcttcccctagcaccgacgaagcctcccagagactcaaaacgcccagttgttgcctcggcccagaccaatttcgctagcgactcgagctccgccgccacaggcagctatggccaccgggaaccccgtgagcgccgctgtgtttagccaccttggaacccaccgtcgcactcctaggcaccccacaagccgccgccggcctcctttccgtcgagcaattgccgcttcactggtgcacccccataaacctgaagcctagccgccgcctagaccaccgcctcccatcgctccaggccacctcagccggtgtgctgccgtccataggtggccgtggtcccggctggccccctatcgtcgctcgccccggccgtgtcccggaccgggcagccgccgcgcaggccaaccctagtgccggcgccggcctgcgctcgggacagtgaagggaggaagaagagaagcagagaaagggaagagtgagagaccgacagtgagcccaacccgctagtttaaaatctgtgtcactgacgtgcaggccaccccttgattaaaatcagttctaaaaccttatttaaagttcatatgtgtgcccatggccatgaaatggtcagattgaccaggtcaaggttgactatggccccacctgtcattgactcactgtattcctttacaaaaataattgttttactaaagaaaaggttgtgggacctgactgttagtgacagaaggaatttttcctatacaaaataattccaaattttgattaaatggctgaataggaggttttgcaattaatttgatttaattcaaattggaatctttgaaaggccataactcactcgttttaaatcagatttcaacgagacttttaccaaaattcctctaaaatcaagacctatccaatggcactggttttgcattttttccccttttctaagattttgccctctgcgttgggctaggggagccggccattgacccatcattcgccgagcaaattacatttgtgaagaagaaatcacagcagttgacgagggagccttgactgagcaaggcaagtcactacactcccct

SEQ ID NO: 42051 - DNA, 2791 bp, Oryza sativa
aacttattgtaagccatccttgaaattgttatccatattccttactgcctgagtctattatttataggatcgtaaagggccttttccaccccaaaagctagccattaaagtgaggggctcccccacttatatcttaagtcctttgcccttccacaaccaatgtgagactattcaacaatctcccccttcacacattggtgtccctcagcccttcaccgccccttcactgtattcgggccccaccgcccacggtccatcaggtatacgggccccgcaggcacccacggtactattcaacaatctcccccttcacacattggtgtccctcagcccttcaccgccccttcactgtattcgggccccaccgcccacggtccatcaggtatacgggccccgcaggcacccacggtacatcaggccttcacacgtgtccatcgggtcagagatgttaacctagcctggctctgataccaattgcaggatcgtaaagggcctttcccaccccaaaagctagccattgaggtgaggggctcccccacttatatcttaggtcctttgcccttccacaaccaatgtgggactattcaacattatctacgcgtagtcaattattgacactgcttagagatgaatttcttggaacattatgatctcagagtattcttcggaagggaacatttccaaggttactgaaatgtatcaaaggatgagaagagaggtgtctcctagctgccagaccttaaccacagcagttgctgcatttgccaagcgcaagtgtctccgagaaggtgagaaactgcattcttttgcatttaggagtggtgtcagcgatgcaattttggtggcatcctttgtgggttcttatgccaaatgcagcagattggcctcgtcagttcagttgtttgaagaattcagcgaaacagacagctgcatatggccagccttgaattgggggttcatttactgtggacagtttatagaagtaatcaatttgtttgggagaatgttgatttcttcatttgttcccagtgttaacatgctgcaaggattagtcatcagttacagagaacttggtgtgctacggctaggtaaagcaactcatgggtatatgataagaaacagttatgatgcacaatctgagaatagtgccttggagacatccatcgttaaactttatgctagctgtgggagcattaattcggcgcaaaggtgcttcgacagcatccatcagaaagatattgttgcatggagttcgatgattgaagcatacacgatccatggctatggtaaggaggctctggcattgttgcacaggatgctagatgaaggagtaaggccaaacggggagaccttcctgagcttgttgtcagcatgtagtcactccggtcttgttagtgaagctcatgaattgtgacaagaacgtttggcatcacacctgagcttggtcattacacctgcatgatatgagtgttaagccagatggaagaatttggggtgcgctccttgcttcttgcacaacacactcgaacagtaagcttgcttcttatgcggctcagaaacttatggaattggaaccaggtaatgttggctaccatgtggtgttcagcaatgcccgagctggtagtgatcgatgggatgaagttgaaagcattagaagctctatggtagagatggacctgcaaaagctgcctgcatggacctgtcacctgtgtttctaagaccgttagcccttgatttgtattttctatcacttcccaaaactcatgttgatttggtatctatggaagttgctgtgtattgagtatgttggattggccaagatgtctcactgtatcaactgttgatgtttcagtgtgagagtgaagtttctatagatgatcaggcaataaaaggtcctcgactcctcgttgaatgataaaacattccagccttcttggtaacttcagggatacatgtaataagaaaaccattgtaaaatttcagtatcgacagttaccagtgcagtcagcacactacctgttaacctgcttgggagcagtaacagaagccatctagcttgttgaagagctgaagctgtaagtccccgctaaccttccattgattctgcagatgcagcagcttgggtacttcacatttgcaaggcgcagatcgaaaatgaagagctgctgtgaagtggcaggagtgtggtcatggtgtcactctcacaagccaaggtggaggccgcaattacggggcgtcgcagaccaaggccactaggctggcatgatagcagagttgaacaagacctgtatgacaacggtaaaatttgtcgattaccagcccaccgtgccacatatttggagctcgtcatggaaaattttgtggcttataatttacattggttttagacttaaaaccatgtttaagcggcttcttaaccatattattttatggagcaaaggaagaaccattcaaacttctcaagattcagtcaaattctttgaatcgaactgattctgtcccaacagaagactaggaatagcaggtgcagatgatgacactgtatacgagtggcactaatttcatccgtagaagattctatcccaatggaagaccaggaatatcgcacaaattttgtgtgccagcccaagacttaattttttttaggtcagattttttgtagcacagcaaggaaaattttgtggattatgatttacactggtttaggacccaaaacttaagcaggtccttaactgcatcgttctacagggcaaaggaagaaccattccaagttttacagattctatcccaa

SEQ ID NO: 42052 - DNA, 2304 bp, Oryza sativa
atcggaggtgcctaaaaggtttgcaacttcatcatccaatgttttttttgtcatattacatttgcacctatgttttgcacacttttttgtctccaaaatttagttgtaagttgatgagagagaaaatttgtgtggggaagaaagaatatatagaaatttagttcatttgctaaagaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttactcatgtagatgacggcgtgcactatttttttactcattatggatgtacgctgaccggcggtccaaagagtttattgacggcgtgcactattttttgagagtggccgaagctaacaggcaaaggggttttatttgttgtccatgcaataagtgtaagaatcaaaaggagtattctacatccaggactattcatttccacctgtttgagtcggggttcatgccaagctataattgttggacatcccacggagagcaaggtgttgaaatggaagaaaatgaagtggaagacgacaatattccggactttgctcagtatgttggatttgaaggaaataaaacgggcgaggaggaaatagctgctgatggcaacgacgttgcggatgatcttggtcagatgttgcaggacgccagggaggacagcgaaagtgaaaaggaggcccataaattggacaagatgttggaggaccacagaacttcgttgtacccaggttgcgagcaggggcacaaaaggttggataccactctggagttcttgtaatggaaggcaaaaaatggggttagtgacaaggcatttggcgatttattgaaactcgtcaagaacattcttctggggggaaacaaattgcccgagacaacgttcgacgctaagaagatagtctgcccgctaggactggaagttcataagattcacgcatgtccgaatgattgtatcctatatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccatggctaaggcgtttgttcaggaacaaggggaatgctagaatgatgcgatggcacgctgaagagcgtcaacaggacgggatgctgagacaccccgccgatggttcgcagtggtgaaacatcgacagaaaacttaaagaatttggaaaggacgcacgaaacatacggtttggtttgagtacggatggcatgaatccttttggagagatgagcagcggctatagcacttggcccgttacgatgtgtatctacaacctccccccctggctatgcatgaagaggaagtacataatgatgccgattattattcaaggccccaagtgtcacaccccgaagttttcctcccaagccaaaattgtaatttataaatgaccctaagaaaataccggtgcaaatcaggagaaaaccctaagaaagtaatgcaaataataatcggatttgacatgtggaactttttcttgagttctacaggtcgaaattcattaacaggatttttagtggaattttcagagctctagaaataattttaaccaattaaaattgagcaagcaatattttaattccagggaaaatcctttttcctttttctttttctttttcctctctttttcctcctttctttcgaatgggccgccggcccattccctccttccttccctcccccttactgggccggccgcaggccgaggcccagccaggcagcccgccgcctcctctctcggggtcgccgacaggtggggcccacctgtcgggcccgtctccctcctcccgccgatctcgcgctcgcgccgccgcgccaaaaccgccgccgcgcccacgtccccgccttccccgggccacgtcgaccacgcccgcgcgtgcgccgcgtctcccgcgcccactcccctctctctcccgctcgcgcccgcgcccgagatggccgggattcgattttcgaatccctcctctctctcctcccccactccccacgtcggccggcgattcccgcctctcccggccacgtccggttctctctccccctt

SEQ ID NO: 42053 - DNA, 11940 bp, Oryza sativa
tattgcgcaataaattatttaaggatttttgttatagtaataaacacagtgaatcttctaaaattcataactaattcatccgagctccgtttaatcccattcaagtctcattaaatcaagaaaaatgtgtagaatccattaaaaatggttttgttccctgtttcagtagtcttatagcctgtttgcaatgtttgccttgtatgtcgctagattccggcaattccgacgctccggtgtacttcgagatagtcgccgaggttccttcagcagcagagcaaggcaagtcatgcttgtcacttgatcatattgatcctatattgcaaatgtcctaatgttttctttcaaataccgcatttgttttgcaatattactatgggatggttacctattgttacagccatgctattttgataccatgctcctttgttagcttgggttataacatgattagagttaggactagggtttgcttagccatgcttagttcaactagcacacaatggggagatctcatttaaaacctagactataggtttatgtgataatgttggattagtgacaccgcttgggtgttggttaattaaaatgaatcacatggtgggctgtgggtgcatggttctgctggtcgcacccatggcagttaaggaccggttcgcgggatgccctggaagaattcatcgtacttaccacaagccagcgtgggcaacggctgggcttgtagtgtggctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccgggatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtttcaccctagttagcttttggaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtcctttccagttgaagatgtctcgaagaggttggtttcgtcgctgctgtcaaggatgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaccaagcaacctggtaacgacatcgatgtgtacctaagaccactggtcgaagatcttaaactattgtggaagaaggaaggtgtccccgtgtgggacgaggacaaacaggaggagtttaacctacgggtgctgctgttcgtaaccatcaatgattggcctgcacttagcaacctatctggacagtccaacaaggggtacaaggcttgcactcactgtatggatgaaatagaaagtatgtgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgagaaaacagtgtttgctatggttaaagatcttaaagtagtgttcggaaaggggcctggaagccagcctatagagagcgaagatggtcacgcggcgatgtggaaaaagaactctatattttgggagttaccatattatgaattcttggacgtacgccacgcaatcgacgtgatgcacctcactaagaacctttgcgtaaaccttcttggcttcctaggtgtatacggaaagtcgaaagatacactggaagcacgtaataatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacacaatttcgctgaaggtcatcgatccggatagattagaagcccttcagaatgaagtggtgcaatgtctcgtcagttttgagtcgatatttccaccttcatttttcaatataatgacgcatctgctttatcaccttgtgaaagagatcagtattctcgggccagtgtacctacacaacatgtttccttcgagaggtacatgggtgtacctacacaacatgtttcctttcgagatttagccattccgctagttgctgcttatatatgttgattactaataaataatctctcacaacatgaaggtggcgtcgggcatggccatcccaacggacccttcaggtacttaccactgcaggcggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggtgtctcgtgcaccatctcctctggctccaccatctcctcctcgggatcctgcaccgtctcctcctcatgctccgccagcaccgtctccacctcaggctccagcaccgactcctcctcaggatcctgcaccgactcctcctcgggctcctacacctactccttcgcaagctcctcttccggcaccttcaaagtcaagggcccccctagctccaccgcctgcccacacaagggcaacgaagaaggcgaaagttgacgccgccaagaacaaggacccgaggtacgattgcacgcaagaggagcttgacgcttacgtggcatcagaagtcaagagacaattcaagcctcgaagtccagaaaagaagattcctatagacccgagtgtcaggaacttctttaggggtatgtctgcacctgtcaaggaggccatcaagctatcggactatgagcgaacgctgaagaaagcattttctggaaagtccaaaccagtccctcagcttggagagcaaccaaaccaggagatcgagccgttggtgaccggggaagacatgacgatagaagaatttattactgacaccggtctaactacggatcaattgctaggagtcgaaccaatagaaaaggcggaagtgaaatacatgtacgaactcggtaaaccgcttgtcaagcccgagctggtgcagtccctacccacacaaatgtacaagttccatcaactgtatatggagatgagcgccaccggtagagagatgatcggagcgaggatcagggacccggacttcttgcaaggagatgacattctctggatcaatttcaagggaatctacgaactataccagctggacgcccttgacgtctctattatgagttgctggattttgtaagtatatcgtttagttatatttcttaattactacgtctcctttaattaattaggtccttgtatataagtagactatataaaataaaatactcccttttatcgttgtagaatggagattcaaagggcccgacggcggagggttttcgatactggattcatcgaccctcggaaagtaaatgtcgcaatgctcaaccaatatccgcaagacacagaggacaatctcgtctatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtactgtcataagttcctctgttaattaagaaattcttgttatgttaattatttctactacgaatcatatctttaaactccatgtagggcttggtattggttccgtcgtttggtccgcggcaactggagagaaagacttaggcggaagttcaaatttcctgtgagtacacatgctctacatttatatttcttcgattcaaattaatacatacaagtgtatattaattagatctcacgccgttaatttgtcatttatttgtagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttatttgcatgagggataacctgaccacacacaaggaatttatcgcggcggttcaagaacaactcatgtgattcatcaacgaagaaatccttgatcccaagggtgaattctactatggcggaaacacaattcacaggtccttagcttctgagctagcgactactactacgtcgaaatcgtagctagctaggacatataatggattgtaattaatacatgactacatatgtttctatatgcatgtgtacacattttctataatgtaaatatattttggtcatatatatatatatatagacacacacacacatatgcatttgcataacatatatatgtataaatacatatatattatgcatgtacatatgtactgaaccatatatacataatatatatatatatatatatatatatatatatatatatatatatatatatatatatatatatatatatatatatatatgtatggtttatatatatatagataaaccatgcagcaacagggccatgcaaaaaaaaaaggtcagcttgatctttagtcccggttatttcacccgggactaaagatagcgatctttagtcccggattggtagtcccagtttggaaaccgggactaaaggggggttacaaaccgggactacaaagggtttctccacccgtgtgtaaaacaaaataaagcaaacaaatactcaaaaggacatactccctccgtttcacaatgcaagacttgctagtattgcccacattcattttgatattaatgaatctagacatatgtagattcattaacatcaaaatgaatgtgggcaatactagaaagtcttacattgtgaaacggagaaagtataaactttttttagataatggtaacaaagaaaaacatagtattcagtcaaaaaaaataaatcatagtaatactatgttttttttctgaaaagaatcatatgtgctattgacttttggatacacgtttaaccattcgtcttatttaaaaaactttacataattatcgtttattttgttgtgagttgttattactaaaagtattttaagcataatttatatcttatgaatgtaagatgaatggtcaaacatgtgtctaattgttaacggcgttatctattaaaaatgagtacatacatggacatgactataactatgaagaaaaatgttaagtaacatgtaataagatatttcgtcatgcgatcggtaagtatgaaattagtgtaagtttagttccaaatgatttaatctagcttttctgcttgtattttaatcaagtaactaataataagccttatatgtcttcttatcggaaattagccttccaaaagtttgctaattcatctcatttaaacaagttcaacaaacttaaaatttcagtacagtagtgcaagttcaatacccacctttgtctgttttttgtgttagaattttaatcgtgcatgcatttgttttatgattggcctaacgacatgttcgctaactaatctctctttactcgagtaattaacctatgtcaaggttagggcagtcctatattgcaagacctatgattcaattaatcttttcctgtaatttaatgtatttatgagcgtgttggaaggagcgtctacgaagaaaaggtcaatgctacgacgcccccattaattccacaatcttctgtcttcacgtttggaaaatgaggaaaatatctcgacgaaacgataaaaacaaggaaatgtaaataaacaactaaaaatgagtgaaaaagataagtcaacgagaaacaggagaatatgatgacactcctccatcgctcgatgatcacttcatgttaaaaatctctatgacatatattgagatctcgctatctcgggcaagatattatttgaacgtgggaatttggttggattttgtccaaattgcttgaaattcaactaaaattgtcaaaatttaaaaattttcccataagtttacctagagatattcctatcttgtgtgccctacatatttcaatgaggtcgaaaaaaaagccctacatatcaatgtttcgcttagcttaatgcagtaacacaggcattgggatctcgatcttgttactgggtgcttcacactcacacatcgtaactctatagttcgtggggtgacaaaaattggagtgccttcccaggtttcttttcgattcgagttctaggaccagcaccgtagagagtagtcacaatgttaaatactatcagtagtttctatattttccggggaaccattgtttatatataagacagagctataaaactattcacataaaatttgtcctggcagacaaatttgcgtcgttatgcacacactcgctcagcaaaaatgactcaggtggccaaagtcctttcgctggatttgaggaggcactttgccccccgactatcatcggttgcatctgatcaattcacatgcctttgtgccctcctggctgagcacccagtgacaaatggccaaatggatgtgcgtaggtcaattcataacaatgatattctgaagacaagccatgcatacctagctgaatgttgcggacttcccccctgccccaacgggaagtttatatggaataataaggctccgctcaaagtctagttctttgcctagctcctggctaaagatcgactcccgacgaagagaatccttcataagaaaaacattgtgtcctcccctaactgtgatctttgcaattctcctgaagaaacggcttcgcatttgtgtttgcattgcccttttgctgtggcattttggaacaaccttcatatccatatcaacattacatcaatgagcgagctggcctcccttctcctgcctcatcaaattcctggcaaacattttagggtgttttatctcttgtgcttctggtgcctttggaatcatcgccatggagtggtcttcagacatgaagaagcttccctgctccggattttcactatgtgtgtcactgaagccacaatgtgggctgagcgactaaagtttgatgatcgtcatgtagtctcggcttggaaatctcttttttcttcttctattcgctctcttgatgtataactgaacttcctgttcctattgcgtcctaatgatcaatgaattcaagtggggaatctccccccccccccccggtgaattttctaaaaaaaaaagataaggaaaaaaaaaccattcttcaagatcaggcaagaaactagtaccatatgtaactctactaatacatatactactactttaacatgttaatttaataccactaaactcttatcatattaagcatattatgtagtagaaaagtcatatttttcatgattaaatctcttgctacatcaccatcaatcttaattgttagctcaactttagttctatgaaaccatccaaggtggagcattgagaatgcccttacctatgcttggacatctgcagtttgtgaaggttctttgaattgtttttgggtacttttcattgttttctgaattttacatgttccaaaatgactttaatttgattttaaaattttacttgtgttgttccaaattctctgagcatggtagtttttttttaatttttttaattattttaacagtatttttaatgcaatatatacgtttttattaatttggtggtttcgacctaatatttgtttcaatccaagcccatcgccgtggcactgctttctttgaaaagcacgtctcattcaaaatcgcagaattaatttcaatctattttttccctcgacgcatttattatccagccttatttttatgtttgctaataagaaatcctagcttaaattattattgaaaataacatttcaaaatcttatctttttagggaaaaaaaagctaaagtggggctaatatgatgaaaaattggataatgtgccattgtcaaaactgggtttcgccgaaatgctaccccgcaaaagagattcgttaaaatgccatttttcaccccgtggctacaagctataatgctatccgagaccaaattgcccttgccttcctctatcccccatcttctcttccaactccggctatccctgttttcctcatcctctggcgcggcggtgcagatggggaaaaggcagcaccgagcacgtgcgttggctggcggcggtggtgcaaatgggggaaagaatgctgcgacgcagatagggggagaaggcagcgacgtgcgtgtgcttcaggcggcggcggcgcagatggggaagaagggagcggcgcacgtgtgcatcactggtggcagtagcacagatgtgaagaagacggtggcggcgcagatggggaagaaggaagcaactacacatgcctaggtaagaagaaggagaacgagggtaatttggtcccgtatagcattgtagcttgtagtcatgagttgatattggcattttaacaaatcccttttgcggagtggcatttcggtgaaacctagttttggcaatggcagaatgtccaatttctataatatgacatgctgagatagctaaaacgcatgtcattgaggccttatcttttcgctcatgcttatcagcggaaactaaaatttgattgattttaggtttttttatcatcgtttattttcccgtttttttgcttttaaatcattaagaatacgtatataaaagttttattttaaattattttttatttataaatatgtcgcttgacttagttcctgaaataagacaaacgatcgggctgtgaagttgtatgtaatgaaagcaaatcaagtagggctatcactacagtagtaccaaaagtaaaggagaaaccgtacataatttgaaagaaagagaaagtcagaaaaccacataattatgcatggctctcgctgcaacttggtccgtgacccacacgagtcctattaaaaaaaaatcaaaacagcagtagttgagcttatttaaaaggggagattttcttttccttttcatttcgagtccacatacgtttggaggcacagaaaaaggaaaaaaaagaaaagaaaaacaaaaagtcagaacatctgcacttgatttcttattcacgcaactccattaaagtctaaccattgacttttttcccctgcccgctcttacacggcacgtctcattcaaatatgaactctcgcacagtgaggaatcccaaattgagaaggaaaaaaaatgaaaacaaatttctttttcctctgacttgtagctctacaactacgcgtcgttttctttattatttattcgtgtataaaaacttttcctttcttaattcttgccaaaaaaaaaaaactggtcacgaataatcgtctcctaaaaaaaaaaagtctctagtctcagcgcgataattctcccgcgaactgcgcactgaccccgcgtgaccaattgacatgtcggccacccaacaagtgggcccacctgtcagtgactgtgggatcagggagcgtctggttcgctcggtacgcgtagcgcgatgcggtcgcttgtctcgtagttggaaccaactagcccccgtgaccccacaacgcgtcggattctgattgggcgagacccacctcgtggccactgttgcatggtcaactttcccacccatccgagccgtccatcccatccaacggcgcgtacggatccaccgcctgacgccggtggcgccggtcgacgatccatcccgaccgtccgatcgggctcgcgcgttgactataaccggtccacgccgtgaccgccaccggctgctcccggtgaccgcgtcgcgtcgttttataaccccgactacgttagcctcctcccacttcttcttcttcttcttccccccatttctcacttactccggcgatcaccgtggttgagcgtcggcggcggaggaggaggcgatgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggtaaaaatcttcacgactccctccatttcccccacctcgaattgaactcatcggaattaattttccaggaagcatcgggtgaagaggacgatccgcgtgccggcgataagctcgaaggtggcggacatccccgccgacgacttctcgtggcggaagtacgggcagaagcccatcaagggctcccccttcccacggtgagcaccgcactgccccgccgtctctcctcactccgtcgacattaacactcaaaactaatcgtaatcccctcatttttgcagaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcctgagatacccccggtgaagaagagtgagaattagcttgtcggtcatcataattaccgttagaaattat

SEQ ID NO: 42054 - DNA, 9856 bp, Oryza sativa
ttttttactgcatcattgtagaactagcgtgtaaatcaattttaggagactttgagactgagcttttactgaagaaaaaataaagcagaacaaaaaaaaaagagaagaaggcgatcgagactatcagtagagtagagagtagaaaaaggcgtgccggaattgaagattttgaccgcgcatgcgaatttgtttatcaactcgggttcaatcccgcggattggggtccggtggaggtcaaaaggaggtggggcccggggtgttgaacgttgccccccgcccacggtcctcgtgcggggcccacgcgacagtgacggggagggtccctcgtgtgtgtaagtgtggacgacgcggtcaaagaacgcggcgtggggtggggcccaccacggccttggcctccggcgtccgcctcgcccgcgctgccaacgttgactcgtgtcagccaggctggaatcggattcgctacgcctctctgtctcactctctctctctgtgtttcgtatcatttcgaatgggacattcgagttcgatatcttgatgcgctgtttggagaaagttttataatagaggaaattatcaactttaattaagtatgataatacaaactgatattataatatggagtataaacgcatacgttcacaatgtctcacatctatgattactcacgcacaccctacccttacatatccagaagactttggtgatatattttatattgatgaaatcatcgtagacgtctgatcgtcaaccggtgcattgctaacataaaaactaattaccataaatatgaatacctataataagtgtagaaattgaaattaggtggactggttccatcacaagaaaatctaaccagttgacccatgctataagaaaatatgtttataaagttcttttaaaaaatacatttggatggtttaggaagtgttctcaccataaacaaccgagttaggaagatttaaacgtaattacactacaattattttatatttatatttgataaattttatgaagaaaaattgtcatcaaatgtattgaaaatttgatggggattatgtattggggtgttgctgtttgtttatacctgtaggaccatgatgtgttacatgaaggattgtcaatatcccgatcctgactatcttggttacatccctactacgtttaatgaatggagtagatcggatcggaaaaaaaaacctcaatcattgtctagggaagtagggattatattattagtatactactcccttcattccaaattgatctatatatagtttttttaaggttatttttaaatgatctacgacatatttatgttcatttattaagtctattcgttatttgtgcattggagtaaatggacattaatgcatgcatccatgcatataagtatttataacccacatgcaatatcttgatttgctattggttaggaaatagtatggatggtgtatgcattgagtttgttgctaaagtaaatatagtataagggcacctacaatggttatctatagactctctacaagagatccatgtcagcatattttcctactggaaagagattaaatgaagagagagagcaaaactatctactaatctggaaatagtctatagagaaaaacgaggcaatggattagagcaagttcaatagtatagccaactaccagctccaattcatctatagccaatctaatagctcattcatacaatagttacatgctacactattaatatctggtcccacctgtcatgcacacactgtgtcttggagtccgtgatacagctggctacaaatctgtagcccgctgcccttctctctcttcatttatcttcttaaaatatgtttgcagctggcttatagcctgctattgtacctgctcttagagagctatagatacccatgtagacatgtcattgaagtggtttactattaatctagtctattgctgagatgtacatgttttatagatagcaccttactttaccattgcaggtgttctaagagagttattagctcttttttttatcttggtgtacctatgaaatatgtagatcaatttgaaatgggggagtattatcatggtgattttgctagatcttgacagagattttattgattagtggagatgttgctaagccatgagattatacgtggtgtttactcatcaacctcgttcctaattcccgcattacgcgtgagatctcctccggatggagactgtcaccggcttcgagctataatgacgtgatctctccgtttcatattataaaccgtttgatatttttctagttaattttttttaatttgatgaagtttatagaaaacatagtagtaacataaaacaaatatattataaaaatatatttaatgaagctaatttgatattttatatattactaaattttttctataaacatgatcaaacttaacatattagaaaaaatgttaaatggcttatatataagatggagggagtagtatgaatgaggagtggacaagtgaatgataggagagagatccaacagtgttgagaacggctgtttgacttggctgggaggcagcctgcatgggtacgtgtccgtatgcccactttgatacatctccgttctaaagcacgtgacgctggtcccacctgtcagcgagcacctccccttttggtttggcaattctggtggggccggaggatgctagggagataggttgggtttggattgatttttgctttggaatttggtttgtggatggaagcggtggcaacgttggaaaggaaaggggatgaaaggaggagatattggtgttggtggtgggtttgagagagcaaaagtcaaaacggcatctttcatctttttgtgtccagaggggaggggggcaggtgggtttgtcccattgggtgtgaaactgtgaatgtgtgctcttgtgtccctaccaccactatgctttggaggctggatctgatgtggccttccgccttcgatgccgtctaacctaccactatgagcaagtttaatagtatagctaactactagctctaaattatttatagacaacttaatagttaattcatacaatagttatctataaatatatactacacaattaatatatagtcttatctgttatacacatattgcgtcttagaatctgtgttgcagctagctataaatctgtagcccgttgcgcatctctctcttctttaatcttctcgatatatgtttatagctagtttataatatgctattgtacatgttctaactgcttgttcgactagtcatttttgtggttgtacctgtggttagggtttactccctccgtaaaaaaaaagacaaaccctgggtttttgtgtccaacgttggaccgcccgtcttatttgaaaaattataaaaaatttaaaaagacaagtcacgcataaagtattaatcatgttttatcatctaacaacaatgaaaatactaattataaaaaaatttcatataagacggacaatcaaacgttggacacggaaacccatagtttatctttttttgacggagggagtatcttttaatataaaaataaaaaccgcttctcatggtttatcgaaaaccgataaaaaactgttaaatgtggatagaaatgattgaacgagagagattgagcgagagagagaattgaacacaagtagagcgaatcgatggatttctcattgatcaacagttcatttatacaatgtgaagcggtgtcaaccgcaagggacgcgatgtttgtcgagagggacgccaaagggagagagaggagcgatctcctcttctctgccagttagtttaggaaccgttgttcctattttcttgggtggatgagatcacccgtagtttcttaacactcccccttgatcgaatcaacctgtgatcattgcttatttattgttccaggtatctgtaaagataatcttagaaacgataaataattagtaattaaatatatcacgtaaaactcctcgaaaacccagtgggaaaaataaggagagaaccatgatgtattattgactatttttagatctctatgattaaagctcatagtatgatccaaaatagtataatgtctacagttattatttagtaaaaaccccagtggggaaaagccaaatgataggacatataagcttatgttgatattatctcgttaaaaactttggatgagaaaacctaaagggtaaaactcatacaaaggaaaaagagtataatatcacgaaaataggttattttccagaggaagatactccccttgaatcctgcaaatttttaagtcgtctcataccaattccttcgacatatttaaagaatgtggagtatggtagagattttgtgaataaatcagcaagattatcacatgacttagtttgcaagatatttatctctccatgttgctgaagctcatgaggataaaataatttaggagcaatatgcttagtgatgttgctcttaatataaccagttttcatctgaacaacacaagcggcattatcttcatagataatggtaggtgattccaatgaaccaataccacaagatgttaatatgtggttaaccattctgcgaagccatacacattcacgtgacgcctcatataatgcaattatttcagaatgatttgtggaagtggctaccagagtctgtttagaagacttccatgaaatagcagttccaccctgtaaaaatacgaatcctgtttgtgatctggcgttgtggggatcagatagatagctagcatcagtatacccaattaaagtcgaatcctggttctttttaaagaaaagtccaagatctcttgtgccattaagatatcgaaagacattcttaactccagtccaatggtgtttggtaggagcagcgctatatcttgctaatagattaaccgagaaagcaatatctggccttgtactatttgcaaggtacataagtgcgccaatagcactaagatatggaaaatcaggaccaagtacatcctctccatcttcctttggtctaaatggatctttctccacgtctagagatcgaaccaccatagggattttggaaggatatgacttgtccatattaaatttctccaaaattttctgggtatatgcactttggtgcacaaggattccagaaggtaaatgctcaagttgtagacctaagcaaaatttggtttgacccaaatccttcatttcaaattccgtctttaaatgatgacgtgcttcattaatatcttgtgtattgccaatgatgctgagatcatcgacatataccgaaataatacaaaatcctgtgggggactttttgataaagacgcacgggcaatcatcatttttagtgtatccctttagcgaaaggaattcacttaatcggttgtatcacatcctgcccgattgttttaagccataaagtgacttctgcaacttaacacaatacatgttacgatttaccttctgattcgggatgtcgattccaccaggaaccttcatgtaaatatcagaatcaagtgacccataaagatatgctgtcactacgtccatctactgtataaatagacgattttgtactgccaatgatattaaatatcggaaagttataccactcataactggagagtaagtttcattgaaatcaacgccaggtttttgcgtaaaaccttgtgctacaagccttgctttatatctcaccacctcgttgttttcgttccgtttccggacaaaaacccatttgtatcccatagggaagataccacgaggagtaggcattacagccgagaatacatctcttttgtaaagcgaggctaattctatgtcaattgcgtccttccatttgttccagtcaaagcgcttttggcactcttttatagacctaggttctggatcaacttggaggcattcagcaatttgttcagaaaaattagtgtcgacaattgtagctcttctatcaaaagattctctagtttcagagtaattgatggcaatttcatcaacccttatagactcattgtgatctcccgaaacaatgtgtctatggtcttccgaattcctagtctcagcattgtgcaccaccgagctaggttgcagactatcatgatctgcttgacatatagtatcaatttggtgtgtaccaactaaaggttggtttgcatttaccgtctttctttgcttattagcaattgtttctcgctgagtggccatacttcttcctctctttttagtgagtggaagttgagtggttttatttggtacctccactctttctggcgcattctgagcgggaatgaaagatttagtcacacctttaaaattggtaaatgcatctggcaggttatttgcaagtctttgcaaatgtataattttctgaacttgaagttcagcttcagtagtacgtgggtctgagactggaataccctgggcatcccaatcaatttcctggcattctttctggtacttgaattctccccctaatgccggaaaatgttcctcatcaaagatagagtcagcgaaccgggcaataaatagataacctgtttagggttctaaatactttatgatcgacggagatttgaatcccacatagacccccactttcctgtgtgggcccatagcggtacgctatggtggtgagatcggtatgtatatagcacatccgaacttacgcaaatgggaaatacttggaggatttccacgtactaactgcattggggaagtttcatgatatgcagttggtcgtagttagacaaggtcagcagcgtgcagaactgcatgaccccaacacgacgaaggtaatttgcaattcatcaataatggtcgagcaataagcttaattcttttgatcaatgattcagccaaaccattttttgtgtggacatatggaacagagtgctgaacctgaattcccaatgccatacaataatcatcgaaagcatgagatgtaaattcggcagcgttgtccatacggattgattgaatcctatgttcagggtaatttgccttcagccttataatttgtgacatcaatttggcaaaggcatggtttcgtgtcgatacaagacacacatgagaccatctagtagatgcgtcaatcaaaaccataaagtacctgaacggtcaagatcttggcacaatagggccacagatatctccttgaatgcattcaaggaatttaagtggttcggctctgattttgagataagatggtctcaaaatcagtttcccagtagcacatgcagtgcatacgaaatcagaggatttgggaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttgtttcgttaagagaagaaattcttctcgattatccatatgagtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgctcccagcgatagtcaaaactttgccttctctctttttgagagtttgaaagtatttgatctccctaagtatagagtttgtggtaccactgtccacaagacataattcctctccaatcggagcgatatccttagacatctataatgaaagaagaattgcatgattaagaattctttatccaatatatatacatacatacaataattaaaacatcaaatacatagtatgacgtttacatatgttaatagtacatactctaatgactagcaagccatacaaccttacaatacaagggagttcgtacttatctacttattacaaccaatattatttggcaaacttataggatatcaatatactgtttcaatcacactgagataagggcagcttcatctccaagtgggacgcaccgagatcattgcaaatctccaagtgggtccgttgagcagtattcgatgaacatatcgtccatcgtagagagtggagcgacatcttctgggagaacattgaggttgctctctggttcagcaggagcctggtgagaacttgcaacctcagggtgctcttcatgtgtgagattgaagtgtgcttcaaatcttgggttctcagaagattttttgtccttgagggatttttggtacaagaggacaagatgtttcgggatgcggcagtctttagcgacatgagtgtcagatccacacctgttgcaatgcttgttggtattgctacgaggttgtggtgccttacccttcccttttcctttctttcgacccttgaatttgcgcctgttgttggtgcgtttgcgctttccagtcagattcttaggattattcgaagaatttcccttgaatcctttcttattctcagcattattctatacattgaagtgcacctcaggcagtggagcagagcccggtgggcgctgttgggcattctttaaagaaagctcagggtgcctttctgcctgagtcaatgtatgtataagcagagaatgtttctgaaaattgttagcgcgatactgttgagtcagtatcctgtcctccggaagtatagttgatagagttttctctatcttctctgcctccgttggctcttgttcgcaaaacttcaacctggaacaaatgttatgaacagcatgattgtattctgccacagtttgaaagtcctgtaggcataaatgaacccactcataattagccttaggccaaatgagttccttttgctgatcataacgctcttttagagctttccaaaggttgagagggctcgtctctaacatgtattcatgtttgagatccttgtgaatgtagagtctcaaaagaaaaagggctgtattgagcttcctgggctcaattgccggatccccatcattaggctcctcaattgtatttagaatctcccgagaggcaaaattgattttgatatcagaagcccagatgggatagttagtcccatcgagggcgagttcgtcgaactcttttgttgccatgtccctacaatcatggttaacattatcaatttacagaggtaaattaataaaaacatgatattaagggtgtaatctcaatgcgaaatgtaaaacttcatattctgtaatgtttcgaaagatgtaggttatggacctgacaattttgagttagaattcgaaattaggtggcacaatgtggataatctctaagtaattaaacagtggagtagatctcttaatagtgggcaagttatacttgctgcctaaaacacggtctccaggcaaatatattctggtgaatataccgcagccaatgtttaggactccactaccttgtgttcaaccaaatttcaaataatctcatttctcaaaacatattcttggaaaagaacacatgtgggtaataatcgtgagatgtagacctctgtgagatgggcgaggtgctcgccgcctaagttatgaccagtgcggccaatttctaggactccatcgggtaatcatctcaaaatgtagaccactttatgatgggcgagatactcgctgcctaagttatggtcgatatgaccaaagtataggactccatcgacatgtgattaatttctaagtcaaagtgtgaagtggaacatgcattaaatcctccattaattatgttggacataattaaaagaatttgctaaatcaaaatacaaaatttatagaattttgtaaattaataaagcgagaaagt

SEQ ID NO: 42055 - DNA, 1573 bp, Oryza sativa
ccggccggattaggccgacggctcccgatcctcatcggagtcggaaaccggccgagccccgacgccattccccggcaccccgttagggagtgtacggctaggagagccatggggaacggcgatgaaggtgtggcggaggccgggacggcgagcggcggcttcgctggcatgacgacgagacgaggacggattgaagaatggcggctcccccgtgcgcgcagccatggtaccggtccaaccggaccccggtggcgcgggagtgggggaacggcgtcggcgtcggcttggggtcggtagggctggtgaagcagcggttgatggtggcggcagcgactccatctccggggaaagatcgcatggctcgccgggcagagtcaccactgccgtccatccgtggtgggcgcagtactgcaccccttgcacacagatacggcgaggcactgcggctaccggagatggaggcggaggaggagcaaccggagtagcggccaccacgatgcgtcggcgagggtggtggcgtcggccaccagccctagcccgacgttcatggtgttggtggcggccgtggtggcggcggcgactcctctccgatcgatggagaagatggggaaggcgacgagcgcgctgattgcgagaaaggccgagaacggcatccataatccaatgaaaggtaggcatcgtaccttctcagttgattcttctgttcgcttttctgttagatcaaaagcgatgtttcttcctttcacttcgcgatctccttcgcgagagcgaaagtgctgataacatgttaaatgtggatagaaatgattgagcgagagagattgagcgagagagagaattgaacacaagtagagcgaatcgatggatttctcattgatcaacagttaatttatacaatgtgaagcggtgtcaaccgcaagggacgcggtgtttgggaacatcgcgtcggttgtcgagagggacgccaaagggagagagaggagcgatctcctcttctctgctagttagtttaggaaccgttgttcctatttccttgggtggatgagatcacccgtagtttcttaacaaaaaaaccgtaagttttggtcaacaccgtacaaaacccctaaaaaaccgtctaatactaatacggatcgattttgacaaaccgagatgtaacggtttcacgatgatgagttccgtgaaccctggccataaacctgtactcctatgttgcagccactgacacaagacaccacaacagctgcaaaagtcaacagttgaaaggcgtggtagactagtagtaggtggtgcagcatgacgggcggagaacctcaaaaaagttacactaacaaaagaaaataagaaacctcaaactttatttaagaatacaatatttcattagggaatctaaagtaatgaaagaaataacctttcttccaacctgattgagccacatcatcaattaagtatatgcgtgactatatagcttgttaaaaaataattaactactacgaggttgaaatgttgctttaaaatactactccctccgtcccaaaataagtgtagttttgcactattcatgttcaacgtt

SEQ ID NO: 42056 - DNA, 5169 bp, Oryza sativa
atttttcaaataagacggacggtcaaacgttgaacgtgaatagtgcaaaactgcacttattttgggatggaggtagtatgaaaataaatccatctacgagtttgagaagtatgttgatgataatactccgtatattatcagccccatcttttggcttatgcttatgtttataagccaaaatttaaattttcaacttaaaatttagagctgattttagattttttttattatagtttatttttcagcctttagttttacttttagaacactaaaaacacatgtataaaaattttatttacaaattatttttcgttaaatatatcgtttcgcttattccgtcggagtccaacatgtttgagtgaaaagggagcaaggggaaaaagtatatcggccgcatccttgaacacatcaacacgtatgatatattttttattttatatgacataatgtaaaagtacttttatacttcggtaccatatgagctttagtaaaaaccatttgccttgtttagatcttaaaaattttggctaaaaacgtcacatcaaatgtttgacacatgtatgtagtattaaatgtgggaaaaaaactaattgcacggtttgcatgtaaatcgcaagatgaatcctttaagcctaattacgtcatgatttgataatgtgatgctacagtaaacatttgctactgatgaattaattaggcttaataaatttatctcgtagtttacagacggaatctgtaatttgttttatcattagtctatatttaatattttaaatatgcgtccgtatacttacaaactttacatccaaataactaaacacccattatggtttgagggaagaccggaagagggtatttcacatggttcgaagacctttgagattagctttaaactatggttgcttgtaacgatgtcggaggttcagaaataaactttgcctctttcacatatgcagtaggaaatatactactacttcgatctatgtggaaaatactgtgagaaattaagaggccttctcattcaatatgcttgtcgaatatccctctcagtctccaaccgtataacactgttacaaaataaaacaaataaacgcgtacatgcatttttatcattacactggccatggacaaattttgcagtggcttcgactaagttcgtttaggcaattggggaacgactcctcgttcatcataagcacactcttttaagtatatattaaactgtgtgttttatataaaagttttctgcgtagaaatttctaaaagatcaaacaaacaatatcaagggctattcagattgataccattttcaaccataccattttttttacaaaattgttaaaaaaatatctatgtttagtttgttgctaaatttcataaatacataagaaatcatgtgccaaaattttagcattgccaaaatttgataaggcatattttggctataatatgaacatatccttaattttataataattaatattcaactaatcctgtactaatgacttatctcgctccgttatgccgtaggaaattccaacccaacaacctatccattttgagccaaataaacaaaaatacaattttatcgtcatatatattcgccatcgacgaattttttttgagcggcttcgtcgtcattgacttggacttattttgagtcctcctagactaatatggcaagagtgctgacttcacaatgtaattgccgcgcaagaatgcaatattaatgcaaccggctgctatatgctattccctccgtcctattttaagtgcaactatgattttttatacacaactttgaccatccgtcttatttaaaaaaaataaaaaaattaaaaacataagtgacgtataaagaaccattcatgttttattatctcataacaataaaaatattaattataaaaaaaatttaaataagacatatgatctaagtttggcacgaaaacttatggctgcagataaaatgagatgaagggagaagggagtagctagctcatgaaggcactgacggccatccttgactttacttgtcagcatactccataaaacttccaaatgcacacctactccaaccgtgcaagttatacatgactttgaagactcgacgacaatcatgcatgttggtactacacatcatcaccacggtacaccgattgcttatacatctcaagttggcatttggcaatgctcaatcttgttatatatatgccctttatcttcaaggaagaaaacctcaacttcaaattgtatatatatatatatatatatatatatatatatatatatatatatatatatatgttgtttgtacgcaaaaaatgatatattaggtgtttgctttgttgttttgctaggaactttgtcttaaatggggcacatgtgtcaaaccgttgtcccatgctatctatataggctgcctcgcctttctagatgatctcatactataccagtatatacaatatctagagtaagactaaagaggagataagtagatttatactcaatctatgatgttgagctatatatggatgatagtgccttgataagtagtagtgggagtatttgtggtccattgtgtaaagtgtaaagtcttgtactcttgtgtgctataacaaaatgggatttcatttcacgcttataatgatatactccctccattcacaaaagttatacgtattactttaatttatcacacaaatgctatgtttgggagcttaaaattctaagaagtaacttgttggtatgagaatatggaaaagttgggtttctgaacttctggcttctacttcattttttggattatacaactacaacttctcaggttctgattccgagagaagcaacagcagctagaagctctccaaacaggctcaaactaagggaactcaaatccttcgtgtgtttaatggtgtccacacccacaccctctgacctctgtaaattgcctacctctgttagggggtgtttagatttagaggtgtaaagttttagcgtgtcacatcgggtattatatagggtgtcacatgggggtgttcgggcactaataaaaaaaaactaattacaaaatccgtttgtaaatcgtgagacaaatttattaagtctaataatctgtcattagaaaatgtttactgtagcaccacattatcaaatcatgaagcaattaggcttaaaagattattctcgcaaattagtcacaatctgtgcaattagttattttttagcctatatttaatattccatgcaggtgttcaaacgttcgatgtgacagggtgaaaaattttagggtgagatcttaacagggccttaattgcatacgcacgaactgtctttgctattcatgcagtccatcaatcttgctcaaaaggagacccttggttgccaaatcaatttaactagttgaaaccccgcacgttgcaacgtgatattttgttaagattggtggttgcatttggtaaattgaagtgatataaaaattcctcactattgaattgggccatgattaaattagatgggtctcccgtagtggaaaatatacatgggcctcacatggtggatgtgtgtatgggttgggttgtgtttagaggcgatcaaacgactcggaattgacgatgatgtgaaacattgaggtttgagctttaggatcttaattgcagttagtgggtaactttatagtaagaagagatcaacgcagataataattttttttagaaaggttacagcctcatatgaggattttattaaactaggaaggtagcccgcgcagttgcgcgggcatcttatttaaactatcataatttttgttattaggattttgaatattatgacttttgtctctcggtgaaagaatttgaaggttctttccaacacatgattgaaaaaaatatataagtcagaaacatgttagaaatgcatgtgtgaaacaacgaataaatgaattttggacagtaaacgaattttttacagagtacagcaataatatgaatgttaaaatttgttaacccacatagatgaaatcatcatctttcattgcataaataaattgcagttaaccaaacaacctttgcatcagcagcttgattttctcgatcccatgcgaaggaaaaaaacatgcgcatgcatcttatttctattttattaattttattgccattgagatataccgcaactttttggatatcagctaatcgttagatgcaccgtgcatggatacctcgtaagcaatatgatttgggaattagtagatagtggtagtgtggatatacctcataagttataattgatagtatacatattaagcgttttagtagctttctaaataacttatcggattggctactcccttgtccaatatatctgtaaagttcatcccactaagtgcagctaatgctaattctctcttctctcatgaagccacatcatcttaattgtttttagcccttggatgattcatcaagggtgcaaattgcatttcttctccccaaaagccacaccatacaactcaaccatttataacttttcaataattgatcaaagtacaaaatatacaagcacatgaaagaaaatcatatagtaaataagatttttttttctacagctcatatctactattttatcacacaaatctcccgcagcaatgtgcggggtacccatctagtttatagtgagaacgtttcccggactactaaacgtgtaatattttatctttttctcataatttctatgattttatctaatttattatagtatcatgtatgaatttaagagtgttcataagatgtttaatggactttaacttttctatgtttatttttgcatggtatcgataggatttgaatttttcatcagacttactataatgtattcgtgcaaatcaaaagatgcaatcaataggaatcccaatcgcatactttttttcctataatctaaaggagctttgaattttaattttaaatcccaactatacttttgagctgagtacaaactttttaacggtgtattgccttttggatttcacaaaaaaaaaatgaaagagaggaacatcggaccggcgtgggtacatacttatgtgcaccttgaagtggggacttttagagataaatttaattggtagttttttaagatagatgtaatggataaaacaatagtctaccaaaataaatgaaa

SEQ ID NO: 42057 - DNA, 47011 bp, Oryza sativa
atattatcgggtccaccattttaaatgaaaactgatggttatatattttttttcagaatttttctctaatttattagaataccatgtgatggataagttttttattttttcgtatagtagatctaatttatttatgcatgttttgtgaaatgatacattatcatgtttttctattttatataataattttaatagcatggatatgataaaaactaaatatttcttacaagttaaattacagattatattgccttttgaatcgttaatggaccacaatggatagaataatacggaagaataaaaagttttatgtgtaattaaaaattaaccacattttttataaattatggttattttaaatttattaattttttaatattttaataactaaagaaaaagaagaagggggagagcaggaggggagggaggaggcatgtaagtaccttacgtacgtcgtacggtacacattggaaggtgtgggccgggcaggaaagatagggaggtgggttatgtttttttttgttaagatagatttgataaattaaatagtaagaaataatgggtccaccaatttattagattgccacgtggcgatttaggagcgtttgtaggaatcccatgtggcgtcttgagagcgtttgtaggaagtttaatagacttttagtatataatagatagaagatagatagataagctgagagtacagcaagtcttacaacagagaggtccctgacagatgggaaaattacactttaaccctgcaatatggaaagaaggacctaaaaagaaacaggaaaagcaatcgggtccttctctttgccttgtccacaacaatatggccggatcgacacacactggacgacaataggagcagagaagccatggctagctgcatatagtgatgcctaggtgcgaacccaaaaggagcctcactaagatggaggttgaaacacctaaggcaaacggagaaacatttcacctgtaccttgtaaaattgtcgctggagaggaggaagaagatcaccgcggatgcagaaaaaaaactcgcggagaactagagaagaaacaaactccggcgctgccttgttttgaacaaactcgccgcgctcttagcttcaggcattgatggtgaacctggaaaatgattgatagggagccatcaacgtagagaagcccacgaggacatccatggtagaagcaaccaggatgaagctaggagccggacgccgacgaccccctcgagctacaaaatggattaacccgactatggccatcctgttaactactaacactactaataagttcaacttagtatttggaaaaattagaaacataatacgtgcaactattatggatagagggaatataattatagaaataccaccagttaggtttctcttggcctagctgtctagctagctgagttaaaacttgtactcccgttttcaacaccacttacctaactaccaataaattttattatttttttattattagtggagcactttagtcagattttcttagtaacatttgtcgacaaattttctcctaaaaatttaacaaatgtaattatattacaatcgtagtgtaattacactgtaacttatatgtatttacattgtagcttgcatgtaactacaatgttacttgtatataagtttcatgtaattttgaacagttaaatctattacaagatttgttttggtgaggaagaaaaaaatcacagcgcatatatatgtgtaaggatttgttcccacaacctctattttaccgaaataacatattacagagagatttttgaaagttacatacaagttacactatagttacagtgtaattacatgcaagttacagtgtaattacactgtgattgtactgtaattacatctgtcaaatttttcgagaaaatttgtcgacaaatatatagcaaaattgatcgaaatatattactactaattaataggatgagttttttgggcccggcccagtagccaatattgcatgcttactgatcagatggatggttgccccggtttggcccagcgtatgctatgcatgcttatttactgagtggactaagttcacttgtggtcctttatcttgacgccaagtttgaattacgtccttcgaccgcagtaccatatataatgcatttttatcttgcaaaaccggtatactcgaggtcccaagacattatagtgtctaattcaagctagcgtgacgagtgagacccatatggatcccacatgtcaacgatcaactcttcttcctcctctctctcccacttccctttcttccccatcgctcttgaggactagcactacctacttgtcgccggagcgtcaccgccacgccaaggaggatgaggacttgagaacaagacggtgctggagcgctgccgccatgccaaggaggacccgaggtcctcgagaacaagatgttgatggtggtctggatcaatccgatgtttcctaggtttcaagggttcaaaccatttgccccatttagagttttgaatcaacctaaaggcccaataaaacatatttgtggataggttcagtggttaaatgggccaaacttaaccattcccatcctgagtggaagctgccgtgttacgtcccatttttcgtatttcttaatttgcctaatttcaaaaattcacattcgtgtttattcgtctgaaatggcttaatgaaaattctgaaaattaaaaagtgtttaatttgactaaataaactaattatacattttattttatcgttcattaattggagttatttgatttttatttaagtttggaagtggagctcaattatgtgaattattctctatccaaaaaactcctgaacaaatccaaataatttacaggattgggattcttgaggaatttttctagattgagaaccctattatccttcttgttcctcatttctccttacctttttcctctctttttattattttcttttcttttttgcttttcttgttgttcccgatgcctccaagttcaatttttctgtatctctctctctctatcgatctctctttctcttctttgcacccagcagcacacgctacctgtccctggttccaggccagcccatgccgccatcctcgccacggcagggacacggcgacgtcgtttctgtttggtctgcaatgaaggaacgtttctcctgctgcatgaaattaagcagcaacgtctcttccaatctcctcactgatcccttcttcttcttcttcttcttcttcttcttctgctccatcagtttctctcttcaataccaaaagttaaacattcctgatgagcttgatccatttttccatcttgtgtcgtggtcgtggcccctcgttgcacatgcttcttttctgcttcttcgtcgaaattgatagcaaagcccaagattgtgaatcctcactatctctctctcacgcgaattctctgaattggaaagacgatgaacacgaatagagtttttggtgtcgcgaacaaaccagcgacgttttctgatgctcatatatatagcaaatatgtacagactcaaactgacaccactacgccatcatccacgacgatgcgaccacgatgctgaaatccggatgactcgcacacgacacacgacccggaagactcggcttacaggaaaaagaaacagagaaacagacgccgaaacagagtctaacgaaactgaagaaacagcaacactagacgcgttacagtaaccgataatacggcacaggattatagctgaagctaacaaactccccctaatcctgtcgccgggtgacaatatgcacgacgcccgcctgactgcgaaactcttgaaacttgattcgtccgagtggcttcgtgagaatgtcggcaacctattcgtccgaaggaacgaactccacctcaactttttctcctcaatgcattgcctgataaagtggtaccttgtatcgatgtgtttactccggtcatggaaaaccggattcttgcacagggagatcgccgacttgttgtcgaccttgaggagagccttccctggatcacttcccagcacctcagctagcaatcgagccagccatatgccgagacacgctgctccagtggcggcgatatattcagctttactggaggaaagagcgaccactttctgcttctgggactgccatacaatcgggcttgagccgaggaagaagagagcaccacaggtactcttccgatcgtgcgcatctccccccaaatcactgtcagaaaatcctagcaaatggattccctcttctcctgaatttacaaatttgcaaccatagttcatagtacctgcaacatagcgcagaatgtgcttcaccgccgtgagatgatcattgcgcggtgactccatgaatcggctgacgtaacccaccgcgaaagcaatgtctggccgtgaatgcaccaggtaccgcaaactccccactaagccgcgataaaaggttgaatcaacacttggtcgatcgctgttcttcgtcagtttcaatctgggttccattggaacggaagctgaagccgccaggccacccatcttcaaaagcttctgcgcataagtggattggtttattgtgatcccatcgttgccttgatgaacctcgatgccgaggtagtagctgagtaatccaagatcactcatccggaatagggagtgcatctcctccttgaaactctgaattgttttagagtgagcgccggtgatgatgagatcgtcgacgtatatgccgataattagccgcgcgttcccggtcccgcgcgtgtacacagcatgttctgtgatgccccgtgtgaacccgagttcatgaagactaacatccagcttcgcgttccaggcacgaggagcttgacgcagaccataaagtgctctgtttaggcgcaggacttgatgtgggtgcttgtcgtcgatgaagcctagtggctgggcgacgtacacctcctcctctagctctccgttcaggaaggctgacttcacattcatgtgatgcacagacgacccaaggtgagctgcaatggcgagtagcagccgcacggattccattctggcgacaggggcgaatacttcgtcgaaatcaatcccctgccgctgaacgtaacccttagcgaccaggcgggccttgtgcttgacaattgcgcccgtctcgtccttcttgagcttgaacacccatttcaggccaatgggacgcttgtcagcagggagatcagcgagagtccacgtgttgttctcctcgatggacttgagttactcctgcatcgctcgcatccagagtgcgtcctgtgccgcctcagcgtggttgcttggttcctcggcagcagccacatgaagctcgtcggagtcgagctcaattggcgaggtagtgtcaaggattttggccaccatccaaaaacgacgtggccctgtgctgtcgtcgtcgacatcaggtgtttccgcaggcagcgacacaaactccaccgctaggacacccggtgacgcagagattgatggcactggtgttcccatgtgagccggcgacgacatggagtcggagtggcgggacggcacgtccaccgccactacctcgtagcgcacggtgaaggtttcctgaggagacgttcccccgtcctcctccccgggtgacgcccatggccatgatgccgcctcatcgaacacggcgtcacggctcacgacgatgcgcttggccaccgggtcgtatatacgatatgcctttgaacccggctcgtagccgagaaagaccatcaccttgctccgatcatcaagttcttgatgtgtggtttcacctccttgacgtagacgacgcagccaaatgtgtgaaagtagtgcacaacaggtgtttgaccgtgccatgactcgaacggtgtcttgtcgcggacgctctttgtcggcgcccggttgaggatgtagacggcagtggtgaccgcctcgccctagaactcccccggcatgttcttggccttcatcatgcatctggccatggccacaaccgtttggttgcggtgctcgatgacgctgttttgctgtggagagtatggcgtcgttagctgcctggcgacgccttcgttcgtgcagtatagcccgaactcgacagaggtgaattcccctcctcgatcagtgtggagaacgcgcagcttgcagccggtctccacctccactcctgccttgaaccgcttgatggtagcgggagcctcgctttttgatgttaacagaaacaaccacatgtagcgagttagatcatcaatcagaagtaggaagtattttttactgccatgtgtcgacgatgtgatgggtccacagatgtccccgtgcaccagatcaagatggatagtggcgcgatgcaatgccgccgttgggaacggcgctcgtcgctgcttgcttattaggcagccgtcgcagaccttggtaacccgctccagagtgggaatgccgcgcaccatgccgcggctcgccagtgagcggagagcgtcgaagttgaggtgcccgtatgtcacaccctgaagttctcctcctaagcctaaattgaatttataaatggtcccaagaaaatatcggtgtaaaagcaagagtaaaccctaataaaccaatgcaaataataatcggaattggcattagaatttttcttgagttctacatgtcgaaatttgctaacaagatttttagtggaattttgagagccctagaaataattttaaccaattaaaattgagcacatgcaattttaaatccaggaaaaatcctttcttccttttctttttcttttccctcctttttcctcttcttgggccgtcggcccagtccgcccgccgccgcgcgcgcccttttcctccttgtgggccggcccaagccgcccctccctctctctccgggacgccgacaggtgggtcccaccagtcggggtcgtccccttcccccggccgcccgcccgacgtcggcaaccgccgccgaaaccgccgcgcccacctcctccgctcctcccgcgcccacgccgcgccgcccccgcgtccttcccacgtcgccgccctctcccccgcgtctcccggcccgcgcgcgctcgcaaggggcgggattcgcattttgaatccccccattatctctctctccaccccacgtcgccggtcaaataggaggctttcccggccgtttccacccgtcccgcacctataaatcgctcccccgagcctcctctttccctttccgctctcgccgctccctcccgtgcttcctaccgagctcgcgccgctctccgccagcgccgccgcttgccaccgcactccagccgcgtgccaccgccgcgctaagccgccgccaccactagcttcgccgccacaagatctttcccaaccgccgccttgcgtcaccggaatcccaccgagaccccatttccctcgcgtcgccggtgagtcccctctccccttcaactccagccaacatggacggccgccgtggggttttttcctccgccctaattcctctcctcccctcccctaggtgtcgccgtcgctcgtccgcacctcggcatcgccggacttcgccgcctccctcgttttccgccgccggtcgccgccgccctctctggtgaggactccctcccccttcctttccttccccttcccgcgtgcgccgtcgcttttggccgcgccgttgctccagctgtgcgctgccgcctttgcgccgtccgccgccaccggtcgccgccggtggtcgtgcacgccgccgcctctagccatggccggccggccggctttgaagccgagccgaacccggcggctgctccccgcgccgtccgatcggcccgaggccgatccggaccatcggtcccgtggaccggcggtggaccacccgcgtggtcccggtccacggtggaccggccgctttgtgccgctgacccgtggggcccacgtgccggcgccccctccctctccccttgcgccgctgacatgcgggccaagcatgtcggcgccgcccgctccctttgatgacgtcagccctaggcatttattgtgcaataattcaattaaggatttttctgtttattgtaaaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgtattgtttgctttgtatgtcgcttagattccagctcttccaacgctccggtgtacttcgagatagtcaccgaggttcctccagcagcagagcaaggcaagtcatgcctgtcacttgaacatgttgatcctatattgcaaatgttctaatgttttccttcaaatactgcattgttttacaataatactatgggatgtttacctactgttacagccatgctattttggtaccatgctcctttgttagcttgggttataacatgactagatattggactagggattgcttagccatgcttagttcaactagcacacaaaggggaaaatcctattaatgtatagactgtaggttctaatggtaatgttggattagtgccaccgcttcggtgttggttaattaaaataaatcacatggtgggctgtgggtgcatgattttgttggtcgcgcccatggcagttaaggaccggttcacaggatgccctggaagaacttatcgtacttaccacaagctagtgtgggcaactgctgggcttgtagtgtagctttcctctagctgacgcatctaggcaagggtggccgtgatggagtttggatgggtcctgcgacggcctatgcggcttccggattcatctaggcacgagaggggactgcccgctgccttgcgaggagtgggggtgatacctgaggtgtggtgtgcttggttagagggggttatgcgaagggtcctgtcacggcctctttccggtatgtcgtggtggcatgccggcgcacgaaaacgtgtcgtggggctgtgtcttgtgggtacagttgtacacctctaatcagagtaaaactattcgaatagccgtgcccacggttatgggcggtcaaccagattcaccgtgattagtctcaccctagtttagtctgatgaaattggatagtataggtggatggttgggcctgttgcaacatggtatagcgttggacagtggatgattaatattgattaattgttacaactgctttactgctttcaacttctgtttataaatgcccgttttatgcaaatgaaccattatagctatcccttgataattccctgcatcatagccctattccggtatgacttgctgagtacagtgggtagtactcagtcttgctctattttccccaaaccccagagtttgagtatgcgtcagatggtggtttctccgaggagtaggcttcgtccgtgccatcgaggatgcctgtggagtggtgttcccgctgcagttcaagtcaaggcttagctccagttatcttttgtttttccgctgtatttatgtaagacttttataatgtttgtaagacgtggatctgtatgtcaactttgtcgtttgtgtaccccggccggtcctggacggggattttaatgcacattctgcttggaattctattcgggaatttctgggcgtgacaagttggtatcagagccgaccttgaccgtaggacaagccaaatggaaaacctaagagccctctgaatccttttcattgcatatgttctttgcaattggatttgttccgtgagaaattgggatctgttcttgtggttcaagggaaaaatcttggtcgctcgtttaagtgagatttgtcgaaacaagtaagtctagggttttagtaaaattatttgagatatattcgacagttagtcgggatttgatgggtggtatgcattaggtcctagctcaggaatatgggttgcaaggtgtttatgcttttattgttattattagtatgtacctaattttctcactattttatcgctatgtaagtctgtcttatttattcgctctcatgcaaatgatctatgcataaaattccgctcttattcgcttctcttatttgagtcctttactgctttatttaaaattggatttgagcatgcattgatcctacccctttgtcttctctagatggccgagcacccacccaaccaccgcggagaaggcatggatgattttgtggcagaattggctcgcatgacactggtggtgggctaccccaacgtgccagagtactcgactgttccaccgctcagtggcgagcttcctcaccgtgttcgcctggaggtccatggctatgtgggtacctgcctcgctaacattgtggttgaggcatccggaggcacagcagatcacgcctgtcaggaggcagcatatctgctgatggccaggcttcgtgatcagcacaactacatcttctgcaacacggtgtaccgcttccaccctcgtcgagcaagtggcgatgatatcagcaccttccgcccgatagctggtgagaacgacaccaccttcggccacatgtgcaccgtgatgaggggaatggacaggatgcactcggatctgcacaaggcgtctaaggccttgaatggtgggaagctcgtgaggatcatagctctgaaggatgagatagcacgcctgaagaaggagaatgctcagttgaagggtctccccgcgccaagaggagtcctgatccgcaccacgcccggcaagtcgacgacggcacccgtgtgcattcaacttgcgcccaggaacccacctccgcctgcagctcccgcagctcctccagttctgccccacagttgccgcagctcctgcagctccagagccagtcccagctcatgttccagtgtcagctcccgtgtccgctctctccttcgctccagcatcagccgtcaggggcccagccagtggcaacggcggttggttgcctgccactcccagtggcagccgcgaccacagcagcagcagttccagtggctcagagccgggcagcggcgagacgtatctgccagactccaggagccgctcagagggacctggtgacaagcaggaggacgccttcgactccaccgaccgcaggagccgttccgagcattaggctcgctttccattagtttatcgactgtttagtatttgcctgttagtttgtgtgtttaggtctgctcgcttgtgggtcagtcgacggtcgatatcatgtgcctatgatatggctgtcttaataaggattttgcttgctgttttaagtgttttaattcagatcagaacaattgcagtttaaattcctatataataaagcttagttcctgagcatctgtttttcttcttttctacccccccgtctgctcttcctccagatggtctacaccaggaatggtagccgcacaacaggcgagggcagcaacggcaaagaacgcactgacggtgtgcatcccaacagcgattccagcaatggtccgccaccactccccgagaatccgactctggcccaagtaatggctcatcagactcagatgatggcagccatgatgcagcagcagcaccagcagatgcaccagaggatgcagcagcaagacgagcaacagcagcagcagtttggtccccctccccctcagtccaagttgccggagtttctacgcgtcaggccacccaccttctcttgcaccaccaaccccatggaggcgaatgactggctccatgccatagagaagaaactaaatctcctgcagtgcaatgatcaggagaaggtcgcctttgccacacaccagctccagggttccgcgtcagcttggtgggacaatcacatggccacccgcccgccaggcactgaagtcacttgggcggagttctgtcgcagcttcagaaaggcgcaggtgccagacgcggtcgtggcacagaagaagagggaattccgggcactccaccagggcaacaggacagtgactgagtatctccatgagttcaatcgcctagcgcgatatgcaccagaggatgtccgcactgacgcagagaagcaggagaagttcctaggaggcctggatgacgagctgaccaaccagttaatctctggagactacgccgactttgagaggctggttgacaaggcaatccgtcaggaggatcagcgcaacaaaatggacaggaagagaaaggcggcgcagttccggtccaaccaagggagccaccagcaaccgcgcttcactcccggacagcaaggtggacctaccaccatgatcgtcctccagcaccgccctttcaactcaagcagcttccaccagggcgccagtggcagccagaaccaccagggaggtcagcccaacctcagtgcagctccgcgcccaccaatggcaccagcacagtcagttccatccgctcaagccaagatggaggctgggacaaagccagggtcctgcttcaactatggcgagcttggccacttcgctgacaaatgcccgaagccaaggcgtgccgggctaaggtttgtccaggctcgtgtcaaccacgcgtccgcagaggaggcgcaagcagcaccagaggtcgtactgggtacgtttcctgttaactcaatccctgcaatagtactttttgattctggtgcaacgcattctttcatttcaaagaaatttgtggggatgcatgggttaagaaaagaagagcttagtactgtcgtgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtttcttttccctccccctctccctcttgggccggctcggcccacctccctccctctctctcctctcccccgcggcccaatcggccccctccccgcgcgcgcgtgccgctgacgggcgggcccgcccgccaccctcgctgacgggtggggcccacccgtcatccccttcctcccgctgctcccgccgcctcgcccgtgccctagcgccgccgccgccgcgaatcccgccgcctcccgccgtccccgcgcgcaataaagagagggaaatcactccccgtgattccctccctctttccccccacttttccctctctctctccctcggattcgttcggaaagtttccccctaacttcgccggcgcatcaatggcggccggaccttccgcggccgattccccctcatccggccgttctctccccctcccaacactatataaacactccccgtgcctccctccaccgtttccgccactcgccgctctctgtccccttcggaatcgagctcgcgccgtcgttctctctctctgccgtcgccgccgagctccggtccgccgccgtcgttgccccggaccctctcccgtttcggcgtcgccttcttcgggttcaccgcaacctcgccgacctcgtccacccctccgtttcgcccgccgaccgccggaactccgccgtcctcgtcgacccgagccgcgccgccgccttcctccgctccggtcgccgttcccgtcgtcgccgtcgacccggggtgagccgtggaccgccgtttcactttccccttccctcccctctctcgggcgccgctccgccgctccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcataaatatccatttaaagagcatataaacttcaaatggccataacttggccatttgaactcggaattggaccgttcaagtctctaatttttccttaagaagccaagaacccatttttgtgctttgtttctgcttgttatatggagtttattagagtaaaagccttttcttttccgttgatcgtgtagacgctgcagctttggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattgttattgttattatttccttgttcaccctagaataaacaaaaccccagctagtggacactctactcatggtaccactagtatgattttaggtagatgcttcgctatttaattaggtaacattaggcggttttacaactctagactttgggatattcatatcacctggacactttggaattgttggagtattgtggaattggattcacaccgccccctctattcaaaatccccaaaaatggttttaggctgggctcggggtgcatggttttgatagtagcacctcggccaaataaggaccggtcttcgggcctctgttgcaaagcactaccgtactttcacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggtcggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttgcatgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgtatagttctagaatcgtgtttacaaaatagctttgagcaactaagtatctttaaatgctgtttactgcaaccctaaccctttatattataactcccttgtactcccttgcatttattatgcacttgtgggtgtgtcttgttgagtacggtggttgtactcagtcttgctcaatttttttcccaaacccagaagaggagtctctggaagatgaaggttttggtgtctagctcgtgcctgccgtcaaacgcctgtggtcgtcgccctagtcttccgctgtttctcgtttgtctttgtgtgtgctgggccttcgctgcccatgtaataaattaactatttacgcttccgcttgttgaactctgatctgtatcaacttttggtgtaccttgcctcctgggacaaggaataatgcactcacgtaaggaacgcccgttgggttatttccggtcgtgacatacaatctacttgaatcgttcttttactatgttttctattttaccctagtttagtccatctttgtcggtttgcgctgtaaacagtctgccgccgctgcgagagtgcgacacctctttgtaggtttctcctgaaaaccttccgttttacccacgagacgggtagttatcctcatatcgatctaaatcggcctagaggctgattttgatctctaaatcggctccactagccggtttagcttttctttatacaaaacccatcttgatttggctctttggctagatcgaggtggttggcgactccatatcaccgcaaggcgtttaggtgttgcgatcgtgcttgtcgacttgtcacaaaaaggtgccaacatgatttttggcgactccgctggggacgagatccgttcatcgtcaactcgacttcgacttcgccatgacgaagccatcatccagaacggaggtggagccatctaatgtgatgccggtcacattggatgacttcgaaggagaggatcgtaaagctgtggaggagtacatcaacgagctcacacgggaggcgttgatgagattaactactaggactcatcaagttgtgatcatcaagcccgggccacgtcctatgctcgctcccgacgtggtaagtaatgacgaggtatcgcaatctatcaacgaacaaattgcatctacaaaagattcatctatggctaattttaaagatagattagatttaatgtttaaggagaaggttgatgggtttttaaggagtaggctaggtgcttttatggatgattacacattaaaggataaagcctataccactgttgatcaatctcctatagatccgatgggtagtaaaaccgacgcgacggtattcacggtcggtccgaccgggcctgacggccggtcagaccataacatagccgtcggtccgaccggccagacggccggtcagaccggctctcaggccggtccgaccgcgcaacaggacgctggtcagaccgggccctgggccggtcagaccggtgcaattgtcccgattcagggtatagatccaacgactaacgctagttatttgtaccactttagaacatttgatcctcctgtatctactgctactattaatcctcaagttcccccacatattcctaatgcttataatgatgtttctaggggatatcctcccgatactaggcaaggccaatataatcatattgcgccacaaacccagcctattaggctaccaaacccaccaccaaatccacaagggcctaataacatagagaatgtgattagtgatattatgagaaatagattcgggattgaaactaggaatcgtgctagagcttacaaaaagccatatcctgattattatgataatgtgccgtttcctagaaattatagagttcccgaatttgccaaatttagtggtgaggatggtaagaccacatgggagcatgtaggtcaatttttagcgcaatgtggtgaggctaatagtgatacttttaaattgcgcttgttttctttatctttatccggtaatgcttttacatggtttacttctttaccggcaaattctattcatacttgggctcaattagaagaacaatttcatgatcatttttgcactggtaaaactgagcataggttgtctgatataacatcggttaggcaaaaatacaatgaatctgtcgttgattatattgaaaggtttagagaaattaaaagccgatgttttagtttgaaaataactgacaaagatttggccaacatttcatatgatggattgcttgattctattaaagagaaattgaatggccagatatttcttgatattgatcatgtgttgcatgaagctctgactcaggaaagccgagtggatgacaatagcttaaatgctagtttagatgatagtgcaataacatgtatagccgaacctagcgataattcggattgtgttaataatttgtgcaatgatgccgtgacaagtatagccgaatcaaatgttggtccggactgtcttactagtttggatgataacgcaataatcaatatagccgaaccaagtgttggtttggattgtgtcactagtttagacaatgatggaatagccgaaccaagtaatggttcggattgtgttgctagcttagagaataatgccatcgaagatatagccgaactaaatgacggttcggattgtattacaagctcaagtgaaatagcattgtcacctaagaccgaattacaaatcggtcatgtagatgttggaaaagatagtgacaatgtcttgcaggatagtagtgagatagaatccaaagtaactatgcatacatatcaaagatcgtatcctgaacacgtagattcggtcccatacccgcaaggatttaaggtgcccaacttcacaaaattcacaggtgaggatgctagaacaacaatggagcatatcggccaatttattgatcaatgtggtaaggccggtaatgatgatttgcttaagttaaagttgtttcctctttctttgtcaaactttgcatctacatggtatagtttacttgctcctaattcaatttctacatggtcacaaatggagcatgagtttcatggttatttcaaagatgcaagcttaatggagcaaagaccgattgatacttcaccggtcacttgtgaaactatttcggttacatctatgcctaagaccggaattgttagtgattctctccctgttagtcctattgatgtagacaaaaagaaagggaaaagtgttattattggggatcttcggcccaagaataggataaaaaatgcgaatgccgaatatcataaagttgcaaaggatgggtcatctaattcccaaaagaccaaaaagccgaagctcacttttgagatgcttatggctaaatacaagaaaggattagccggttaacgatttgataaccaaactagtgattcgaaaagaccaagatcatctcgtaggaagagatttagtcaaacattaaagcaatcggagccatcaaccataccaactccatataaacctccggttgtgatgccatggtatccatatccaatgtcaccgtttggttatccttttatgtattacgtgccgtggatgcatcaaccacttatgccgcattatcaggagtggaaggaatcacctaggacagtgccaaatcgttcatctaactcaagacaagactgttttccacaagagaatcggtccggtggatcaaaggtgaaaaaaatgaaaaaggtgaagaaggtgtgggtgaggaaagaagccaaagctccggaggtcgttgctgccaaagaggagtctcaagaggttcatgtacctactggagatgcggtggaaaccacgcaggcaaaggagattgaagctgatgccgtgactgccaacattgggggtctaaccgagacagctggccggtctaaccgccagtctatggccggtctaaccgaccttaccggccggtctgaccgacggcttgtggccggtctgaccgggctcagaggccggtctgaccggggggcattggagaagagtgggaaaattgagagcaacataggagcttccacttcgacaaaaaatatcaagaatcattgtttagctcctggaaaacaaccacagccgaagtggataccttctggcttatctcgctctcaaaagaggaggctacagcgtcttcgggccataggtcaaaaagaaaaggaggccaaagatgtggagaacaaaacatgtaacaatttagagcttcgaacgacacctaagcaagtgtggagatctaaagaagtaaaagttaagagaccggtgatttcccatagtagtagtgataaatccaatttgatgagagaagaatcatcggtcattagagataagtctccttcacatgatgctatggatgttagtacggtattcatcttgccttcgaaatcgtgcaatcaagaaagccgattttgcttggggggcaagacattaatatgctcgtgaaggaaccaagagaagatgaacggcgatggatacgacatcatatctttgagccgccgtttgttggatgctaaggcaagatatgggtttattgtgtttaccattatattatatgcctatgccatgttattagaatattgcttgctatctagaacatgtgtgtttttgcttatcaaattgatattatacatacatgttgcaaatgccagttctaggaagtagaattggtaggatggcatataatttgtttgaggtatgatttggctcatgactctttgatatttatttaaagccaaatcatatgtgtttttatggatcaccatataagatatagatttcatatttattgcaccatgaaagttttgcctactagtaattcggctaatatcaatggtcactgtgatggtttgctctagagtggttttctttaggaacattggcattgttaatattttgcatacatgctcaagccgattacttacatttttagtttattggaatctatgcatgtgacacatatgactttggtgattcattattgatcatacttcaattggctaagtgttgtgatgccatgatgattattgtttcaacagccaattgaattagtattcatctagacatattagttgaatgttatgatttttcatatgtatagagagaaggaattttggtccaataatttgatacactaagcatctggctattatgtgaagaaaaattatatactaaaggccgatgcttgatttcaaaagtttggatgaagttggcaaagtcatagatcaggggtggtctgaccggcattgcacggccggtctgactggtggtacccgcggtctaaccggctctgcatggccggtctgaccgggcagacagggtggtctgaccggcattgcgtgtccggtctgaccgatcccagacaggaggctggggggcacgttacaattgattaaaaggccgaattaattattcggacatttgtgcccatgagttagaaatagcttggagaattcctttgattagatatttaaaagatcctacacttaaggttgatcgaaagattcggtggcaagtgttcaaatattgtatcgccgaaacatagatggtgtcttgttaaagtgcttagatgaagatcaatctaaagtggctatgggagaggtacatgaaggaattcgtggaattcatcaatcggccgtaagataaattggttgcttaggagagtggagtttcattggccgaaaataattgatgattgtttcaaatgctatagagggagtgaagcttgttaacggatcgacaatgttcaaattagcgcctatcactatattgaatattatcatcaaaccatggccgttccaaggttgggctttggatttcattggtcaaatttatccttcgtcatcaaaagggcattggttcgtgctagttgcaatgggttacttcactaagtgagccgaagccgtgccgctcgagaatattactacggaggtaattggctttattttgaagcatatcgttcatagattcggtattcctcaaacattaaaggagcttcttttatgtccaaggaagtgagaagttttgccgaatcttatgatattaagttgttgagttcttctctttactacgctcaggctaatggataagccgagtcgagtaataaaacattgttaaaattgccgttttgccagttgaggtaaatcttggctctcttcggtatttcaagcaagacgacttgtcggttgacgattacaagaccttgatgggaagcaattttgaagacgtcatcgacaagcgtttaaagactttgaaggagatgaagacacttcaagacggtgttttcaaagagcaattaatgggaaatagcttgaagaaatacttcccgagcatttggtaagatgcttaggaagtcctatggccggtaattggattatcgccctgagataacatgttctatgcttttaggttcacgtatgttcaccaaaaaggcaggggggcatgtgtttacacccaaatttggcacctatggacgaaatagggaaaaattgccaaagtttggaaagtgtcgggtttccttcactagggccggtcagaccataggtatgtgggcggtctgaccggctagtagggccggtctgaccgcagttatgtaggcggtcagaccgtgagggtctgagtccgactctgttttcgtcgggtctcgggtttccttgctcaggaaggcatgtttcgtgtttccattggtttctatcccgaattggacgtgaaggagggcctgtagagggcaagaccaacccctatataagggacaaggccggttcattgtaaaacccccgaatacaatctacttgaatcgttttttaactatgttttctattttaccctagtttagtccatctttgtcggtttgcgctgtaaaccatccgccgccgcagcgagagtgcgacacctctttgtaggtttgtcctgtaaaacttccgttttgcccacgagacgggtagttatcctcatatcgatctaaatcggcctagaggctgattttgatctctaaatcggctccgctagccggtttagcttttctttctacaaaacccatcttgatttggtcctttggctagatcgaggtggttggcgactccatgtcaccgcaaggcgtttaggtgttgcgattgtgcttgtcgacttgtcacaaaatgttgccaacacaaatcactagtctcaccaaagcaaggggtctccttgaatcagattgaggtggaaatcccagtggtcaccgaggggaagagttcgaggaaattggaagatatccccatagtctgcgagtacccagaagtgtttactgaagacctcactaccatgccacccaagagagagattgaattccggattgatttggcaccgggaaccgctccaatttacaagagaccgtacaggatggcagtcaacgagctagcagaggtcaagaagcaggttgatgagcagctgcagaaagggtacattcgaccaagtatttcaccttggggtgctccggtcatttttgtggagaagaaggacaagacgaagagaatgtgtgtcgattaccgcgcactcaatgaggtcacaatcaagaacaaatatcctttgccgcggatcgatgatttgtttgatcagctgaaaagagctaaagtgttttctaagatagacctgcgatcaggctatcaccagttgagaattcgggaagaggatattccgaagaaagccttcaccactcggtatgggttgtatgagtgcacgcttatgtctttcggacttaccaacgcacccgcattcttcatgaatctgatgaacaaagtgttcatggaatttctggacaagtttgttgtggtattcatcgacgacatacttatctattcaaagtccgaagaagaacatgagcaacatctctgtcgggtactcgagaagttgaaggagcaccagttatatgccaagttcagcaagtgtgacttctggttgtcggaagtcaaatttctgggtcacgttattacagctcaaggcgtggcagttgatccatcgaatgtggagtcagttaccaaatggaccccacctaagaccgtgtcacagattcagagttttcttggacttgcgggttattaccgccgattcattgaaaacttctccaggatcgcccgacccatcactcagttgctttagaaagatgagaagtttaaatggacagctgagtgtgacaagagttttgaggagctcaagaagaaattagtatccgccgtagttctgattctgcccgactagacaaaagacttccgagtctattgcaacgcatctcgccacgggcttggatgtgttctaatgcaagagggcagagtggtcgcttatgcctcgcggcagttgcgtccacatgaagggaattatccaactcatgacctggaattggcagcagtggtacatgctttgaagatctggaggcactatctgattggcaaccgctgtgaagtatatacggaccacaagagtctgaaatacatcttcacccaaccggatctaaatctccgacaacgaagatggctggaactaatcaaagattatgacatgagcattcactaccatccgggtaaagccaatgtggtggcagatgctttaagcaggaaaagctactgcaatgccctatgcaccgaggacatgtgtgaagaattgcagcaggagcttgaacgtctcaacgtgggaatcgttgaacacaggttcgtagccactctagaagcacggcctacgctcgtggatcaagtcagagcagctcaagtgacggatcttgagatagctgaactgaaaaagaatatgagggtcggaaaagcccgggacttccttgaggatgaacatggcacagtctggatgggagaaagattgcacatgcctgatgacaaagagctgaaggatctgatactcaccgaggctcatcagactcaatactccattcatccgggtagtaccaagatgtatcaagatctcaaataaaaattttggtgggccagcatgaggagggaaatagctgaattcgtcacgctctgcgatgtttgtcagcgagttaaaacagaacatcagaggcccgcaggactattacaacctcttcagatcccggaatggaaatgggaagaaattggaatggatttcataacaggtctgcccaggacatgatctggccacgattcgatataggtagttgtggatcggcttaccaaagtcgctcatttcatcccagtgcacactacttatacgggcaaaaggttggcagagctctacctcttgcgaatcatgtgtctacatggagtacccaaaaagatagtatctgatcgagggagccaattcacttcaaagttctggcagaaattgcaagaggaattgggaacccggttgaatttcagcacagcctaccatccgcagaccgatggtcagaccgagcgagtcaatcaaatattggaggacatgttaagggcttgtgcacttgattttggtggagcttgggacaaaagcttgccgtatgcggagttctcttacaacaacagctaccaggctagtcttcaaatggcaccgttcgaagcgttgtacggccggaagtgccgcacacctctcttctgatatcaaacaggcgaacgtcaactgttcggaacataagtgctaacggaagcggaagagaaagtcaggaccgtcagagagaggctaagaattgcccagtctcgacagaagagctacgcggacaaccgccgaagggagctcacttttgaagccggggattacgtgtaccttcgtgttactccgctccggggagtacaccgttttcaaaccaaaggcaagttggcaccacgcttcgtgggaccatacaaaatcttggaacgaagaggagaagttgcttatcagctagaacttccattcaatatgatcggtatccatgacgtgttccacgtgtcccaattaaagaagtgcttgagggtacccgaagaacaagccgattcagagcacatcgatatccaggaagatctgacctacgtggagaagccagttcgcatccttgagaccagcgaaaggaggactagaaacaaggtcaccaggttttgccgggtttagtggagccaccattcagaggaggaagcaacctgggaaagagaagatgagttgaaggccgcccatccgcacctcttcgccagctcctccgaatctcggggccgagattccgtttaagggggtaggtttgtcacaccctgaagttctcctcccaagcctaaattgaatttataaatggtcccaagaaaatatcggtgtaaaagcaagagtaaaccctaataaaccaatgcaaataataatcggaattggcatgtggaatttttcttgagttctacatgtcgaaatttgctaacaagatttttagtggaattttgagagccctagaaataattttaaccaattaaaattgagcacatgcaattttaaatcccaggataaatcctttcttccttttctttttcttttccctcctttttcctcttcttgggccgtcggcctagtccgcccgccgctgcgcgcgctcttttcctccttgtgggccggcccaagccgcccctctctctctccgggacgccgacaggtgggtcccacctgtcgaggtcgtccccttcctccggccgcccgccccaggtcggcaaccgccgccgaaaccgccgcacccacctcctccgctcctgccgcgcccacgccgcgccgtccccgcgtcctccccacgtcgccgccgtctcccccgcgtctcccggcccgcgcgcgcgctcgcaaggggcgggattcgcattttgaatccccccattatctctctctccaccccacgtcgcaggtcaaaaaggaggctttcccggccgtttccacccatcccgcacctataaatcgctgccccgagcctcctctttccctttccgctctcgccgctccctcccgtgcttcctaccgagctcgcgccgctcgccgccagcgccaccgcttgccaccgcactacggccacgtgctgcccccgctagagccgccgccgcgctaagccgccgtcaccactagcttcgccgccgcaagatctttcccagccgccgccttgcgttgccgaaatcccaccaagaccacatttccctcgcgtcgccggtgagtcccctctcccctccgactccggccgacatggatggccaccgtggggttttttcctctgcgctaattcctgtcctcccctcccctaggtgtcgccgtcactcgtccgcacctcggcatcgccggacttcgccgcctccctcgttttctgccgccggtcgccgccgtcccctccggtgaggaatccctcccccttcctttccttccccttcccgcgtgcgccattgcttttggccgcgccgctgctccggctgtgcgccgccgccttcgcgccgtccgccgccgccggtcgccgccggtggtcatgcacgccgccgcctctagccatggccggccggccggctttgaagccgagccaagcccggcggctgctccctgcgccgtccgatcggcccgaggccgatccggaccgtcggtcccgtggaccggcggtggaccacccgcgtggccccagtccacggtggaccggccgctttgtgccgctgacccgtggggcccacgtgccggcgccccctccctctccccttgcgccgctgacatgcgggccccgcatgtcggcgccacccgctccctttgatgacgtcagccctgggcatttattgcgcaataattcaattaaggatttttctgtttatagtaaaaacacagtgaatcttctaaaattcataactaattcatccgagctccgtttaaacccattcaagtcttagtaaatcaagaaaaatatgtagaatccattaaaattggttttgttctctgtttcagtagtattatagcgtgtttgtattgtttgctatgtatgtcacttagattccggctcttccgacgctccggtgtacttcgagatagtcgtcgaggttcctccagcagtagagcaaggcaagtcatgccggtcacttgaacatgttgatcctatattgcaaatgttctaatgttttccttcaaatactgcattgttttacaataatactatgtgatgtttacctactgttacagccatgctattttggtaccatgctcctttgttagcttgggttataacatgactagatattggactagggattgcttagccatgctttgttcaactagcacacaaaggggaaaatcctattaatgtatagactgtagattctaatggtaatgttggattagtgccaccgcttcggtattggttaattaaaataaatcacatggtgggctgtgggtgcatggttttgttggtcgcacccatagcagttaaggaccggttcgcgggatgccctgtaagaacttatcatacttaccacaagccagtgtgggcaacggctgggcttgtagtgtagctttcctctacctgacgcatccaggcaagggtgggcgtgatggagtttggatgggtcctgcgatggcctatgcggcttccggattcatctaggcacgagaggggactgcccacggccttgcgaggagtgggggtgaaacctgaggtgtggtgtgcttggttagagggggttatgcgaagggtcctgtcacggcctctttctagtatgtcgtggtggcatgccggcgcacgaaaacgtgtcgtggggttgtgtcttgtgggtacagttgtacacctctgatcagagtaaaactattcaaatggccgtgcccgtggttatgggcgatcaaccagattcaccgtgattagtctcaccctagtttagtctaatgaaattggatagtataggtggatggttgggcctgttgcaatgtggtatagcgttggacagtggatgattaatattgattaattgttacaactgctttactgctttcaacttctgtttataaatgctcgttttatgcaaatgaaccattatagctatcccttgataattccctgcatcatacccctattccggtatgacttgctgagtacagttggtaatactcagtcttgctctattttccccaaaccccagagtttgagtatgcgtcagatggtggtttctccgaggagtaggcttcgtccgtgccatcgaggatgcctgtggagtggtgttcccgctgtagttcaagtcaaggcttagctccagttatcttttgtttttccgctgcatttatgtaaaacttttataatgtttgtaagacgtggatctgtatgtcaactttgtcgtttgtgtaccccggccggtcctggacggggattttaatgcacattctgcttggaattctattcgaaaatttctgggcgtgacaccgtatctagcgtgccagacccaggcttgatccttcccctttgcgagaagggaaaccggttgcgccagctcgacgtggagaacgtagaggcgcccaactccttggcgcaccctacacagcagctgtcgctgtggatcatgcaaagtgagaacaccatcctcgatcaccgtcttgcaatgcgcctcatcaagctagccaaggctgaccatgttgctccgaagcttggggatgtagtagacgctagtgagcgcgcagtggtcaccattcttgcaagcgaacagcaccatgcctcgtccttcaatccagactctcgacgcatcaccaaacttgacagtgccgcgcacggtggtgtgaagctcggagaacacatcacggtagcccgtcatgtgatttgaagcgcccgtgtcaaggatccagtctagatcaacgggctttccttcatcctgaagagaaacgtgagcacgttcctccttcagtgtcacctccccgtcagtaatgacaggatcggtagcaggggcaagctcgcacacttgcgccatcagcagtgtcggctccccttcgtccgcggcttgagcaggctcggtgatgagaaggtttgcctgagccagtttctcgcggtctcgcttcgccttgcaacagtccttggcccagtgaccaagtttgccacagtaccggcatttgtccttggacacattgcggtttgccgcttgggacgaacctgacttgccgtcggagccgttgccgtcgcgctcgcgcctgctgcggtgtggttgccgtgagctggacgccctccccccggctgagttctgcccagcttccttgtttgagtgagcaggggcctccttttcgctgaagagcacctgacccgcgtcctcgccatcagagtcggggtgatcgtcgacggtgagaagccggccagtcagatcctcaatagaaagcaaggtcagtgtttgatgaaaacaaaacaacgaacacacagaaaatagggaaaccctgtattgcctttttattaatcatgattcattaacatgaatgtttacaaatacatgagggctcctgtaggagttcgccttttgccttcgtgaggaatgcttaatggagaggtatcttgacaggagattccgtgcagtccgctgattcccggcgctagcaatgaggcggccggttaattacatctataggagcgagcctatggaacacctccgattaagctgcgctttgtgatcgtcaacatcaaaatttggttgctcgccgaaggttgaggttggttcagatttaacggtgaatatagtgaatgtggaactgatggctttgttttgccaaaacccagtcacaatacactatcatcatgttagtatacggagggaatttggtgaagcgggtgacctttgcctcatcggtgcccactcatgtgccccggccttcatcaaacatggattttgtgattgcttttgcctcgtcggtgcccagcaacggtatatccagttcccgtccattttagacgtgttaatagtatagtgacctggccttgtcgacactcggccatggtttcatctaacctcgtcggtcatagacaaatggaatgagttaatgactgcagccttgtcagctttagccaatatgttatccggactcgtcggtctcggacatagcacaaatattgataaattggccatttcatctcgtcgacactcggccatgatgtcgacgtgtgttgtaaatctgcatgccttgccctcctggcgagcattgtttttgttgtcttcaagaattttgagagttgctcccatccatctggtagaatttagagagagaaggaattgctcccgcacatgacatgcacaaggcaaatctataattgttccggtatgaatataaatatgtataaatcatggttggtccgatgccgattagactcaaactcatcccaagtttatacaagtaaatatgcacatccgatattttatcatgagcgagaacatcaatatgcataaattatggttggtccgatgccaataaggctcaaactcatcccaagtttataaatatgcgcatccgattttttatcatgaacgagaatataaatatgtgtaaatcatggttggtctgatgccaataaggctcaaactcatcctaagtttatacaaataaatatccaactccaatatttgataacttagacggtccaaccccacgaggatcggactcgtctgcacaccactgatgatattttcttgacgaaaaacaagatcgatctgcttgttattcaggacggacgactcgccggcagagatgccatcagcgccggcggctctctaaggcatattgctgctgagccgcgcagcggtccgccgtctatgtgtgcttctcggtgacgacgtgtaaattgtgtatatgttggatatgggtttgtgaaactataagcagatcagagcacacagcatagttgcctacctacgtcttctcctctgccagccgcctctgcgccggggattttctcccacctcctgcgtcgtgagggacagcgccttatataagagtagaggcgacggagtcctcgcctaatcccttccgagatttcagcaagccagcgaaatcaagcgttaattctctggataagccagcgcgtctgttaatccaacgacctgcgcgtgataaaaagaattttgtgctccagataaaaagaacgtgtgtgtgctggagataatcacgaggattaacttggctaattgacggtggatcccacacctcatagggtgtgtttggataatgggaaatgaggggtgggattgggattaggaaatgaatgaagggttaggattaaatggatgagggagaataaatggttaggatttaaagatgagtgggaaatcatttcctttagacatttgccaaacactgccataaggataattaccaaccggtgaggagcagcaaacaaattaaggatatacgaggttaacactggttgatctccttcaaatgtttatatctccctaatcatatatcaaatatgaattctgttggaaccattattttccaatcaaaacatacaacaaaacgagtccaattttgaatatgtttgaacattgtatgatatttgaattttctggtcccacatgtcgtagagacatgtttcacgtgtatttcgtaaaattgggctgcaaattaatgcccaatgatatattattttttctatgaattttggtataaaaattcatcaaacagtgagatcaatcaaggtttcaatcgatagagccatttggcgatacctccggggaacgacgcgaagcaattttcaaacaaccttctcttcagacagatcatctccaaggactggagacgaaggctgaaatcctccaggtgttcgccattcttgaatcgcatggactcaaaagtttggcgcagcttctgtgctcgggactccttaacacgatctgcgcctactcgcatggatttgagcgcatcccaggcgtctttggcgctgtccttctcggcaagcggccggaccatctcagccggcaccgctcgcaagatggctgaaagcgcctggcaatcttcctgatacgggacatcgccggtgtcgacagcatcccacagaccttgagcctggagattgactcgcatcaacaccgcccaatcggagtaatttgagcgtctgagtattggatagtagacggagccatcttccttaacaatccgctgcacgacgagctgtcgcccgctcacgcgcggcggagacggcgagagccggcggcctgttcgccggtgagtgcgagacgaaccgctggcgggagcggacatggctctgataccaaatgatagcaaagcccaagattgtgaatcctcactctctctctcacgcgaattctctgaattggaaagacgatgaacacgaacagagtttttggtgtcgcgaaccaaccagcgacgttttctgatgctcatatatatagcaaatatgtacagactcaaactgacaccactacgccatcatccacgacgatgcgaccacgacactgaaatccggatgactcgcacacgacgcacgacccggaagactcggcttacaggaaaaagaaacagagaaacagacgccgaaacagagtctgacgaaactgaagaaacgacaacactagacacgttacagtaaccgataatacgacacatgattatagctgaagctaacagaaattccctaatcctttcctctccatcatcaatttcacttgttgaatgccgaaaattgaatctcttttgatgagttggatcttgtctcccggctgttcatcttttctttcttccttctcgatcggtcatcttcttcctctggccagcaggaggccgaagtcccatcagcaggaggccgaagccccatatctcatttcctcgcatgcagttcgaaccagcccgcctgcgcgcttcagctagccccggccgtgccatcacatcaccagccaaatccccggcgaaacccctccatcaattttctccaccaaagccaaaaaatgagtaaccatcatcagtcagtcacctcaatttccatcgtctcagctaaaaaaatgaataaacatcttccggctggccgctcaactccctgtcctcctctataagtagatccagcaccccctccttttccctttgcagaccaccgttcctgccacaccgtgccgtcgccgccgccggtcaacaccaaggccaaggccacctcccatgcatcttcctcacctccggcgacacgcctgcatccctccaccggccgttcgctgcgaacttgcactgccgcctctctctccatcgtcgtccaccggaccatgtcttgctgctattgctgctcactataatccggcctaggttcctgcctcgggacatcgagtagacgcggttgtgttgcagtccgatcgagtgagcaccaatgttgccgctgtcatcgcaagcacgagctgctccatgggaagatcgagccggcatgatggtcgtctcatttccagcactgctaccatcgttgggagatctctcaattaccagcgaatggcgcagcactgttatgccatccacctctgtcgtcttccccacttcctgcgccgtcttccatcaagccatccaccatcgccatcaacttgttgtcaaccacccggcattgctgccacctctctatcgtggtaagcacctgcgccgctttcacgttcttcctccctaatcatcatctagtgtgagaaaaccattttggttatattcgcagatcacaaacaatatcatcgttgcccagtttccaacatagctgccacctcaatgtcctcatcagtggttaatccccggtcctctcccatgtgttgtcgttgtcgccttcgtgcagaggtgctgctgccatcgtggaatggtgccaccctctcgccctcatgatagctgcctaaactaggattcagaactggagacacacaagatatatcgacggggatttccaacgaattccgccgccgccaatcgccactaccaagttctaaatcgataaaaaggtttacaggagttgtgtgtttagttttatcactcccactcactccccacacacgcttacagtctggcacttgggccgaataaccactcaggcttacaatgcccattctggtccacttaaacgaacattcccccttttaagtctactacctctcccttcgatcttctcctccttggcaatgtcagcatcagcacccaacgcagccttgacaatgttccccccttgaaaactggattgcccccaagccagtgctcttgggaaacgagtacgaagatcttccaagtcttcccaagttgcattggcgatcacatcatcagaccaatgtataagcacctgaggaataacagacatacctgacttgcgcaccctagtatccagaatagccacaggaacttgtttagtagaagactgaacaggaagatgaacagaagcatcccctttaaaaccttgagctgctttgagctgcgagacatgaaaaacagggtgaatagagctgctcgccggaaggactaaacggtatgctacaacaccaatcttctcttgaatttcataaggaccaaagaacttgaaactcagcttgtgattagccctggctgctactgaagtttggacatatggctgtaacttcaaatagacccaatctcccactgcaaaagctctaaaacttcttttcttgtcagcttggctcttcataaactgttgtgctctgttcaaatgttgctgcaagagttgtatcattaaccctcattcattcaacaactgctggacatttggaagttcacaagagttaacagtaatgcccaattggttaggaatatgcccatacaatacttcgaaaggggttttattcagtgtggagtgatagctagtattgtaccaatactcagcccaaatatagccaggtggaccatttagttggacaggaatgagtaaaacaacgcaaataagtctccaagcactgattcacacgttcagtctgtccatccgtctgagggtggtatgcagtactcatatgaagtttagtgcccacactgttaaacagctgcttccaaaagtggctagtaaagatgcgatctctatcagaaactatggccaggggtaaaccatgcagtctaaaaactccttccatgtacaactgagcaacgtctgcggcagataatggatgagctagccgtaaaaaatgggcatacctagatagcttatcaaccaccaccataatacagttgaatcgcctggaggttggaagcccttcgataaaatccatcgtgacatttgccagctcccaatggaaccggcaagggttgcaataacccggggtacttagaacgatccggcttcgcttgctgacaaatagagcactccttcaccttgagcttgatctgtttcttcataccaggccaagcaaaaagggccttgatccttcgataagtcacaggaaatccggaatgcccaccgatgctactgtcatgcaaggcactaaaaattttctattgcaactcaatattctgtcccaaccagattcgtcctctgtatcgaataagaccatccttaagttggtatggagagtcagccttagagtgaatggctaattcagacagtaactaagtagccttggcatccttcaaatacccattaacaacctcttccagccaagtgggcttacaaaccgaaatagcaaccacctccaaagaagagttatggtcacatctggaccgggcatcagctgcttcattgtggattcctttcttgtaacaaattttgaactgcagccctagcaactttgtataggccttttgttgccaaggagtatgcaagcgctgatcagtaagattcatcaagctcttgtggtcagtgagtatagtgaactctgcatactgaaggtaggaccgccaatgctcaattgccaataggattgccaagcattctttttcataagtggataaccccctagtacgaggacccaatgccttactcatataagcaatggggtgtttatcctgggacaaaactgcaccaattccgatctcactagcatcagtctcaatgacagaaggtttagtaaaatccggaagagcaagaacaggagctgaagccaaagctttcttaaattgctcgaaggactcatgcacctccggagtccacacaaactcaaccccttttcttaacaggtttgtgagtggtttactaatcacaccaaaattcttcacgaatttgtgataatacccagctattcccaagaatcccctcaacttctttaaggtagtaggaatagcccaattgacaatatcttgtaccttgctagggtcagtggaaactccagccactccaatagtatgccctaaataattgagttccttcagagcaaaagagcacttgctcaatttcaccttccactgatgatcctgcaagagttgcaagacagttctaagatcttgagcatgagcttccaaggttggactgtaaatcagtatgtcatcaaagaacaccaaggcgcacttccttaagaccgaagccaaggtttcattcatagctccttggaaggttgcaagtgcccctgtcaacccaaaggacatcacccgatactcaaagtgcccaaaatgagtttgaaaggcggtcttaggttcctctccagcaaccaacctgatttgatgatatcccgccctcaaatccaacttagaaaaccaacctgtgccggccaattcatctaaaagttcatcaataacaggcagggggtatttgctcttgatggtgatagcattaagcagtctatgatccacacaaagcctccaggtgccatctttcttattaactagcaatgccagagatgaatacggactaacactaggatgaataactccagactttaacatatctcgtacttgctgttcaatttcatccttctgggctggattgtatccatagggccgaaggttgaccggcttagacccaggaattaatggaatggaatggtcacaacgcctcctaggtggcagtccttgtggttcttcaaaaactgaattgaattcattcatcacttcttgtatcataatgggaatctcaggtttatgtatgtcggtttcactggtaatctgaaacagatgcataagagctcccattttgcacaagcccatgagtttatctccagatattagaggacaggcatcaaccttgggcatcaccccttgaatcctaactggacttccattgatctcatattccaaccacttttgaacccaaattattctcatgactcccagcccttgtaaccagtctatccccaggatggcatcatacccaggcagggaaagcaatttaaagttggttctataacatctcccctgaagccaccaagcataatccggtaattgtttgtcacaaatcagaacttcaccactagcaaccttaaccttaacaggttgtggaagggatgtaactccttgcattgtctgaacaatattctcatctaagaaggaatgagaactgccagagtcaataagcatcagtaatttagtcccctgtatcaaccccttgactctgaaagaatgagtagaatctgtgccgttacaagcactagccaaaagcgccatcaaggagtctttctgggaggaatcaagtccattaacttcttcttccatatcaccttgaaatgcttccaacaattcctctaccacatgcaactgcacagtttgggaacatttgtggtccttactccatcgttctccacatgtaaaacacaacccttcagccctcctgtaagatttcagagccaagaccttatcttccctgactcaatcagcttcctgtcatctccagtagtctgagcaggactttttggccaaacagttggctgagtaggtcgggaaaacaccttgttgaaattggttccatcagatttcctgtaacttggttttctgcttccttccaatatttcttcctgtagcaatgccattaagcaagctccataaggtccaccggtctctgaagcataactgcccctctaatgtcatccttcaagccatccacaaacttagttaggaagtaccttggtgtaagggcattgtcatacgccaacagctgatgcatgagactatcaaatctctccacatactcagtcacactgcctgtctgcgctacatgaaaccacagtctaataagaatttcttgcctatcccttgtaaacttacggcacactctatcacataactccaaccaggaaatccctaccaactcattcctaacagattgcaaccagaacgaagcacttccagtgaaattcagcagagcaaccttaacccaattagcaggatgtaccccatagacctcaaaataaatttcacagttatctctccacatctggggattttctccatcaaactgagggcaagacatagaagggacattgccaccaatactagccattccagaatcaaagattggacaacccgagttctcaggagtaaatgggcttacagaattgaactgcggaggatttcgccatccttgttggggtgtgaacaggaaaggattcggtgagtttccattgaggtcatcatcatttgggaattgagttggtccttggctggattcccctttgtatagcgcgttctgctgaacttcccgctgacatttctccacacttgcctgcaaggaattcaccctcttcgccaaatcattcgcagaaccccccaactcgctcacctgtttctccaccaagggtatgcgggactccatcgcaagcttcaacagctgcaactccacaagattcagggcctccgactcctcgcgcttcctatccatctcctcccgctccttctcggcctcctccatcatcttcaacaagagatcgagtttcccatcttgagccatgatttgagccgcttgcttagtggtataccgaggtcgctccaggatgatcgctggttcctaccccgaatctagccaaccagatcaagggagccccaaaaggcttttgcggaatatcactgtaaacagcggatccccacctatctcatggaattttacggctcgaccaagggaattcaagaaaccaagaagatctgagggctctgataccaaattgatagctgcctaaactaggattcagaactggagacacacaaggtatatcgacggggatttccaacgaattccgccgctgccgccgccaatcgccaccgccaagttctaaatcgataaaaaggtttacaggagttgcgtgttcagttttatcactcccactcactccccacacacgcttacagtctggcacttgggtcgaataaccactcacgcttacaaggcccattctggcccacttaaacgaacattcccccttttaagtctactacctctcccttcgatcttctcctccttggcaatgtcagcatcagcacccaacgcagccttgacacctcaactccagaagttccttctaccaccggtgattaccctattgctatcttctcttcctagtgctgctgcccttttctttttattaacgcacgctgagatgtcgtcagcttcttccccatcgctagagccgccttgatccaagctgccattgcatctctgtcccgatgtagcggatgtgccgacgactcagtccgttgcttcgccttcatccccttggctgcctatgccatccgccatcttcatcagctgactagtgccaccgcatcctctccatttctgcgcctataccgtgacgcatcgtgcgcacgcacgtcgtcctgctgccaggggctacagttgtcatccccacacgtcgtccatggcggttgcatcgttggtgagtatcagtctactcccatcttccttcttctacatcattgatcaacgccactgtcatagctaagtgacattatcttagtcaattccatcttctcatctagcgaccgtacgttgttgtcttccttaagtcggtcttttcttttgttcctagcaccatcaaactaccggtggttgtgccatcgtcactatgtcacccctacccgctggtcccttgttcttcctatattaatctcatgcaaaaataatacttttatttcagaaattccagtggaacattctaaaaatattccctgttcattctaagtttccatcttccgatagcagtagctccttcatcaaccaggcccaccactctgtttcttccaacgccatcccagtggttgtgtgcatcattgttctttatactatccaaaggatcggagatgccaccactgttatcctcgccaacgcctcgttgtcaaaccgccgccacttcactgttcccaaaccacgtcgttgttggcactaccaccaccatttttttcctggtactacctctaccatcttccaaccctccggcttcacctccaccatctggtgctgtctctcgctgtttgccatcatctggagagcataggctgctacctccgaaatttcagtcgacgccatcatcaaccgtagaccataggccgtccattggcaccacctccttgtcgttgaccacccatcgttgcaccactgcctctgcagccatattccattctcagctttttcttcctcacctagcactgttagcgaaaatggatcttcgttggcggccaagttaagaggactgtcaatgaagatgcaccctttttgctggcggcccacctaagccaccgctagcaaaaatccatctcagttctttatcttccttttaacttccgctagcaaaaaatgtgggagcgcgtgcggaactgaaattttaacttcctcttttttttctcggctccccatatccatctcagcagcgactctctctctctctctcacgacttgtctccctctttatctctcgcaacttctctcggctccccatatctcaacggcaggcggcagcgcgtggcggagctcagcggcagagtgtaggggaggcagcgacgcggtccagcgcacgtggcctcgacgactgggcggccacgctcctgggagcggtgatggtgacccgaccctcctctccctttcccagatctagccagaggggaggggacgtggatccagtggcagcaggttggaggggcatggatccagcggcggcaggttggaggggggtggattcggtggcggcaagtcggaggggcgtggatccagtggcgggtcactgtggcacggatccggtggctagggttgcggctcggtgatggatgaagcgacctcgaccatggttggtcacggtggcacagatctggcggcgggggcggttctcctcctctctgcccctcgggtcctctccctcttcccctgcctcccaccggcggcgcgtggcctcctcctctccgccatggcttcctgcgtcgtcctcctcttttccgctgggccgcaacaacggatcctccatggacggtggctgccatgatgacgacgacggctaccacgacgatgacgcctgggctcctccaatcccctcccctctaccacctggtgaccgcggtgtgggctttggcaggcggtggccaccgcgggctgtatttgcagccatggcgaccagtggtggttacggctatggcggcctgcaacaccgattttgattttttttatccccaaaattgttatcaccgatggtcctctttagcttgccgcaccatttttgctagcggctgtctaattaagcatgtccggttgcgaaactcaattttcgctggccagccggccgctagtgaaaatgcattattttcactggccgttagtcgctggtgacacttctggccaccagcgaaactctattttgactgtcagcaacaactaattttctaatagtgacatatcgtgctctgtgtcttccaaattttctatccactattttttcccgataagacctattaggcacataccatcccactgatgggtggatcatgctcatcagttctccaaaaataatatcttgttccagaattactaaagagacagtccacaaatcttcgtttacctttccatccaaattatctcaaaattcaatcttccaattgttatatctcctccatccgaactccgaattgacctgtttattttcttaagttaattcttcaaaagttgagctctatcttccgatttaattagttattttatttgttgttatttttctgccttttctttttgtttatttgtttttatcccttttaagatcatgtagacgttgccgccgaggaagttgctattgcaggtgaagttcagtgtgaaaatcccatgggtaaaggcaaatatacccttgaacatgttttgaacatgttgatcccaacttacaaatttatctcgtttcaaattatatgcattatgttgtttttcaaattatcgtgtgggtctagagccgaccggccatcgagcctgtgtggctgtccacgtcaccgccattacgtcgctcccatccaatataggtcaaaatccggtgtcaccatgtggcgccatctctaaaccctagatcgagttcaatctgagccgtccgatatagtcaaaatccagtcaatcgatgtcagcccttcatccatcctcgagtgatctaatccgttgatactctgtcaacttagtcaaaccgagctctgccgtcatcattttccccctctgccatccaattaatttgaagtaatcttttctttaataggtttaattggattaaaccttgtaaaattcataactaattcatatgaagttggaatgaggctgttcaagtcttataattcttataaaatcatgctctacatgtttgtttactttttatgtactatttatttggagtttttttattcttttttctcgttttgcctgttagcttgtcatttaattctgtcgttttggaggtttatgagtgcattggaagagtttcagaagattaattgaagaccgattattgcaagacagatcccaaacatatacaatccctttgagcatgttgatcttatatttaaattctctatttatttcaaatgttcatttttttaatgtcattgtgtggtgtgaacacatattcctttgtatagctaatttgtactgattaccttattccttgttaacctagattatactttgactagtttggactttatacattggtccaactagatactccctccatctatttttgatagtcatatttccaaatctgaaaattttatttttaataggcatatttcaatccaacaacttatcatcttaatgactttcttagatttaatgcatgactcttcattcttccacaccagattggttgcatgagcatcgagaaatgtaaatattaatgaatcgcttgtttacgaggaattactagtagcatatttaaatggatgataagtagaatcacttatccttggtctgtgtgtcaagatgaagtatgactatcaaaagtagatggagggagtatttagtataatttgctttgccatgcttagacactttagtgtcatttatgtgggaataattaatgcttccctcatgattaatgatgattaattagtgatatctcgtgacgattggtagtgctgattggtagtgcttggtttattaacttgacaaataaaattttactaatggtgagttgtgagcacatagtgtgttggacgtcctcatgacaactaaggactagtttacgagctagtgttgtgaagcattaaccatattaaccacgagcaagaataggcaacgacttagatctgtagtataatatgaccaacgacagatgccacggtatgttgtgtttttatcgtggcagacaactaagtccacaggtgataggtgatagacaattaagtccactgtttgggcattaggtagtctccctgttagggaactggccatccctaccggagacagatgcttagtgggtgtcattcggttgggcatgttatgcaaatggtcttgtcaaagttttcccctttgcaataccatggcggtatttcggggcatggcaacatgtgtagaattagtgttttgtgggtaaatttgtacacctctggccaaaataaaactattcgaattgctgcgcccacggtcatgggtgggcctagcaatgttttttgtgattagtaccgcactattcattaataataataattggtgattataatttgttagctactgttatggagtttagatctgtgcaactggggttagttgttcagagatggttaggcctgtgcagcattggtgtacttcagtgttgattaatattgatgattaattactctaatgttttactactctcaaatatttgctaaatactacttttgcaaatgaaccctttattatgccatcctttgttattcctgtgcacttgcatatttgtgtggcttgctgagtatttcatgtgctcactcttgcaataataaataaacctcagttgaagaaagtagcgaagcaaaaaacatttggcttatacctcacttaagctgcctatgggagtgtagctgaagccatctctagatcatctgtccggtgctgttttcttttcttttgtaagtatttaacgatattatattgatgaatttgtttattaaattattgatttgtgtacctcggttgattctttgacgagaattgtatgtgtaaattagttcggacgtgacaattaaagaagaagagattgagggattccattcccgcgataaatttggaagaggaggcaatgaggaagccgaatcgagcggacaaggcggtggtgtggcgcacgggcacgggagggaggccggctggaggttagggccgtcagtgtagcatggggaacgtgaagtagacttttgtttctttcttgggccggttgaaggagggaggacaacggacttgctccgagggatgaggaggggctgctggctcgagctgggccgacggggagagatggaaggaaatgggcccaactcggccaagactgggaagaggatttattacctttttaacttaaataattactgaaatgttgtttgtattattaaaattagtaactgagctataaaaatccgaaaaatttttagagagtatagttcatcaaggagaatttaacaaaaattaaatcagaccatgttttacttaggaaattttatttcccaaatttaacttcagttgtaaataatgaaatttaatgaaaattctaggaataatttatatgtccttaaaacgaaaatcaaggtgtgacagatttacccccttaccaggaatctcgtccagagatttggaacaactagaaagaaaagggcatatgtaaactgcattctatcttatttcattactctaataattattctaaggccaaaaggaagctactgctgctttggaactgatggctgagttttatcacttgaagacgcaattggcacgacattggctcctatgacgacaatgttgttgacttgaccttgtgacatctgatgcttcagcttcgaacactctcttacaaagtgacttgactcataacagttgaaacacaccaactgcttccttccattaccgttgtcttcttgaggctaatttggctaagctggtattgattgaggagtttgctcgttgctgacttcattgcccgcattattctctgagttgatctcaccaccattcttgaactattgcgactattcttgagaggtagaacttgattcctcaatttggagtggcttgatacgttgcctctggctactaccctgtgcttcctttgaaaccaacattcccctcttgcagctatccaccagtgatcagcatatatagtcatcggaaatcaacgcatatatagtcatcggaaatcaacttaactgacatcttatcatttagtccctccaagaacttctccgatctttcttcatcagtacgcacatcttttggagcataacatgctagacagctaaactcgtgaagataatactctctcacagtgtgatccttttgttttagtgtcctaaactcgcacttcttcaaagcaacaactcctgcaggtatgtatgtcttcttgaatcctttagtgaagtcagtcaagttgattggttgttcttctactctgttcattcggaagtgatcccatcattctaaagtaggtccatgcaactgatgcgaagcaaaaatgactttctcctgatccgtgcactggagcagtcccaacttcttctcgatagcatgcaactagtcactagcttcaataaggttggtagtgctagagaatgtaggtggcctcacacaaagaaattcagctaactttttctggggcggaggattgttgttaccttggtcaaactggttatccatctgctacatcatcatgttcatgagctgagtctattgagccaagacttgtgtgatggttgggttctcatcgttgttattatttccactttccactggcgcgagtgttcaccatctgttgtagatttggagagggtagaaggagaggggttacactaaagataagaccttaaccatgtttccactggtctgatgtgtgtaaaatattatattgttcaagttgattaagcaaacaacctagtacagttacacgctcgtcaatgatgaaaatgctaccatacctacacacaaccaagcaacaaatgttatactcttgcaaaagagtggtttagattctaaggtagtatccaaaacttcattccatctcgaaagctcgatacttcagttcttcagttcaaccacatcttcttgttccacgatacacttgacttgactttggcatcttcaagtttctccagaaagcttaacaactattcaagttgaaggaggaaggggagattgataaaatgatttgcaaagaattatggagaaggaagaaagggaaaattttcacaaataaagtttcggaaaatttgtcattatggtt

SEQ ID NO: 42058 - DNA, 8678 bp, Oryza sativa
aagatgggttttgcaaaaagaaaagctaaaccagctaccggagccgatttagagatcaaaatcagcctctaggccgatttagattgatatgaggataactacccgtctcgtgggcacaacggaaggttttcaggacaaacctacaaagaggtaccgcactctcgtagcggcggcagacggtttacggcgcaaaccgacaaagatggactaaaactaaggtaaaatagaaaacatagtaaaagaacgattcaaatagattgtattcgggggttttacaatggaccggccttgtcccttaaataggggttggtcttgctctctacaggcccttctctacatccaactcgggatagaaaccaaagaaaacacaaaacctgccttcccgagtaaggaaacccgtcactttccaaactttaacaattttcccctatttcgtccataggtgccaaatttaggtgtaaacaatttggtcagccatatagtctagctagctggatggagatgttgttgaaggctaattttttccttcgctagataaaatttggcttggagagccccttaggaaatgctcttataaatattatgcacgtgctaactaacttaggcgtcaacgtcaacgtgcacgttgattttctagtatatagtctggttgaaaactgagttggtatagctagagataaaaatgcaaatgagtatgacaattttcaatcgaagttgcgtgtcaattatttatttttgggtcggacgttcccgggacaaaggaagagtcaaactgcaaattaagctggaatttacaaagacacgatggtacatttattgaatcacacaatggcgggcgtacgacgacgaccgattcatgttgaccgaccctgccggtcgtgaggtgaccaaattaagaaccgatggattatccggtcccacgaaacagtgacttgagcttcctgatctccaggtcgtccagcacggtgaccttgctcaggacatcggttgggaggttgttggcgaagagcgcgaagtccatgatctgcaggccggggttggagctgctgtagaaggagaccgccatggccgccgtcgcgttgttgccgtcgccgccgccaccgttgtcgttgatctggaagtgcaggaggccctgcgggaacaccatgaggtcgcccttgcggagcgtgctggtgtacaacatgttggatgtagagctgatgaatccggcggacagggtcccctcaacgacgtagatgagctcggtgccgctcgggtgggagtgcagcggcacgatgccgccgggggagaagtcgacacgtgcggcggagatgtcgagcccgttcacgccgggaaacctggtttgcactttcgatttcggtcaaaaatttcggtaacattttgaattttacaaaattttagtacttttaactaaatcttaacaaattttgatcaatttaaaaaaactaaaaaattccgatgagataatcattaggatagggggaggagccaggtgtcctaatttacgataatttcgagccgaaattgtaatcatttacctagtggagaaggccgaggacagggcgatgttgaaggggttgacggtcgggccggtggtgactaggccgcggtagcagaagtcttcggcggtgacggtggcctcgggcttgcacgggtagccggccggcgtgtcgccgcgggccaggtcgccgacgcagaagtcctggttcagggccagggagccggaggacatgatcagggagagcaagggcaggagcagcagcatggcgttgcccatggtttgtgacttgtgagcatgcaatgccattgtacgcagtgtctagtgtcgtacttataagagagtgcaaagtaccgacggatgaccgtctaaaccagtactccctccgttctattttaaacgtagtcatgagtttacgtattcaattttgattgtccgtcttatataatttttttttaaaaaaataaaaaatagaagccatgcataaattactattcatatttttatcatctaataacaataaaaatactaatcataaaaaaattaaataaaacgaactattaaagttggacacgaaaactcatgacggcttaaatgggacaatgggacagagatgactacgtttaaaatgggatggatgtggtagcttagtagtccaattcatcacacacgtacaattctatatacaaataagtttcatgtactgaactacatatttaatccaacttgaaattgattaagtgatcctctagcttcttggagaagtcaacaaacagggtaggtaaacgactaatccaatttgaaaatgatttagtgacgtagtactctatctttctctggcgaagttaacactgctaaaaaaacatttttgtaagccgtcgataactcgtatccgcatgtgttcttcgaaccacctgcgactaagggatggcgcgcagaaatcgagattttcttgcacatgcgcatttccatggaaaatatcaaatatagacaaaccctataatcagttgtattatattgtattgcattgactacagagagaagataaaaactggtgtaaaatatatgctagaatagatttatctctatgattataccttgtatccatggttcgtgtttgactctaactctaactacacatatatgcacttttaacgatctccttctattgtaatgggagcgaagagaacgaatatgtttccatgagaattctatatgcaaataagtttggcaacatttattataggacattaaaaaacgtgtaatcagcttgaagacattgcaagaacacatatctgttgtgggacatcgtaaaaaactggtagttagctactgagcacatgcaatattattttattataactagagcaaatgaagagagaaatagtcatgaaagtatgattttgcccttatttgccatgtgtgtctcgcatatagcactgacgtcgtggtggccaagacatgaaccaggaggtggtccacgttgcgctcgcctgcaagtgtggtgtgtggcagagcatgagcgccaacgtggccctcgcgctgaagtagcgacgagtgtgggaatgatgcgtagtccgtgcctaggtgtgcatactccctcccccccctcccccacacctgaaacaccagagagtcgcctagccggcgacggcgactgggggtgcagttgctatatgcgagtagggcttggcaggcaaggataaaatcatacttttgtaactgtttctctctcatttttcttagatattataaaataatgtcatgggtgtccagcaggctaattaccagttttttcggtgtcccacagcatgtacgcgttcttgcggtgtacctcagctaattatatattttttggatgtctcatagcaaattttgccaataagcttcatcacacatatacaattctatatgcatataagtttgatgtactgaacaacttatataatccaactagaaatttattaagtgatcctctagattcctggggaagttaacaagctaccttagtgttccatggaatcgtgattgttcccttcaggggcaggcccaggattttaagattgggtattcgaaatggaaagggggtaaaaaaatttttttacaacatgagcacaatatttggtacgtataatcaacaatatggcgacaaaactcgatccggtttctgaacgaacacgctacttagccccgcaaatcgcagcaccacgtctcatctggttatcaaccgtgccgaaacccggttaatctcgccgagaaggctaatccctacatgcgaatcgaagaacacaagcaagaacgagatagattgcaacacaattgcatatgaatgattaagcactcgaatttggggttccacaaaccgatctagcggcgatactattcttgacagattaatctaagcaaaaaccgacttaaaacgatgacgactactgaacaaatataattagggatgtcctagggttgccctagggcgcacacccccttgggctaagtccatgacacaattacaaggcccaaaacccaaatcagattcggactggatgaaatacgtggcttattttgcagattcccggcagctcggtaggaattttaacacgggaccaaaaccatatgaaagtagactccataagctttctaacaagtactcataggcaccgaaaatccttctagatcagcggttaggtccatttgaagttgatgctatcaggaggcccgaatccgaatgcaaaacgtgtaaaactttatctcttgtcttctatagaccaaaagtgacatggtgagatggaagtagacttggagaaggtcttagtttggtccccaatcaacttctttgatcatccatgcattcgttacgctcggtctcttttccttcaccaaagcaagtatctctgtaaacaaaaaaaacacacgaaactcattgtgtagcaatgtttgttcaaatatataacaagtaaatccaatatagaacatatgcacatttggttgagtaatacataagatagtcaaggttatatccgagctagttgtgtcctcatcatgaaggacgaaaatcggatttggtgtaaagttaagggacctcaaatgaatttattccacatataaatgcagaaaaaaaagcccaaggcctagcggcatagtctgactcaccagcacacaaatccatcgggcatgcacgtgcgcttgtagggtacttcactagttttctctgtttctcatctccagtctcgtactttcctgttggccatttggcggcgtggcacggcgcatgcgaatttactttctctggatgattcatattcatgaaatgtgaaaacaataagttcaaagaggacctaggtttgtgatttagattaaattgaatcgatcaaatgagcgttcgttttccttgtaggaagataaaaatgaagatgatcaagtgcataaagattagtaacgtcattgagagaaattttctttaagattagacatgaatgaatgatgatgcgtgcaagcaatttctaagctacaaaaaccatcttataaacataatttcttttcattgtttgtcttatgtaagacatgacctacactatctattccatacttgggggtaaactaagatcttttaccctatttgtgtacttgtgtgtatgagtgactctgattcggctcttgaggattgtgtgggcacacccacgacaaaatacctaggtccgccacttggtggtgagatcgagctgcatattgatgagatggatgtcgagacacagtggaagatttatcgatctgcaacaactccaacaagaatcgacgggctgcaaattgttgaacggtgaaaatgctgatgtcattgatgctttcttggctaacaatagtgatgatgtgctgatgaagtgtacaacggtgaggtggtaatggcaatagtaatagcaacatgctttgttcttggctcctgttagctctccagtaatcaaatcacatattgttcattgaacagcttgccacactttttttccattaaatagtctcgacgtctagtagtgtctatcacaataaaccgtctgtcagataaaataaaatctgatctgacaatagagaatgagatgagggtagtgttatcacaatgttgctagaagccgagaaccatgatgtaaaaaaccacatggagtattgtgggagcggaaaaatagacaaaaatgatagaaaaattaagtagacacgtctactctagtttctacatgatatggcaatctcgtacatcaccgccggacccttgtgtattgcttaatttgtacgttcagattgcttggtagcattctgcattggtaagttagctctttgctgcataaattgatatcgagttcttccagagatggtgggaggccctcttctggcaaccttgtgatgcgagtacaatgccaaatctccaacctcttgagtgagggaaggcggtgtaatccggcaggaaaatctatgaattcgctgcacgcaaatttgagctcttgcagggacgagaggtgctgaagcgctttctcttgctcatccaatagtctctcctctccgcgtctgtgtttttcaagctctaggcgtttgagggagccaaggtacttgaagaacgatgtagaaaggattctgggatcatcgatctctagtctttccaatcgagggaataactcatcaacccgccctggaaaccaaagaaaagatggggacaagctggggcatttgtatactttcaaaaacctgagattgcagagggattgcgagacctctattttggtgagctgtgaacattctcgaatctccaactcttcaagtgccgtgcagcattgcaactgcagacattccaaacttgcgttgttctgcactagtaattttttgaggcggacgggcttccctataaaacagggtagcgccgtttgtagggaataatcatgtacgctcgcctggtcatcatttttgccgttatgcacagaagacaagctgaaattgcgagatttgtctgaacaactgcaatgaatcttcttcagagaggagacgagatttaacggaattcgcaggagtccgtcttcagctgagcttatcgaagcgtcacttggatgtcttgacgaggaagcctcaagatctaacaaaagctctagttgacacttttcctcctctcccatcgatagtctcgttaccgccaggcaatttcttaatgtcaattcctgtacgccctgcacatgttgcagtatctgagatagccacttccccgttattccacattctgtaatactgacaagttcaagagatgggcggtcattgcgatttccaattccagctaccatgtcttcacgggtagaagtaggctcttgcggaacatctgaagagaaaagattttgacactcgtctatcttcagcctcttcaaatggatcagttgcctgagtccttccaacgaaatatatctcagatttcggcattgtgatatatgcaaagtagttacaaacctactaaggttgtggtagggcaacactgttttatccatcgctgtcagcttatcagaaaatgagttactcctaatataaaatattccttcgtttgacctcatcgttggaagtgttgaaattccattgatgaagaactctgaaacagtagttgaagggggaaaaggatgaggcacagtgaaatcaggacaatcatcgatggtgaggttgctgaggtggggcaaccatgagcaccccaagttacggcagttctcaaacaacggaaagaccttcagaaccgggcaccttttaatcttcaggatccttaaactggagttgaagtccaccatggaagtgcaagagcacgtatgcaagttttgcattccaattaaaataatatcctgcggtgaacggattgagagcaccgatgcattcttcatctcgatcaacacaagctttctaagcaatgatagcccttctaaagaaagtgtatgccattctgcacaattttctagacgaagtgtttgcagataggtaagtgaagtggaaagccaagttggggctttagttccattgtaccaagatatccgtagatacttgaggttgtgatggggttcaagaccttcaagctcctcacttgctatgtctagaatatgatctaaactaggggcaccattgctatcactcatttgcaatctctccccttctgtttctgagtgcatagaaggttcggatatcatgttaccatcgcattcattttcagagctcccaccactgtcgtatctattcccgtcactgtcatatccattccgtacacccttccagaacaaatgtagtccctccaagcaatggttgcttttcaggcttgctccactggcctcttgctgagttgtaacgttttcaagtcgagacacacccggttctacgggctcgctcatgcattgaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactctttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaaatgatggttatattgcccaattagtaccaatgtcctcaacttactccttgacataactttcatcaaacttttctcaaattcctcattacgagataattttccattttgatacttgcagtatgcagaattagttactatcgacaaatgacgtatactcggtgctaactctctgcactctgatccatctatagttgcacattctgtttgtgaaaccagtcgtgctaaatcatgcataagatcatgcataacaaaaactactgatgaagaccaccaactttcagcttgctgaaagaaacccgagttcaccaactcagttagatattcccatcctttgtgctcgaacttctcactggatttttccacaaatccttgag

SEQ ID NO: 42059 - DNA, 12361 bp, Oryza sativa
  unsure (1)..(12361): unsure at all n locations
taaatttattgatcctgccgttccacacctttgagcgacagtcagtattcgagttgtcacaatgatcatattacctgtcacttctgatgcattcacatgattaggtcttaaaggacccagtagtttgttccaacagtcttctgtagtgacatcccagacatcatccaaaacaatcagaaacttcttagatttcatgtgtttctcaagatcctgctgaagcatgttaaagttgcttattccttggtaacttcggttggagacacaccctaaaatctcccttgtgatcctaaccacatcaaatttatcagatacatggacccatatcttgatctcaaactgatttccgatttccggatcattataaacatgttgggacagagtggttttccctatccctcctatgcctacaattggtaggacggttatgtcattggatttatttcccatgattagatttttgatggattccatctctgcatctctcccatacattttgggctcaagaggataagatgatgttattgcatttggggccaggggtgtactctcacacctctgatttaaacttgcatacccacatagcctcataaccccatttacagcctcttgtaactgatgagtcatatgttggatcatgttggagagttcacccctgttccaaggatgcgtgctaactgcctcgtggagtgttgaagtgccatccatcctcatcctttttctgccaactgaattaccaggtgcatttggtgcaccctcaccggcactgcaaaagaatgtgatcgtggttcggcaattagcaaagtcagcgatataacacgatcttaagcagataaacgcagacggttaactcagcggaattaagagctactccctccgtttcataatgtaagtcattttaccatttcccacattcatattgatgttaatgaatctagatctagattcattaacatcaatatgaatatagtaaatgctagaatgacttatattgtggaacggaggaagtacgtgccttatgtggctacgtaaacattctattgaagattacagagcttcaattctccgtttttatatttgacttttattaccatgatctacatcataatggctgacgcgctaaaacgcatctacatatgcgataacttaaaaagatgttccttatatagaaataaaatttttaaagcgggttacatcatcctcaaattactcttatcgcaccctttttttattagtagtggtcatagtaaaatctttaatgcattagttgactattaatccataccaaagggcaaatggacttattatagttactaggaatgtagcctgtgtatacgcacggacatgttgtttaatgttgttagaatttttattacgaatatttatgtgtggatgatatttttgaaatatttatttaatctattttaaacgtgtatttgttaataactggtttggtcgtattactactagaaactgtatatccttaaatttcttagaaacaaacgtgtcacaataatggagttggttcgtagctatttgtattatgtgtgattctatttttaaaatttttcgagtttccgaacttatataacattttttattttgtatgccatagattactttaagtagcattttaattttattatatatttctaaaatatattttctattaaaaatatacttcatccattttatattataagactttctagcattgcccacatttatataaatgttaatgaatctagacacctatcaatctagacacataggtgtctagattcattaacatctatatcaatgtgggcaatagctaatgatactacttcatctagccaaagatgatttatattacttatacttcctctgtcacataaatcggaggagttaaattttattctaaaacaatagaataatttatatgtaactgagacaaagtaattttttaaaatactagcacgataatctccaaagtaccgtattatatttttgacagatatctatagtgtaatgcacgttagttcagtgtctggtttcttttcaacacctattctttctaacgacatgagacacctttagtaatttggagaatacgtatgtacatttaaattagcattgtatattcatcaagtttttttacacctaagatatgatgtgaaattattatcatagcgttaattattacttgtcggttccatatgttttgatgtattttgggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaattctatttttaggactcccaatctttttggctttattataagtatgttttctattgttccggcaaatgatacgtaatcatcattgttctttaaatcatatgtacgtatggagtactttttctggttaatagctatatgtttctcatgtatccgtatatacgataatttttttatttttaaataataaatctaatataatggtgtaaaataaaaaaactaaattgtgttgttttcatttctacatatgtatatttaaattagcgttgcatatttatatttgtgatatttgagaccctaaaatatgatatgaaataaaattagcatcacattagaaatagatatgcatatttatttgcgaggagtagcggtgggctcctgctcgtgtgccatttttgagcctggcagacgccacgtcacctgatctaagggcaaaatgactatcttgtccttcttcttaattcatttctcctccccttcctcagtcccttttacatctttccttttccttgccagtgagctgcttaggctccggcgagctccccgccttgtgctcctccctccctcactcgactccctacatccccagcccctcctctattcctactgccaacgtcatcaaggatcagcgggcatggctgtccggcaatgtgatgccattgctggtgcctcactccatcatcgatgtcatcgttgtcctctgagcacagagcgtcgtcctcctctcggatcttctccactctcccccgacgtcgacggctgcgtcagacccagccttagggcttcccctgcctcattgttcgctgcccgatgcaggaggtgagggtgcacattgggtggtagaagagccaggggccgttcgtctcctccatagccattcggcagcgggacgctcgaggtcctcttcacgtcgtcctggccttggcttgatggtttggcattggtggtgatggcatcaccagctcatgcgcaggaagaaggttgaaggagagagaccccaagctggaggaagaagaaaggcaaaatggtcattttgccctcatatctggtgacgtagcgcctcaccagctcaaaaatggccaatgagaaagaaatcatctctctccaatggtaaaaaaagcaaagttctttggaagagtggcatttgagaacacgccatccgggaaagtggcaaatagtccaaaatcccttggaccgcagcattgctgggccgcgcgcgcttcatgggctatgtgcgtgaataccctagcaagccggcgggggtccgacaaggccttttttttcctttcgatttttcttttctttttttagaactttctttctttatttcagaatatattttcttaaagggctcatatcatgaaaaactaaaccctaatcagataatatttttatcttggatataatttttgtttacccgttccaacgcatgggcattttttctagtctaattttgaatttaattttgttttaattctaaatttaaatctgtcgacgagtgatactcgtagaccggataagtagagtattggggtacattggaacgagggtctatgtagtacgacatcaagcagacaaaagacaaagattatactggttcagggcccttatcaggtaatagccctagtccagtttatatggaattgatgatgatgagaacacattacaaagagagtagtcgaaacagatggtaccgacgagatcgtagtcgagagattcgacgagatctcccactgagttggctccgtgtactccggcttcataaacttcgggaggtgtgttgaagatgagatacgattccctgaacccctcccaggggtcccttttataccgtggatcatcttgccccccaagaaaagcttgaggatatcggacctggtacagtataacagaaactctatcctttccgagtaggattttggaaatcacttgacccgtagagatattttctataatttgaagtagtttccatgtgacatttacaggaacaatccatatacgcgaaggtatacctaatcgatatatctcgtaagtcgtaggacatgaggtatgccttatctgtaaccctaacaaattcaatcccgagttgggctttagaaggactgttttttttcaactttcgttatttctattccaaatttaagttatttataaattgtatttctacttaattttttttctaatttaggaatttattttattgtttattttgaattttaattaaactcgtgttgtgttcgattattatttcaataatattcttttatttcgaattttagtcatttcaaaattgtattcctactcaaactcttttttttttccttttcaaatcccagaaaaaatattttggattttaattaatcacatattatgttcttatatggactcttttttcagtattgcttatttttaattcttaattcagttatttattagattgtattcttacattgactaaattttagttatttaaaaattgtattcctcttaaactctcatttcttttcctaatataagaatttattttattttttattttaaattttaattaaactcgtgttgggttctagattgattgttttttttcactattttctatttcgaattttagttatttcaaaattatattcctactaaaactctcttttttatttttcttttcataattttctaatttttattccgaattttaattaataaagtattaatgcattattataaggactcttattccaatattgcttatgtttaattccgaattttaattattatttttaatactgtattcctacttgaacaaaatcttagtcatttataaattgtattcgtacaaaaactcgcttttttatttttctgatttaggatttttttttattttttattttgaattttagttatttcaaaatttattcctacttgaactttcttctttctttttctaatttcagaattttttctgaaatttaatttatggattcttatatggattcttcttccaatattacttatttttaatttcgaatttcaattgttttttagattgtatttctatttgtactattcttttctttttcatagccaacatgggaatttctagccttcatagctatcgtgttgtctttttttatatatatagatagatagatagatatgggaatttctagaaatctaaaggcagtatggtgtctctttttagctatcattcacagattggtagtatacctggaagggtctggtggcggaccaattgcttcacgtttcttcttacaattgtcactcttcagatggttgtgtaaaactgacgtccctttgtcggaaccgcacttgaccaccgtgtgacagtggatacatctggccttcaccgcctttccgttttccttttccgtgatatcgaagtcctcccaagccttggatcgttttttgccaccactgctactcgctatgccagcgttgcaactcggtctcgctgcttgctctactccatgttcatccgcgcatgaatctgaaccaagattaaaacgtgcaacggaaattggaatcaagtgtactacctcttttcaggttacaagactttctagcattgtccacatctatctattctatctattatattattaaaatagctctaaaagaagacaccacgttcgctgtgggggctagaaatttccacattaatcgaagaaaaagagaaactattttgatcgttagattatagctgtttagatttttcaatggtgcagattaacacatgaaaaatattggagtccaactagaaaacgactacagaaaattgggaccgacctatattctatatagagtgatggcaagttaattaaacctttatgattaggattaggagtcggacatatttgcatggagatcctgtaatcaaatacagagtacaaatctaaccagtgtaggacacgttaactcaaggtagaaataaaaaaaaatcaaataaccaatacagttggaataaaacaatgtaagaatatcattatgcatgagcaaatggaccaggaacgtaacattaggcgtgcaagtaggaatacattttaaaaataactaaaattcggaataaacaataagtaatattgaaagaagattacatataagaatccaatacgatattaattaaaatttagaataaaaataaaataaaacccaaaattagaaaaataaaggacataagagtttaagtaggaatacaaattaaaaataattgaaattcgaaactaaaaataagcaatattaaatgaagagtccatataagaacctaatacaatattaattagaattcagaataaaatataaaataaaaataacataagtttaattaaaatttgaaataaaaatcaaattaaattctgaaaatataaaaataattataggagttcaagtataaatataatttataaataatataatatcggaataaaaaatatgaaattttcaataaacaccatccatctataaaacgcaacaatgacgaataacaataaagagggaagaagcaacaaagtcgtaaaggaattaagtgacagcagttgatgggacatctaaaaactataaacaaaacccaaatagaatcccaatggcgatcaaaaggagggacgacggataggccgttaagtagtacgatcacggtggttggctggatttctagaaagtaaaaaaataaacctcaatgatattaaagagggaagacaacaagggtaaaaacaataaacaaaaccacaaatagaatcccaatgacgggtaacctgttaagcagcacaaacacgatggttagcaggaaagtaaaaaaataaaccataatgagaatcatgttcgaattttaaaatcacaatgacaattaaaagggaagacatcgggcgggccatataggagtataatggctaagctgctgacggtttggtgggacttctacaaagttaaaagtgaacaccgacgatcattatatttgaattttaaaacccaaatgacgataaagagagaaggagacggacgggcataagtggagtagagtggcggcgtttgatgggacttctaaaaattataaaaatgaaagccaatgagttgattaagtctaaaatttataaggttctattttaaagttcaaaggaggacgaatagatgccgtagtagatcgaacaagcaaataaatgggtgaaaaagagcaagaggtagcggcaagtgtgactttaaaaaactataaaattagaaaaatagagatgataaggttagtcttttaaagtcctaatatacaaggaagctatttaacaaattttaagtaaactcatatgtaaataattttgtatggatactatccgcgcaattgcgtaggccaccttgctagttcatatagatggatgttaaagattctaggcatatgggtaatataaaaaattcttataatatgaaacagagaaagtacgtacgacgtcctgcgttacgaagaagggaagaacaatgtattttttatgtacacgctttacctccttggagctgatgctggagcctgtagtattcgagctcgtcgaccgcgtcgtcggcgtcgtacagcacctcccttagacgaccgagtgatcgggccagcggtttgttcgcgatcgccctccccttgacagcaccgaccaccacctccaccctctcgacctcagaccggagcttttcggtgtcatcggcgagcccgacctggctaatccacgcgccaaacttgtcgttgtccaggttctccactatggtatccgccagccatccaatcgaggactccagcaaattaccttctatctcctccatccgcaaatgagaagttattagtaactcttaaccgatggtctatggttataagcaaaatacgcgaatgatatttgggaacgggagcaccggagcagccgagaagagaagaacaaacaacgacaacaaagtacaattacagccggggggactcaccgcagcccgcatataaaagcagtacagaagtcagaactcagaagtccgacatggttttggaccgagtgagagacgatgactttgctctccccatattcaaaaggataaacctcgagcaagcctttcaaaccgcacgcattttagatttcgcgtcgtcagatttgcatatgttatcattacgcatacgactgcagcaatttgactgaggatataaacattgtaatgaatgaacttttagagttgaaataatccctccccgacacggctgactcagaagctctgcagtacgcaaataaaacaatttggagaaccgcacgctgaaagcggaagatggattctaatccctcaggccttgttcggttgctagggattaaatcctaaggggaagcaaaccagggagggattgagtgaatccccccaatttcactcaaaccctgtggggactaaatcccttgtttcttccaatccctctcttagaaactctgtgttcgttttgacagggactatagcagctattggcagggaatataggagcgtattgctagctctctttatgatctggacttgtattactactattagtacatttggttaccactatttacctaaaaccagtagtgctagtaccctgtgacggcagcgtaggagcaagatcaaaagtaccattagtccatttcagagaaaactagaaaacaatatacacgcatgttacaacttcctggatcaagaaagttgatgccaatgtagtgccagccaaaattacaggaaatgcttgtaatattccaattatatgatataataaaaagattgttctgattccatttaactgcttgaaaggttgttaaagatggctgaatgaactgcattcaggcattgttgaagatctgacatgtcacaatgtcaacaattacacctgatcaagaaataagctattttcagttggaggcatagtgttattatccaaaattaatcattcattcgatggttaattagtggccactggtttctttagcacacacatcagtagacactgatactgagcaagttgaatccatctgtggcgacttcgatgattgattagtctaaatgcacaacaaaatccaaacttctcccaacatccctaaaatgacacatcagtaatacccttcattggatagttaattagtctataaatgacaccatcacgaaactgctaccatcaaagaaattctatggaacatccctaccagtcaatttcaaggagtctgcaaggaaaatcagtgagtagacatcagtttacctatcacagaaatagagaagaaaacaaaactactaccatccaattattctttttccttctactagacataacgcaatgaacattataatgcacaaagtttcagaatcaattgtatagtagatgtgaatcttgagttgcctgaattttaagaagatatagaaatcatgtatagtggatagacagatatatttccgagttgagctcgcttccgtgtggaccgtgtaaaaaaatggcataacagtgaacccaaatccatcaccaattcacaatcggctcaaatctgatttgaggagctgggcatagccgcaaccagcagttgggttcttcatacgcaatcgacaagcagcaccatgttcaaggccttgttcttgatggtggatgaggaggagcccttgcagttggagacggagataaaccaagaaacaaggaccaagaaccaaaccctaggtaggataggaagaagagaggagaaggaagagagactcaaaagtgagaaggtggccagcggaggagacggtcgccggaggggagagcgccgcgtcgtcggagcgccgtcgaatcccagtcacgtccgtgtcaaggagcaaccactgtccgagggcgctaagtcagttgcagaagacgctggagatgatgctgattccggaaggagggaagatgaacttgaagcagctgaaggagaagtggtgcgccgtgcaacaaggcccgtcaagataaacctgaagtactatgggcctgactgggccgtgtaattaagtctaattcctgtaatagttcttcgtgcgagaggggaaagaactgagtaggtgaggaagataagagagagagaacacgaggtgaactctgtctttggcgaccatggtggcgtaggcggcggtggctccattcctgtcggaatcggagaaatatctcagtaatagagttgccaattccttcgtgttctaatccgtgcgttcattctggattgcttttcctgtgcaagttcgttaacaattggtatcagagcctctacgctccaagaattccttggcgcggttgtaaaattccagggggaggattggaattgttcttagaacagattccacaataaggcaacttgccttctcttggttaactgagttcgggaaggagcgggggattctagatctagttgggttcgctcacaaattccaggatgtcgcaggagagtaaacttgatgtcttgttgagaactattgaggagaatgagaagaagagaatggaggcggaggcgaggactcgggatgatctcgctgatctgaagaagatggtggagatttgtcttcccaagatggaggagaaggtggaaaaactcagcgagtccgtgcagacactaagccacaaggtggagctgatggaaggtggcgcgatcaaacaagaaaccgctgcagatgcttcagcacaaggaactccatggttgcatggtaagcggaatcctcctcccatctcacctagtccattttctccggattctactgtgcaatcaccaacttcttctagcatcacaccgatctgagtactagtcttcctcctatgacttgccctaagtttgatggtgagaacccacagatgtggaagagcaattgtgagcaatactttgatatctatggtattaatcctatgcattgggtcaaggtggccacactcaatttcagtggtaatgcagcattttggcttcagtcgatccgttctcaaattatgggtattacttggcaaactctgtgtgacttgatctgtgctagattcactagagatatacaggaagcactaattagaaaatggttccatgcgcaacagaacagcacagtcactgaatatgttgaacaatttgacagtatcatgcaccagctaatggcatatgacagtgctctcacccctgtgtattttgttactaagttcattgaagggctcagggatgatgtcaggggtgcagttatgctacagagaccccaggaccttgactcagcttgttcaattgccttgctccaagaagaaatcctggaaagtaataagtctactacacacagaaggtctgataatcacattgcgttcaggccagtaccaaaactcaacaattatgtgccagtgcctccaggacagagatctgtagctgttagtgcacatgatgacaaaaagggagtggaatctgctaagtccagagaggacaaatttgcttctcttaagtcttacagaagggctaagggtctttgttttgtctgtggtgaaagatgggggagagaccataaatgtgctacttctgtccagctccatgttgtccaagaattattggaagcaatgcgctctgagtgtaattctgatgacatcctgacagctaaagaccctattgaatcagtagaggcaattgatggaggattgatggctatatctcagcaagctttgtgggggtacagaatcatccaaatctattagattaaggggatgggttcaaggaacagagattcttatgttgattgactcaggcagtacacactccttcatagatgagagcattggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42060 - DNA, 8026 bp, Oryza sativa
gggcgcgggcgcgccgcctcccgccgctgcgccggcgtggccgccttcgggcgcaccgtgcggctgccgcgtggggcccggctgtcagccgcccgcgtcctcgggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttgatcgtgtagacgctgcagctttggaagatccgctcttcgtggaagttgaagccggcgtttgggaaagcgagcaaggcaagtcacatcatccttgaacatattgaatcccagtttataaaattatgttgatttaaaattattgcattatcgctttatttaaattcccgcgttatcactgttttatttagccatgcctatttacctttgttatgaccttattattattgttattgttattattaccttgttcaccctagaataaacaaaaccccaactagtggaccctctactcatggtacccctagtataattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgtccaagccgagcaatgtacccaagttagtgttttaattcttaaaatctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgcatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaatagattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagcctttgcagtattttcgaaataaaaatcctctgttatttgtgaaaaccctctagtctttctctgtcttgctgcttcatttatcgccaaaatctgatttttttttaaatgttgcttttctttttgtttttgtttgtagatggccggtagcgtcacccgtcgtggtttggacatgactggtttcgtcttggagctgcggggcatgtgcgttgtcctggggtatccacatggagtggactaccagggcaggccgcttccggagcaggagggtgacgaagcagagccccacgctgcttgggaggtcactgcagtgatcctcgccggctctcccgagcggacttcgctggcagtcaccgcgggtggagattctttccccgccgcttgctagagcgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctagcgcgcatggtggaggcgtacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacctgcttcgtcgagacccctcgtgccgagtccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgccagctctctctatttgctggttctgtgtggggttttcagatggtgacgaccaggagaagtgctaataccggtgatggcaaccaacctgaaggcagcaaccatcaccaccagggcagcccacctccacctcctcctccgcctccaccaccaccaccagacaccaacgccattctcacccaaatcctcgcccagcaggccaacatgatgactgctttcctccaccacctccaaaattcgccacaacataatactccaccaccacccccacaacactctaaactcgccgagttcctacgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcaacctattacttgggcccgtttcaccgccgctttccggagaacccatgtgcccgccggagtcgtggcccttaagaaaagggaattccgagagttaaagcaaggcaaccgctccgtgatggagtatttgcatgagttcaacaacctggcccgttatgccccggaggatgtgcgggaagatgaggagaagcaagagaagttcttggcaggaatggaccctgagctgtccgtccgtctagtctccggggactatccggatttccaacgtctggtggacaaaagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcatggtgcgcgtcccacagccgcagcagtagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataagtgcccaaagccgaggcgtcagcaaggccaagcgcctccccgctccaacaacggtggtaaggatgtcattcggggtcgtgtgaaccatgtgacggccgaggacgtgctgacaactccagacgtcatcattggtatgttcctcattcattccatccctgctaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtggtggattgtgcgagacgcactgtcactctgtaccgagagccggaacaaccggttgttttctttgcacccccaacctctgtcagtagttcagaactccatcagataggactgtcagaaatccccatcgtcagagagttcggagacgtgtttccggaagaactacccggtatgccgcccaagcgagagattgagttccggatagatcttgctccaggaaccactcctctgtacaagcgaccctaccgtatggcagcaaatgaattggccgaagtcaagaaatagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaagaacaagtaccctcttccccggatcgatgatctgttcgatcagcttaaaggtgccactgtattctccaagattgatcttcgttccggatatcaccagttgcgcattagggaagaagatattccgaagaccgcattcaccacgcgatacggactgtatgaattcacggtgatgtcattcggtttaaccaatgcacctgcctttttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgttaccgattggaagcaacccaagagagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaaaagctggtttcctcgctagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccccacccatgatttggagttagctgcggtggttcatgctctaaaaatctggcggcactatctcattgggaatcgctgtgaaatatataccgatcataagagtttgaaatacatcttcactcagtcggacctgaatcttcggcaaaggagatggttagaactcatcaaggattatgatgtgggaatttactatcatcctggtaaggccaacgtggttgccgacgctctaagtcgaaaaagccattgcaacactcttaatgtccgtggcattccactcgaacttagtcaacagatggaagccctgaacctaagcatagttggtcgcggattcttggctgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttaatccatccaccctggcagtacgaagatgtacttagacttgaaggagaaatactggtgggttagtatgaagcgggaaattgcagagttcgtggccctttgtgatgtgtgccagcgtgtcaagtcagagcaccaacgaccggccggactcctccaatctctccaagtacctgaatggaaatgggatgaaattgggatggatttcatcaccggacttccaaagacccaaggtggatatgattccatatgggtagtggtggatcgattaaccaaggtagctcgatttattcctatgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagacagatgggtagaccgagcatctaaatcagatcctagaagatatgcttcgcgcatgtgtcctggatttcgggaagacctgggataagagtctcccctatgccgagttctcctacaataacagataccaagctagcatacaaatggcaccctatgaagcgttgtatggacgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtataccttcgggtcacgccattgcggggtgtacacaggtttcggacaaaagggaagctcgcacctcggtatgtgggtccttttcgtatcgttgcccgacgcggagaagtcgcttaccagttggagctgcccgcctccttgggcaacgtgcatgatgtgttccatgtgtcgcaactcaagaaatgccttcgagtgccatccgagcaggccgacttagagcaaattgaagttcgcgaagacttgacctacgtggagaggccagtgaaaatcctggacaccatggagggcaggaccaggaaccgggtaatccgtttttgcaaggtccagtggagcaaccacgccgaagaggaagctacctgggagcgtgaagacgagctgaaggcagcccatcctgatctcttcgccagttcttccgaatctcggggtcgagattccgtttaaggggggtaggtttgtcgcgtccaaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttca

SEQ ID NO: 42061 - DNA, 1349 bp, Oryza sativa
ttccccctcgtccggcagctccctccccctcccaatcctatataaaccttccccgtgcctcccttcaccgtttccgccactcgccgccctctctccccgtcggaatcgagctcgcgccgtcgctctctctctccgccgtcaccgccgagctccggtccgccgccgtcgtcgccccggaccacctcccgcctcggcgtcgccaccttcggcttcaccgcatccccggcgacctcgtccactcctccgttttgctcgccgaccgccggagcaccgtcgaccccgtccacccgagccgcgccgccgccttcctccgctccggtcgccgtttccgtcgtcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgtcctcgggtgcggctgacgcgtgggacccacggcgccggccggtgtaagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcacaaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccatttcttttccgttggtcgtgtagacgctgcagcttcggaagatccgctcttcgtggaggttgaagccggcgtttgggaaagcgagcaaggcaagtcacatcattaaaagcctaaaatgcgtaaataaattttagtggaattttcagagcacaaataataattaagaagaaataaacaaagttaaaaaggttttataaaaagaaaaaacctaaaaagtctttttccccctcctccccctcttgggccggctcggcccatctctctccctctctctcctctcccccgcggcccattcggcctcctccccgcgcgcgtgccgctgacgggcgggcccgcccgccacccccacccggcatccccttcctcccgccgctcccgccgcctcgcccgtgccctagcgccgccgccgccacgaatcccaccgcctcccgccgtccacgcgcgcaataaagcgggggggggg

SEQ ID NO: 42062 - DNA, 830 bp, Oryza sativa
taccctgagtccctgaacatctgaaggtgcaaagatacacactagaggttgagatcttaaatccacatattctcaagtttggagagcacaaaccaatgattcattcacattcggtattatttaagcgaacataaaaaggcaattcaaggtgaacacttcagaaaggtattatctatgagctggcattatctgcatttagctggtagctcttagaacaagtaaacatagtattgataatgcattgtccagtacctccagtgcatgtgctagcttacacactgtgggctctaccctgtcagcaatcacatgatagaagggctttccgttgtgggaaatcacctggtcttaaaataccattcagtgctagctatcaacatcagtccattactcaaacataagacgacaaccttaagatacactgaaagatcacatttttcccccattaattaacactgtgcctgcctattgtcgcgcaaagtcttataacactttgagcaagcacacaaatcaacaaactagattagtggatgatgtggagtgtacctattgaagacagcagccagcaactcaaaattcgcaggcgcctcagcaaacgccttgagctccgctgcccgcattgcggaaggcagcttgacagcaggagcgcgggacatggcgtcccggagcagaacgctgaaggcgccgccggaagcggagatggccctgcacccgcggttgacgctggcgacgaggcatccctcggtggtagccatggggacatggtactcgcggccgtccaggagcagcgggccggcgacccccacggggagctgcacgtacccgacgggcat

SEQ ID NO: 42063 - DNA, 7303 bp, Oryza sativa
  unsure (1)..(7303): unsure at all n locations
nnnnnnnnnnnnnnnnnnnnnnnnnnnnnnnnnnnnnnnnnnnnnnnnnnnnnnnnnnnnnnnnnnnctcgggttcttggtctctacccgaggcatcgaggccaaccccgagaagatacgagctatagagcggatgcgcccccccagcaagcttagggatgtgcagtgcgtcaccggctgcatggccgccctaagtcggttaatatcgaggctgggagagaaggcgctacccctatttaagcttctcaaacgctccaggccgtttacctggacagaggaggctgagcgggccttcactcagttgaaagcgtacctcagttctcccccagtcctagtcgccccggagccagatgagccgttgctactctacctggcggcaaccccgcaggtggtcagcgcggcgttggtcgtggagcgcgacgaggacaaccctcgccccgcacatcccagtcctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctctgaccccgaggttgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattacttccaggcgcatcgggtcacagtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggacttcttgcgggactcagagtggcagctggactggggatccgccgcctcctggtgttaggcgactcctcaacatcctcaagaagcacggcgactcgtggatcgaggagctgccagcggtgctctgggcgaaccgaaccatgccaagccgagcaaccggggaaacgcctttcttcctcatctacggcgcggaggcggtcctcccatctgagctcaccctgaggtcccctcgggtcaccatgtattgcgaggctgatcaagatcagcttcgccgagacaacctcgactatttagaagaacgaaggcggcgcgcggccctccgagccgcgcgctaccagcagagcctgcggcgctaccatcagcgccacgtccgggcccgatcactctgcgtcgacgacctcgtcctaccccgcgtccaaacgcgtgctggactgagcaagctctcaccaatgtgggagggtccgtatcgagtgatcggcgtcccccgggcgggctccgttcggctggccacgggcgacggcacagagctgcctaacccgtggaacatcgaacaccttcgtcgcttctacccctagtgggggtcgggcgtcatgtctcgggctcgggccaaccccgcaccccccctgggcgtgcaggattggccgggggctaccacatgcatatacttaccttttttctcttccgaatttcaataaaagcattttcgacttcttgaggactgtgtctgtgccatcgtttccttttgaagaatcttggcttgaattagcacgctcgtgctcgaccctgccctcggcggcccgggccggctaaaatcgccaaacggggcccagaaccgagccgtgccccggggcgtggtgacctccgggggggaatcggcaaaggcccacaatcgggtcatccataaccctcggtcaccgcgctcccggcctggccagtctcgacacgaggatctccccaggcactggctccgacccgcgccgtttgaggctgggacctgggcacgagcccttgttcaagccaagacaaagaaggaccgcggcaagaaccatcctcgtctcatacacacaacaaacagaactgacgtggaaatttcctctttacttgattacagattaaatcagtctatacaagaagggggcccgaaagcctcggaagaagaagcaaaagttattaagattggcgggggcctgggggctcactccgacgcgcccgggacgtcggcctcgtcgtcgctgtcgtccgcaccgtcgtcaccgccctcctcgtcggagtcgagcgcgaacgcgagccgaggggccgtaccctcgaagctgtggacgatatggtcggtggcgtcccggaccttcgcgcgcgcgccgtcctcggttcctggagggaactcttccagcgctgcccacggggaaaagtcagggtccctggcctggtggcttgccagtacgagctccaccgccccccgggcgaggtccctcgaggatgacatgatcgtctcctcgagctccttggggagccgctcgagggccccggtcatctctgagaggcgctgggcgaggcccccctggttggcggcgtacttcgcgtgccgcccgccccagaggcccgcctgccgcccggcgcggtctagacgggagacggcgtcccgaagcatgccgggccctacttcgctcgccaaacggagggcctcgacctccccggcggacgagtccagcgcgccctgcagctcggcgatggtgtgttcggcggctgcgaggcgggcggctaggtcgccgtggcccgcggccgccccgccgctgtgcgctctcacgtccagctccttcgcccgcgcctcgagctcagcggcccgctgatccagtgctgccctctcggcgcggacgccttccagattgcgacgcgcctgctcctcccgcactgcctcgcggaggaacaggctgtccgccagccgctgcgccacggcctcggcctcctcgagagctcgcccccactcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccacccgccgttcccgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccagctccctacgacgggcctcgagctgtgaggtgtgccggcggtgcgccttgcggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcgaccaaggcctgcaggaagggctccgcactcagtggggcagcggaagacagaggggagaatcgcctcggtgtgggcgccgcgcggctcggcccgccgatcgacgtgccggactcgggggcgccccccgaagctggctcgtcccaagcgtcgcccgaggggtcaggcctgagcggcgcgcccacggcttcgtcgtgggtggcctcggaagtcgtcgtcgcctcgggtggagtcgggtcaggggtttggcaggccgcctggcgtgcgcgcgccgcctctgcctcccggacggactccccggcccggcggagtctggcctcctcccgagcggcctactcagcctggcgaacccggacggcctcctgggcagcctcctcggcttcccggaagcggtccacggcttctcgccggtcagcttcccgcctccggacctccgcggtcgccgtctcctcggcctcagaccggccggacttggaatggcggggggggggggggggcgacgggatctcgctgaggcagaagaaaaaccagaagacaaaaagaaacgggtgagtgaaaactcgccttgggagatgggaggatgaatacggccgcggtgggcatggggacgaacctgcggggaggtcggctaaatgaccacctcgggggcgagatgaggttcccccggcatggcacgatcccccccatcttgcggagccgtttcttctttcgctccccctcgggctgcggcgtcggcgcggcaccctccgagcgcctgctgctggcacgcaccgccccgcccccttggggaggagatgggggaggggtaccctcctgcttcctcttcccccgggcgtcggcagggtggctgccccccgggcccccgtcgcggggcccagaagcacgaccccctcccggggtagattgttcccccctgcggctcccacctgcgccatcgtggcctcggggggcccgctcccccgacgccccgacctcctgcatgatggtcaggatgttggcgcgctctggatcgcagcagagggggaggaccccttgggggatgagggatgcctccacggagctgagattcagcacccgttggaccaccatcctgaaatcctcagggtcccagtcccatttgcgcccctggtgggtcctcatgatgtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccggaggctggttcggaagtcggaggcgcgcttcgtcggcgaggggggtgtagaaccaatcgctcttccaatcgtcccactttttgcgaaggacgcagggaatgtagcggttcagcacctgcccccgcggctggaagtagcagccaccgactaccgtcggcggcgacaccggctgtacggtgaagaaccaccggaacagccggagagatgggcgcaccccgacaaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccgggcgtccctcgcccagcgtgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgcaggaaacggagagtcagagcacaagtggcaaaggcaaggggaagagtggtgagaggaaggaaacaaatcccttccttggcgtctttgtacccttgccaacgctatgcccggctcctggcttcccgcgcccactacctcgccccctcgtttctcgcgcccacgcctccactaaccccacttgcccgtttgcggcgcacgcggcagatgtgcggccgtggcgtttgagatggggcagatcgtgcgcgcattaactgcgctcgccaaccgcgaaaaacgccatcatcgtgtccccaggcgaaacaaaccggctcgtcccgattcgcgcgctgctcgagtaatgtagcggtcttgaagaggccgctcattattgtcgatcggtttttcccttgccgatgcgcgcgatttgcgaccgttgggtttccgcccgcctgtggggaccggccccacctgtcaccgggcctaaggagtggcatcacgcccgagcgcctccctcgaggggggcggtcgccctggcgtaacgccgggggctactgtcggtgacatggggccgggggtatcgtgactagaggcttgggtagccgcggtcacccacgtggcctgaccccctcggggggggggtcgggcccgacggtgacgtggccacccctccctctgtctccccgaggggtcgggccgctcccgtttcggccccgagggctggggtgccccgaccccctgtggttttggcgccacgtgtgtgggttaggcgagcacaccgggctcacctaaccgcatttatagcaggttggacgagtgcgccacgccgcatttaatgcggcgcagcgcacgcttatccggtccgtgaccagtcgcggtgtgtgaccggtcacagaccggtcagatcgcgggttaggtggcaacaggcagcctgtcacacgcctcgccccgtcccgtcggaatgatgagagcttcgtggctctcgtccctagccggagccggcgtgctaactcctggagttggtatgtcagtcccggtcagatccattcctggcttcagcgcaagtatggcaaggaagtcgctggccattaaataaaggttgaaatgggcgtccaccgaaaaaggggcgagcagagcaggagacgtgcgctctgcttgtcagaggtcacttccggctgtagactagccctcattgtaaaagcatgtttcctttcttaggtggcgagaggcccttgtggtgacccctgaccagagaaaaaggaggcccaggcctagaaagaaaggagagagaaaaaaaagaggagaagagagggggcgaacggggctagagcctgaactctctctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcacatgcacacaagtatttataaccca

SEQ ID NO: 42064 - DNA, 8742 bp, Oryza sativa
gactttttaatcaacgtttgacaacttgtcttattcaaaatttttatgcaaatataaaaatacttatgtcatgcttaaagaacatttgatgataaatcaaatcacaataaaataaattataattacataaaatttttaaataagacgaaatgtcaaacgtttgtcaaaaaggtcaacggcgtcatacattaaaatacggaggaagacaagcttggtaataatttgaagtactgaactaattagcagtccagttatcttggtgtatgttcttgcgtgccttgttgattatgagaaggaaaatattgagacaatgtgttgtttcttttcctttggcgttgaaacatgtcgtctcggtgtactgttgattatgagaatgaaaatattgagacaacgttgtttgctctagataaacttaattgtctgttcatgttttaacgagctcagacgaatcgagctggagcctcgcagaggttgagcctgtgttaagctcgaaggtcagccttggctcgtgcgagctcggcttgttatagcagccggacccggttggtaaatgcatgggcatccggccgttgatctttttgaaagtgtttttgacccattctaccatttgaagctccatggcaagtatggtcaagctgagctgctaggcagatgtacaaaagcgtttttgactcatttctgttttaggcaatgattccattacgtctctcgctgcaacaagccagatgatgggccagtcgctcatttgggccggatgaaatgcatgtgacccgctagcagctaggcggaggcagtcactcattcgggaaggtagtagtagcgttgcttgtaagccatggaccatggtcacagcctcaggatgacaatgcatgtgaatatgtgatgtaaccgctagcagccttttccccgagacaatgccggaccgcggaccgcggaccgccgcacccctcaatcgacgcacttttgatgaggaatgcatgtgatggtagccatccatttttcctatggagggttcagatttgaagctgcattctcactcacccgataggcacagacatttgtgttcgtgcatagccgagttcttagcgggcatttgtagggaaaaaagaaaatctcaatttggtttcttttgaatggccaggtcactttgagattcctttatgctaaagcacctccgctttatccatcttccccctcttctctacgagccattgccgatatcgtacttcttggtgagccattctcctgctcttctgctcccgttttggccgaaactttttggcaacattgctcagactcacttcttttcttggggtttagtgtctgcttctttctctctcaggtagtagcgaagaagaataagaccctgtttagatgggattaaaaatatttttaagtctctatcacatcgaatgtttggacactaattataaatattacgtaggttattaataaaaacccattcataatcttggactaattcgtgagacgaatctattgagcctaattaatccatgattagcctatgtgatgctacatattaataaaactcatctataatcttggactaattcatgagacgaatccattgaacctaattaatccatgattagcctatgtgatgctacagtaaatattctctaattatggattaattaggcttaaaaaatttatctcgcgaattagctttcatttatgtaattagttttgtaagtagtctatatttaatactctaaattagtgtctaaatacagagactaaaattaagtctctggatccaaacaccacctaagtcattccttacgaagaagtgcttttcatagctctgaagatctgaataattttagcactgaaactttgtattagtttcaacaatgtgcagaaggaacatgacagtttgttaaacaaaagtacgaatttcaaaagtaaaaccccatactccagcaaaacagaagagaaatggaagccccaatctttttttttatatcgaagtagtagtaacaagttagcaacagatcaaataaaagtactgttagattgcgcaaatattacacagagaagagtttgtgaagtgcaactcaccagcaatattcaatagctctcagcatattgcacattaaggccttgtttatatcttaccctaaaattttacaccatattacattgaaagtttaaacacccacctcataaaactattaaatataggctaaaaaacaattaattgtacagattgcggctactttgcgagacgaatcttttaaacataattgctccatgatttgacaatgtggtgctactaataacatgtgctaatgcaagattaattaggcttaataaattcgtctcgcggtttactgacggatactgtaattagttttgttattagtgccggaacaccctttacgacatcatatataatacccgatgtgatatgccaaaactttaccccctagatttaaacactccctactgaaaacaacgtgtaacgcgctatggtgtgagaattctatttacaaattttgcatcacaaacgaatgaccaaacaaattctaggcctcacgaattcacgatcgaaacagccaatgaagcactgaaaaactacatatttcagatccaatagcaatttggaccatcaaatgacgtttctgatttgggggtttgttttgcagatttttcagaatttggagctgctgacgaacttggaggtggactagaaggacaagatcaaggagaaaccggagaagatcaaactcaagcagctgccttaccttgtctgcatcattgtcgaggcttgtgcttgcatcactttgcattaacgatgaaatttcatgttgaattagagggtaggtctaatcggcgatcgatcgcgattcggtcgccatgcacgaccacgtttccatgcagagcaaccgctttagccgatagcaatcatttcccattccgtatctctccaccgagccttgagtggttcatcctaatagtgtgatggtccagcccaaaaaatttatacatacactttatatgcaaaataattaatatataaaacttcatgtatagacatattatatgtgtacaaattttgtaagtacatgcgtacaaactttttatgtacaaattttgcacatataaatttgaaacaaattcaacggtgtgttaaattagtctcgagaaaaatatatatatagaattttattacatcagaaaaaactatacatagcaattttgtacgtatatattttacatatatgtgcatttaaactttgcacgtgtaaagtttatatctataaactttgtatatgtaaatttaaaacaaattttaaagtgatatatgtgggtttgaggcccatgtgcatgctggcagcccactctaaagaaaaagcccagctaaaaacaaggcccacacatcagtccagaaaggattaagtctattttgccttcctcatttcttgctcctgttaaaatcatattcctcaattgtacaaccagcgagtaatgtgactatgaaccgcgccaccgcaaggtctggcacctggaacgatggtgtatattgcatccaatcccataaaaaaacaacttatggggaagtgggacagagagtattttcgtagatctttcaaaaacacgtgtataaataaaaaagtttaaaaataatgtaacttttaaatttttattcgataagcaaccgcataagcaaaccgatgggggtgttatataatccaaacggaggatgtattaaatacatgttaacagaatgaaaaactaaacctgttttttttactagacttcccactaaaacacgtttcacaagaacagacaacactaagcgagtagggcacagggcaacgcaagcatcaaaaaataaacagttctgcgggtcaggcataaagaaaccaatagagtatccggaatctgaaatctgaggaagcataaagaaaccaatagggtatccggaatctgtaatctgaggaagcatatcaccacacagctgctacaatttgaaagcttgagaggttttaacagccctggattgcccctagaaaggaatcacaattttgtggcagccacctacaatccacaagctggcctccaaaagattttccatcagccaaatgaaaacgggtgaagaagcatcattgaggcatgacgagtcatagagcatgcgaatatccacgcacaaactgcaagtatataattaacaaaaaaaaactaaattgatgaaaacgaacaaaaagatcagaacaagatgtcctgacatattgtgatgcactagaaacttacgtaaccactgtctatctgttagcttgcgccttcatcttttatgtgcattgctaagggcttttctcttttttcgaagctctgatagactgacgctatcaacgtgtggttttactcttttttgaagctccggcactagtatcaactggtggcttccttttctctaataaaacattcttttggtccataaaaggctgcaaaatgtccttgattgcctacacaaaaaccaagagattgtaaataagagaaatttgtgatgttattgattgcaaaagatttcaaaatactgcaccttgctttttatctgtgtttgaatcttctgaacatgttgtataatagattgcaccttataggcccggacagcacctctattgtcgaagcagatcccaaccaaaagaccatcaacagtaaagacaggggacccaaatgaggcacaaggaagtagcacaatcatgagtaaaatccgcctttcttacaaacctaattaaacatttcataagagcctataaatataatttaatcatttaataggactaattaagcatttcataagaaccaacaaatctaatataatcatttaatactccctccgtttcacaatgtaagtcattctagcatttcccacattcatattgatgttaatgaaacagaggaagtaagacagatgaaattagataaaaataaggattttagctcaccggaccgatccaggagataaaaggtacttttggattctgatatcccaaggtgtaaacatcctcattaatcaacggtccagattcacagattttcacagcagctaatggattagtgcattttggtttgcttagcatgaaagagacaactatcagcaattgatacatcggtaaagttaatcgccacactctccatgttcaagccaggaaaaacagcagcatagagcccttcagaaccataacaaaatgtccccttgtctgttatgacgtagcatgatagcttcttcttcgcaataactattcctggagcaaataaagtcggttttcctgcactcatagctattatcctaacgaaacacatttgaaccttggcttggagattatcaaaagtatcctggtaatgaaacatcatattaaaaaaaagccattaggatcatttgatatctacctcctataaagaaacaagcatacaaccatatacaagaatttgaaaacttgagatcatgtacaatgggaggtatataaagaacttgaggttatgtgaatgattggtgcttataaatatggtgcctaaaagaaggatgtgtccatatcatcgagaactcatatataatttatattgtctactgcaaaattcttttctcaagtgtagattattatttttttgataagggcatgcccatttctattgaagtacagaaaacatggtaggaagaagggagaagtttaggagacaagacattacaaaagtcaatactcctacggtaagtagtttccacacacacacacacacacacagagccagcggaccagatccttccctcgacacactagaactactagaacagcagtactgagccttcactaactggagcgtagcctagggactgcatctacaggattgcagcatcgtgcagactcctacttgatacaaaagcaaagagaacccagccatactaacaatatagccatattaacaatactacaagtaaacaggacacgatcaatcactactggtaccacaagtgctcagacaactaccttttcctattattttatacataaacaactgccaagcatcacacacaaaaaatatgaacaacacaaatctgattctatttactatataagcactccatgtaagcacttgcgcaattaagcatttataacaacagaaccaagaaaccaccacgggctgctgcaggcaggggttcagccaacttatttcgagaaaccaaagagagagcaagttcagtacaacattagttttgcctagtgccttagaccatgcaaaacatcaattaatcgtaatgtatagaaaaagtgagtgaccgattcaagcacatacgaacagaaaagaaaaaagaaaagaggaggggaaaaaagcaagctcaccttaggcagcattttgcaaatgggggaaacaatacccaagtaaagggtgaatcggtgtagcaggtagccaggccaccgggtggaggtgcctaggaagagagatcgtcgcagtagcttatgaagtagtggcgtaacaagaaattttcgtccggtggtcctgcttcacaagttcacatcacataccaaaattttgtatcaccgcaaatcccatgagtacaaattcaggtaaaaggcgaacaaatataccaataatatcttataacatcagtaatcaactaatttaactagcaagttcaaaatgtgcacatattacaatacagatagttcaaaatgtgtactccccactcctcttcatgtctttaccaatcctacaaactaaaataagtccgcggcacatcacaaatttagcaatggcaaatgcttccttgatcaaacacagtgagaataatgaagatatgagctagaggtataacctgtaggagcaggagacggcagccgggagccgcggcgcggagggtagagaagccgcgaacggcggtcgacagcgacgggcaggggatgagggtcaggcgacagtgcgagagggagccagtcagacggggttcccgagctcccggagctggcgaccggtggcggtgcggcagatggacgccttcgctcggcggtggtctgtggctgtgccgatgcggcgccgcggcggggaccggtggtgtgcgcccccgtcctccggcctacgcggctcgggacaagcggacggcggcggcggcaccgagacccagtgctcagtggcgacgaggagaggcagagagaggctgcgaggagaggcgaggcaacggcggcggcgcggtcacgcgcgtgcgagggagcagcgcagcgccgccgcgaagcgcattgccttaccgagacctaagcgcagcgcccgcttctccttctgcttattgggcctgagtagctgggccaaaatcggggctagtcccgaaccaaccgggagcgtttgccatttggaaaaagtatatataagatccctcatcttgtcaccgaattacaacatcgtccctcaactgaaaaaccagatatatatgatccctcaacttacaaaaccggatcaccctgagtcataacttacaaaaacagattactctgggtcattaggtggttgacaccagttttgtcctacgtggctgccggtgggtgaactcctcaagcgggggagtgaggccccctttgttaattcgggcggggggtagcgggtgagaattgagggtttggatggatgtgtgctgtagagggggtcggggcccctcaagagcaatgagataaaaggagtttatacaagttcgggccaatgagaagcgtaacactctactcctgtgtatgatgatttttttgagctttgaaagtctctgaatctcggatgtacaaactagagttggtatgcaaaagctaatcttttgatccccccaccaaggacatgggcctccttttatagcctaaggaggcaccacaggagtttaccggattacttaggggagaaggcgaaaaggaatttatcggaggatgaactcctcgagcgggggaccgtgaggctcctcctttgttagttcggcctagggcagtggatgaaaattgaggagctggaagtatttgaagaaatgagggggtcgggccctcgagaggggtgagacaaaagagatttagataggttcgggccgctaaggagcataataccctactcatgtgtatgataatttttctaagattacaaagtctctgaatctctagcgaggaagctaagactcagcttcccttcagaatttttaggtttcaaccacctccttcgtaggcctggacctccttttgtaccttaaggggttaccacatatgccataagagctacctagagaggagggaaaatgttctctacattaaatgcatgtcttgtgccttagctcggaagccatatgcacattgccttggtggtgagcccattagaacaggccacctgacacggggggtgccctcgtcatctcccatttaagggatggagacttctgggctcctgttacaccgggaaacgggatcctttctttgaccagagcgggcggaccgactccagctggaatgagaggctgaaagcctctcgtcattatgatgagacggggcacttcaaggctgtaggctgcttgacagacggacagtgcgcaggtgcactacccctagtcccatcggttattcgatcggtcacggaccggtcagacgcgctgcatgccgccataaatgcgggtaggtgggctcttgggggcggccacctaacgcatcgcacgtggcgacccgcggagggggtcgaggaagcccgacccccggtcgcggagggggg

SEQ ID NO: 42065 - DNA, 18695 bp, Oryza sativa
gcccccctaccccgggcccgaccccgctcgggagagggccacgtgggcactaggggcagcctccttcctctagttttgataccctcgggcaaggaggggcagctgtcactccaccccgggcccgaccctcctcgggaagtgctacgtgggtttaggggcggcctcctccctccaaacatgatacccccgggcctatatcatcgacataattgattatgctaaagagcacgttttattctattgacatgacgaccacatcctcgaccgccacaacatgggcccatcaaatcgagccgctagacacgagggagcattgtgtcattcgccaattaatggatgaagactcttaattgggctcctgtttacaccgggaaacaggaggtcggctttagaccagagcagatgaaccagctctgggcggatctaggggctagaaaaaaaaaccccaccatcacgatgtgatgaggcggggtaacttgccgccgcctgtcacctgttcattgactgggcggggcaaaccgtctgccgcatgtcactttgtcagtggctaggcatggcaagccacacgcacatcggctgccatatggggcccaccacatcaggccggctgacatgggggacgcctgcgtcattcatcatttaatggatggggacttagagtgcaggcttgcaccgggaatacaaactcgggcctggccacaccggatgggatgagtggctaagagcccctcatcattacgatggaacggggcataacccgctgcacgccgcctgacatgcggtcagggcatgagcgctctgcagtcgtcccatccatcattcggccggtcatggaccggtcactgaccagtcacaggccggtctggcgctcggcacggcgtggaacgcccgctgcaactgccttaaatgcggttaggtggacgctgtgaggcacccacctaaccatatacacgtggcggctcgacccctcgggcttggaggggatggccgccgcccatccttgggcccgaccccctgggaggagtgccacgtggacactgggggcagcctcttccctccaatctttgtacaccctggcccatatcaccgatagtggtggccatacctgggtgaccatgtcatcaccctctccctctctctcccctcttctctcctttcctcctcctccttcccctctctctctctctctctctctttctcttctaccctcgtctaggtgggccggccagccagcgggttcgaaggaggccggctgaaagggtcaattaggcctagaggggggtgaataggctaatttaaaactttatgcggaagctaaaactgaaataaggtcggaaagtctgatccacagtcagactatccaaaaatatcagatagtctgatgttggatcagactgtctgatccaccaatgaagcacaacaagtagatctatcacacagacaagagtaaagcacaaacagcaactagatctatagtggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaagcactcctccttccactaaggggtatctctttccttgcggaggcgagatccggccttcacaaacttctcccggccaaccacacatagatcggtggctcgggagtgacacctagccgtctaggagtcctcaacctccaagagtaacaaacaccacacaactcttggtcaaaccctagtgctcaatatcgagtgaaacacacactaggccctcaaacaccaaatccacaaccaccaagatccaccacacaaagaacaaggagggatttgagagagggagaaagagctcaaagatccaaagcaccttagcaccaagttcaacccaaagtgaatgagaatgaaatgagttgggaaaccctagaaaagggttaggtggggggtatttatagacccccccccccaaaaaaaatgtggtcgttggagaggaatctttcagcccacgtcggatagtccgatacaagatcggatagtccgatattttaaacctccaaggcaacgagaaacagagaacgaagttccatgaaatttcggactttccgagacatcagactaactgatgttaaatcggagtatctgatattttagaagcaaaaacttcgtcctcaaacagagactcaagttctatgaaatttcggagtctctgtatcatcagactatctgatccgacatcggatactccgatacttagaaaaactcactcgataggattttttcaaatcaagacagagagtgaagttctgtgaaaaatcggatagtctgatttcaaatcggatagtctgatgttgatcaagtaaaactacaataactttttactccgaactccgatttcgaagatcttggactctatgaaaagctagtttcgtgggtcaaacccaacataaaacatggtccaaaaccttcaagagatgttgaaaaacttgcaaagaaacccggtgtaagtgttgtgacaagtgaaacaactcgggattgaaatttttacttaggtttttcaactcacacaaagatgaagcattttgagcactagtattctaccaataatatgcatgtggtatcgctcttaatagtacgacattcctacgacacaatgtaaggtaaaagatacaatataccatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaggggcctagatgcactttcaccggcaacgggtgatgcggtgggcggccttgttggtgcagtctaggagttgatgaccacacgtgccacctcctccgcctccacctccacagtgcacacctcccacaccatccttctcgccaggaatccccttgctgccgcccacctcctcgacgacgcccaccaccaatcctcacgccctcgtcgtcgccaccggctcgagacctacgacatcgtcgtcgaggccacgcgccgcctacaaccgtgtcatgttccagctccgctgatccaaggccatcctcaacttccccaacgaggtcacagccgactcaaattcctacatgaaattttctttgaatgcttgtctataacttttctaactttgtactagtgaaattcatttgtttataaccctcagtagctattaaaaaactaaacaattagctatctcaaacggagcctcaatattcaaatataaggaatattaggttctaccaatatctgttctgaacatactaacatatacttcctccgttccacaatataagatattttggcatcttcatacctcgtctaaattcaccaacatctatataaattaggacgcgtatatgaaatacatatatggatccatgcatctatttaaaacccaaaacgtcttatagtgtgaaataaaagatatcatataaattcaccaacattcatatgaatttggacatgtatataaagacacatacatggatacatgcataactatttaaaactcaaaacgtcttatggtgtgaaatagaggaagtataaatttaaaatataggtgtatatatttggcatatcctttttatttgtgctataatatattattagtctgtttgttaaaactctaattcctaaatttaacttcacttgctttagagtggagttgtgaagcggctcgaaccccactcagtttacctctctagtccattttatgatagctcttcagtatgttccgctccctttttaggtgaagctatagttctgccaacaagctctctatctagtactactggttctattatagttattggttaagtactctctccgtcctagaaaaaataaatctaggattggatgtgacacatcctaatacaacgaatctaaacagatatatgttcagattcatagtagtaggatgtgtcatatctaatactagatcggttttttcttggacggagggagtaatgccttccatgtgcatcctagccattcagttctctaggcaaataattagccctccgaaatcttgctatttagaagtatttaataaagtctatgtacagaactacttgttgaacccctgggctaattcgcaagacgaatctaaagaggtatattaattcataattagcggatgattactgtagtatcactgtagtaaatcatggattaattaggcttattagattcgtctcctaaattagcttacgggttatggaatgggttttgttagttatctacgtttaatacttctaaatagtaagattctggagggctaataattagccctccggatccaaagaggccctagttgattatgctcccttcaagagccagaccctcgctttcccctatagatggccatgaggcccgctcggcacggcccggcctaggcacgactaggcacggcccaccagccatcgggccggcacggcccgatcggccgcacctccggcctaggcacaacccaccagtagtcgggccgtgccgtgccagcccgaaggcacgggtggcccatcgtgcctttttttaaataagtctattctccctccctcctctttgggctgtgacatactccctccctcctctttgggctgacatatatatagctaaaataagtctattttatgtccctattctttggaccgtggcatataatatgtctatttttactccctttcattgtgtgttgggcctggctaccggcccaacgtgccggaggaggggcccaggcacggcccggcggtcgggccggaccggcacgggccctaccccgtcgggccgtgccgtgcttaggccaggccaaaatgtcgtgtcgtgggccggaccgtcgagcctcggaccttttcgccatctatactttccgctttcaagctacagctctatcgtcgcttgttcggccccttttcctcctttcctccgatgattcgtcgtcggcggagagagggagaggggtccggtccttccccctagtattaggttagtttagtcgggtttttcctgtttagtcggggttctcccgttgtgtagttggttttttgagtccggagcaagatgaacacagctggagctagctctggagtttgttctcagggtcttctagtcatcactcgggatccctccagatctgcgagttcacaggtagcgtcgaccaactttcatttcttcgacgaatttcttcctcggctggttctcctctgctacttctccagcgaaggatttttttttctccaaggcgtttgatatttccaagtctagccgagatggtctcaatctcctataaatcgggtatgcctctcagttttctttgcaaactgctacgttctctctctaatcctcgccagtggaatagttatagggttcatccttggaatttttgtctgcaagccaactttcgccagtggaagtggaatagttatagggttcatcctgccagtggaatagttatagggttcatccttggaatttttgtctgcaagccaactttcgccagtggaatagttatagggttcatcctgccagtggaatagttatagggttcatccttgaaatttttgtctgcaagccaactttctttcactgatccggatccggatccggcgaatttcttatatgttgttgctgatattattatgtgaattccaacatccaaacctcctttgcaaggccccgtttgggacagcatgttggttcaatctcctgcagcgcatcctccaccgtcagagtcaagtttctggatttcgtcgttggggttgaaggcaaaaaagggggaaaggactccattgctttttgctatttttaaagtccttttctgcactttattaagctcaagtgtaatttgcccagttctaaggggcttttctgcaaacctggttgtattccagtgtcctccactgtatgcaaacttgtactcgtgtactgtgttacttctcttacttaaataaagttacatgagttcaaaaaaagaaaagaaaagagccagaccaataatcggagaatgaaaaaatattaccaggctattctacttttacttgtcaggagcatgaattatctcgatagaacattatgcaacttttactaggagccagttagaaggaaagaatacgtatgctccacttttctatacatcagctatctatatgatgtcttcaaaagaagtgatccattccatcctatagcacacaatgcactgtcgtacaacacaacgcacaacgaattgaagaggtaattcatcttcccaaataacatacttccttcatttcacaatataagtcattctagcatttcccacattcatgttgatgttaatgaatctactaacatcaacatgaatgtggaaaattctagaatgacttacattgtgaaacagaggtagtaccaactaatcaaccagcatgtgttgctataagaactcaaaatgtagaataaaacatgagttttaataaacagtcatatcaatattaagacagaaataagcgcttttttcgggagcaagacaaaaaacgagcacttgtgcagatgtgctcagcctccagtagtatacatgtcaggaaataaagcagtgattgtgtgcgctttgctcaagaaggaacagatgagcatcaaatgccttattttaccatcacatattgagatgtttatgaagacgtcaggccaaagccataattaagataactcactccacattatttgtttttactggagctgaaagtgaactctaacatttaggaaaaatgggagtagcccattaccaaaaacaaagttcatatttgaagggcatccgcaatcgaaccagcaaggctcaacacctcaaatggaggttgttggttgatggctttcactgtttgagggcaggagtcagtgatccagaaatacgcaaacttgtcagctgacccagctgtgagtgggaaaaaaaagggtgagaactgaagttgagtggctgaaaggtagaaagagaagagaatcacgaattaccggaattagtgtgagtgaagcgctcatacgactgcttgggaaaaacagcatgagtcacgtaagcactaacttttgcagcaccatgagcagccaaaactttctgcaaaataattagacaaagaagcattaatgagaaatgcaacataaagcagcatatcccatcaacagtttatgaattagtacgtcctcaaaagtgttaaaacaattacatggagtaaaatgaacatcaagcctactaaaaaatgaaaatgcaaaaataagcatgtgactgactttgctaagatcaggttttacaagggcatgtaattaatctctgtttttcaggacctctgcctgttggcaattaatatgtgaaacgtatattataggaggcattactctttgtcagacaactaaaaacaaagatagcaaaaaaccatatccctcttggcctctcccactaaagtggaagtaagaaaatccaacattagtaaaaattaagtcactgaagcactactttgtagtatcatggcaaagccacagacagtatgttgatacctgacattctctaagagttcccccagattgcactaaatcatcaacaataaccacatgccggccttcaggattcccctccttaattcgaactatcctcttgtcaccttcccgaacctttgcgcagacaaccttataatcaaacagcccaaagtaaaaactcggagtctttcaaccagaaaaaaaaaagagcaattccacaatggcatgcataaccgaatttcgacatgttcattcattcacacaaaacaagaagctaaccattgggaagttgagcaatagcttgtggaaacgcttccacgccccatcatccgggaaggcaatggtgatctgcgcaacacacaaatcacacaagtcagcagtagcaacacgaattgggtacttgaaagaaattagtaggacaccggtggccttgctacgcacattgtcagcatcggggagctgccggaggcgctgcagcaggagcggaatcccggtctcgaagcaggggaggacgtcgtccccgaagtagaacctctcctggagcgcgtggatgtcgtagatgacgacgctggtcgggccgccccgggacttgggaatcatggagaggatgcgcgcgagggtgaacgcggtggcgacgtcgccctcctcctcgacgcgctcgaaggagcccgtggggaagaaaggcagcacgagcgtgaaggaggcgatgaacagcttgggcagcgcgaagatgacggagatctgctcgaagatgaccgacggcgagctgaacgacgccaggaacgccacgtgctgcccccggatgtcgtgcgcgttgttgatgaacaggttggggaacccgtcgtcgaagctcctgcgcggcggcggcggcggcggaagcgaatcagcgaatcaggtgactccacgaaaccggcgaggaggaggaggaggaggaggaggaggacggggagcgtacctccagttgatggactggagatggatggtgtcggagctagcggcgaccttgagcgcgagctcctcgcactcggagcagtagaagaggtttatctgcttcttcgccttcggctgcctcgccacgacgacctccatcctcgtcccgggctccccggcgggcggctgcggcggcggcggcgcgcgcgagcggaatctccgaaaagaacggcgcggggggacgcgagcagtgtggtcggctttatcgacaggggagaagcagcaaaggtctaggagcaaattattcgctcaacacttttctttttttttttcgcgagcgtaaaccctagcttagaccccagccgcgcggcgcgagccacgaatcggcccgtggtatgatcgatcgatcggccgacgcgagcaggctggatttgggctcgaggcgagactagcacctactagtagcggcgcaaattggggaagaagataatgcgagatttttatagagcgctacttgcaaaaactgacgaaaaaaaaacaaaaagggagaaagcatggaacgcgccgccgccgctgcaacgcgacggattactatcaccaatccgataccatatggtgtcatagagaggcatgaagtacacagccaacggctggctctcagggattaaacgtcggttctaaaatatactctccgtttcgaaatgtttgagaccgttaattttttagcacatatttaaccattcgtcttattcaaaacatttaagtaattattaattcttttcctatcatttgattcattataaaatatatttttatgcaggcatataattttacatattttacaaaagtttttgaataagacgaacggtcaaacatgtgctaaaaaatcaacggtgtcaaacatttcgaaacggagggaatactagtatactaagtacaaatttgaattgactgatatctaatactatctaaacggatattcgtacggtcagattcgctaaacaaactcttaccacactatctaatactattactactactaatctataaatagagagtcgctaaataataaactcttactatacaatctaataacctgtttggtacaactccaactcctaaatttagcttcaggagttaggtctgcagtgaagttgtggagctgtctaaacctagcttcacaactctagttcattttatgagagaactccacccaactccactcccagttttggtggaactgaaactgtttggctgagctccagctccaggaggggtggagctggagctgtacctgtaccaaacaggccctaatactactattagtagtatgtagtgttagactgtagtattatataatatctaattcattatttggttaatatattttagtacgaatgaagcaccgaagagcattgttggtgaaggtttttcccatgaaaacaaagtgtacagaagcaagggaatcgtaagaagcatatgagaacctgagcagaagacaagaaaatttctcgagttctaatgggagacatgggactagtttattccccacttgtctctagtggggtgctaatttacaccagcccgtcttgtgtgtatgattgattatccttagccaaaatcaacggtacaaaaatcgtaagttacagaaatgtggtcaatccaaaaaggtatacgaaatcaacacctgaaaagaatgccaaaacttttgcaatgatccaaccgctgttcaccaacagaatctgctccaggcctattcaagaattaagataaaactggcgtgtttttttcaggagcatacctcgcttctccggaacaaagctaagagctgccagagtatctgagtatatacaagtctagctaacgcacggatcagttgacgaatagcccttttccaaattgaatttcggctcgctgggatatacaaagacagttgcggctgaggctgaaggagtcagtgcagcagaatacctcactgaagttattgttatccttggcagctgctgggaaccagaaccaagcggcacaagcttatggctaacaatatgctcggttttcggcagaatggatgcagcatgattgtgagccccagagaagacgaagttctgggaatcaacaagagagtacttgatttcctgaagtaaggatgttgaattgtagatcttcacatgaaaagtgaaagggattccaaggatagcataaggagggcactccatggtcacaacaagtggcggctcctcgatatgaacttcaggtaacctttctttcattataacacggctatcttgactctctccaatgcttgaatctcttgaccagctcaggcaaatttcacctagaaaaaagcttggactaatagtatgtggattcactgaaaatattcctttgtattcttcactaggagcaataactgcgtattcattggaaatcccactgatctgttgcactgagcagagttgttttccatcatcattagacacaatagtcatcgtgtgtagccgcaaaggtacctctgtgcaatttctagcacttaaaataagcatatttgactcgttgaaagcaagagaactttttttatcatcatcacttgaggatctgatcctagataataacaggggttctcgcctaaatggtctcaaaaactgttgactgactatcatggggatcttaccttcaatttgcaagcttctgtgcacattaagtctgtgcagtgctgcttcttcagtcgagtccagggaatagccaagtgagacatagaacatcactgacattgcttgatgccattttatttccaatttgcatgaccaggaatcacctgcatataatgtgggaacagatacaaccccaaacgagtgctggatttttcttatgctatcaacttcttcctttgacccattttccgtggtcacatctgagacaccaagaagttcaacatgatgactttcagattcttctgcttccctaggactcatcaaaaggcctccacctttggcatcgacaaggttgattttcagttcaccagaatgaactgcgtgtccttttgacaatatggtcactgggactgtaaataattctccaaccaatgcaggaccaggacaatctaagacaaggtcaacttgagcatctggctcttcaacttggatcagtttctgcccagaaaaagcaagtacattgtccttcataggtaatgcctctacttggtcctcaaatttccacaatgaaaattctcccattgaaacaggactttccgcttggcagcaaactacaagacgtttacttattgttgccttcaccgccaaacattccagctttccactctgtcctgcagaaagtactcacattgttatttcatgataggactaacagaaggggaaaagttaacatcagcaaatgccgaataaagcttaaattttgattttcaatctatcagccacagccaaaatttggattttagaacttaattttatagttgattttgatgttttttcatcgtagttcattttccagcattggcatttaagtcgctaagaacgcatataaaagagttttacccgcaacttatgttttggttgctaataagtgtcatgacttaaaatcggttgtacgcaaaacgatgagactggtaatgtcctgttgtttctgtatgttcagattaagatactaatatgacaatatttacaggttacttttcaagaaataaaacatttacaagttacaatacgtgcagagagcgggtggatgaacatctaatgaaataaactatatataatatatataactgatacctggtttaacttcatgagtcaaccgcatccatttatcagtgaacagtgtcagaggagtctgaacagctccatcatgaacatgtgaatttgatgcagaacaatcttcctgtgcactaactataacaaagttacagtcggattggttaaactgaacctccaacttatcaatcataactggacaaggaagatgagactgtagagagacactgacaagcattggtgaatcaggttttacagattgatcgtgaaaagcaacagatgcgagaaacactatccttagtggacttatttgatcaatatcgaggtgagtagattcttccatcaaatgaagatcaaattcatcatcagtgttctccgatgcatgctttccttccaagatattaataacttcctgctgtataagctctctactggaaatggtaggagatcctgctggtccatttttccttttattttctgaatttccctgtccactgccagagaataaaggtaatgcagccatctcaagtgaataactgataaagtccttcagagacttaagtttccttgcacattctctcaagtaacctaggttttcccaaagtaaagtggcccaaccttcttgacggtataggccagcaacaccatcaaaaagttgttttgcattactaaaatcccctgctgcataatactcaatggccattccaccactacaggcagaagccattcttgtggcacctaggctccgaaatgattcataagcttttctgaacaatgcaattatctcataggaatcttgaaacctttcagcttctgacaaagcatagctggtatactcagtatcagaaaggctgcaagcacagtgtcagatataagtagtcatataaaaattacgttaacatctaaaagtaactaagggtcaaagaacttacggaagcaccgcaactgtatctccttgctcaaacaagcgtacatactgaccaacatatacggaaggcattactgactcaggtaatccattgactcctttggtaaggcttacacttgatgaagagaactctaaggcatacctcttctctctcaagtaatttgccgccaactgccagaagggaaggcatcataaaaagatcactagtgtggtcaagtaaaaggaatgaaatatcctctgttgtagtgctgtgtagggagaggttgaacctgatagtagtaagctggttgaaattcccactcggtcagtgcgttgtcagcagtgccaaaacgaggagatagtgtatccggaacagttgtagatgttgtttctatgagctcaccaaagacaaggaactgcctgctaaaccattcccagtgaagaaaagcaacttctggtgatccaacaacacgctcatagcttctgatatgcttacggaaccatgtgattgctcccacaaccttccccccatgaagtaatattgttgatatcttaaagtgaaattgctcagcaactgcttttacctcaacaaggcgttgtgttggaggcagtcttgttgaagttcctatcatctaaataagagcaattgtcaatgcagggtgtaaagccaatagaaactgcttaagcaatagtgtcggaaaaataaaacagtaaggaatcttgaaggctttcaatatgtaatgtaagatgcaaacacacatggagaggatagggcaggatagagtggtagcttggataaattatctttaatgctagacaggtatgagatcctcatgaagtgttttctatatttaatattttaaaagtagcacgtgcacaagagtatattcagcattacaaatatatacgacatttggatggatagcaaccatagctgtctttctttatttactcatgagttcagtgtcacaataatctggcttctaaaagagtatgtcaggtgtggattcacttaattatcagtcttttaaggtctatggcaaacatggaacagggatccaattcacacctcacgcagaacacgaatgccctcctcatagaactttaatgcttcaggccaatcccgcctaaactccgcataaacagcgacctggtgttagaatcagaaatatcagaggaatgcagcccaaaaaaaataaaaattagagtagtgagaagtcattagcactactgactttaccaagcatgtgaagaaaaatttttgtcccaataccacgggcattaagaatgactaacagtgctaaattgaaccagagagagattcctcttcctaccttgaaacagtagcgaatgctcagctcaacagatgagaaattccttttctcgatgcgagctttgacccttcgtccttcatccttatagtatgtcgtacataactccgcaaaaacagttgtcaacctttcaatacagaacataatgcaggttagtaggtataactccaaggaacacatgaaaaagaaaagagcaaaagatagtttcaaaaaaaaaagaaatataacagtagaagattaaggggaagtttcagagcatacttgttgagagatttggtccattccatttcatctctctcaaccaaaacaaccaggtgctttgaatcaatttctgcacgtttcctcagagcaaccgtaacatcctcgctcagttcatctgcaaaatgttattggctatctggttaggtttgacgacacaaatatcaagcgagtataagggtctgttatcataaggcccatgcccaagcccaaccctcgattcccatgacgcagagtgtaggcattgacatgcgtaaaataacagatctaatgctgttgcagatatggccagttgcagattgtttagctaagcttcgtaagctaaagtgctaattgcttgttcagcgagaaaatgtattactattacgtatactcgagaggatgcttaccaccagcttgactctgtacaaggatcaccactaatttagtgtttcttccctgaatcacagacctgcaaaaaaaaaatgaacattacttggtatttgcgaattcagtctgtgctacactagctgcttatacactgctgatacttcagaaaagtccttaatccaaaagaggtcgatagtttccaatttgcattgcaggggtgatatttatgagttctgattatgcgcacatctatttgggatcaacgatgcaagagatgtagaggaggtacttgaggttctcgagatcggagcaggcctggagccactgggcggggtccccggagacctgatcggcccggaacatcgcggcgacggcggcgggcactcgggtgcggtgcttgaggagccagtccttcttcaggatcccggcgggggcctgcggcggcgcgagcgggtcgcgggccttggcggtgcgagcgaggatggaggccttggagaagtccgggagggcgagcaagttcatgggcggctgcctggagctcagcgccgccgagatcgcggggtgcagctccgggcaccccacgatggacaccagcgacagcggcggcgtccgcagctcctccgggtagtcctccatggccgccccacccgcggcgccgcggcgaggcgaggcgaacggtcgggaggcgctaggtccggtcgccgccggggtggtggccggggaggacggggagctcggatctgtggtgactgtttggttcgtttggaagaactgggtgggggcgaggacgacgacgcgcaaggagtggaaacacgtatcgctatgtgagatgtaataatgaatatagtcagggtgttttctatgaagtctgaaggaccttgttataaaatttcagaattctgacagtcatcaggttaaatgaacaaatcaataaactacgtagtagcttgtactccctccatactcataaagaaagtcgtttaatacaatatttaagtcaaacattaggaatataaatcataaataactctcaagttgttgagtttgaaaatataaaaattatatgaatagatttgtcttaaaaaaaatactttcataaaaatatacatatatcacttttcaataaatatttttatagaaaaaagaagtcaaagttatgttttggagatcgtgtcgctgtccaaaacgactttctttacaagtacggagggagtagttcgtttatattgaaaatgaagatgaacttagagcacggaaaacaaaaaaatcataggcgtatgattaattaagtttagttattacaaaattagaaaatggttttatctaacatttcaaagcaatttatatatagatagttttcacacaaaatacaccagtaggcagtttgaaaaaactaaaatatagggatgcaagcgggtcaacccgcgagttcacttataggtcaaatactccctccgtactcgtaaaggaagttgttttggacagtgacacggtctccaaacacataactttgacttcttgtttctataaaattatttattgaaaagtgatatgtgtatagttttgtgaaagtatttttcaagacaaatctattcatataatttttacattttcaaactcaacaacttgagagttatttatgatttatattcccaaggtttgacttaaatattgtcttaaacgacttcctttacatgtacggatgggagtagatgataactcatggatttttgcaacgtggtccggcttgccgcatctagatatgcaagtgggtcgatctataaactcatttataggtcaaattaatagataacccgcaagtcaaatccatgggttacccactaattttgcctataaacgggttcgcggacaagcctgcttgcacccctagtgaaatattttttaatggcaaaagaacatgatctgtttggatcccatgaagacgaatattaagtatggacatgtaaaactagaaagccaataacacatggttaatttagttttaattattttaaacttagaaatggatttatcttatatcttaaaacaatttcacatagaaagttttagcacaaaatacatcgttttagcagtttgaaaaacgtgctaacgaaaatcgaggtaaaatatgtatcttataagacaacggaagtcattcgaatttttttagtgaatatcaacaactaattcctaactacactaattcgaaagtagaaatcacagattcagaggtcgggtggaccgacacgggaacagaggaggcccgtggtggtggggcgacgccatgctccctagcctcgccactcttctcgccaagttcacgcttcccctcattgtgtcgccaaaggtgatgacacctagcctctctctctcctttcccatatcttcccattatgttctctcctatcttcacgacgccgaggcctgaggccctcacgacagcaaaaatgacaacctaagcatcaacctgagcttccccgtcttcgtcaccgatagagctcggtgatgccgccgccaccgtctagctcctctctgccgactaccgcccttctccctacacaggcacgtgccatggaggcctgaatagagatgaggaagagagagaggggaggaagaagatgttgtttcaatatttaggaccatcatgatttttttttattttctatttttgcttttggttccaggtcagcttaacacagcctacaaagctgccttgggactacattcgtttgttttgaaagataaagaacgtgtgttatacttatatctggtactgcggtccaaagacacgattcgaactcaacgtgaattatgagggacctaaagtgaacttattctatcacgcggttggagttcaatagtctatcaggcccatccgggcagagagaacaaagcggcccatccaggcagagagaacaaagcggcccaccactggcgggagtaggcgtaggaacaatctgtccctcgctcgcaagccgtggagatccatcctttttttcccattgcgtgccagttgccacctctcaaccccccgcccctggctcaccctccgggcctccctcccccctcctctcctctcccctctctcgcggtcgcctcggtgcagcccgcgaaaatagcagccgcccgttccctccctctccctctcccctgccctgccgaagccgcggcgatgaacggcgccacggccggctccggctccggctccgaccacgacgacgcgcgcgccgccgaggaggccagaggggaggaggcggcaggccgtgccgtggaggttgaggaggaggaggaggaggaggaggcggtgcccgtggcggaggagagggccgcgtggggcggcggcggcactcccccgacccccgagccgaagagcgacgcggacgcggagggcgcgggctcgctggatcgggtggacctcaatgcaggggcgggcggcggccgtgagcgcgaggacgacgagggggaggacgaggccgtgggggggctgcaggaat

SEQ ID NO: 42066 - DNA, 5779 bp, Oryza sativa
caagcctcccaagttctatggcaaaggtctcaactgcctcaagtgcgtgtctttctacacctctcgtttctgttagctcctcaacccgagtacacccatctcttctcgtctaagcttgctctgttccttttccaatccaggttatggaggcaggttgcccacctgggaggccatgagcaggtatggtcctcgactccttgtcactagcttgctcgctgctgctactgtagagtaaaatattttcggtgacatatgtccgggtggatcacgatcaaataagttcaacagtgattagtgagctgcaaggacctgagttatatttattctagttaaatattttgcttgttcaggtaacaatttgtaaactatggcgtcaagttggagagactttcaggccgccaaagtaagcctctaattttcacagaacatgttattcgcagaaaaaaaaagacttccatatgtgagtaatttgttgctgccgtaatcctttgcaggacgtgcactactgtatcgtggtcgttccgaattttctatgagaaggtgatgcatttgctgcatgattttcttttgcctctgtacttgtcacaagagaacttcccccttttcagttctttctgtcacaagtaaatggtcaccaacaatcattttttttcctgcaatcagtatcatatcgcatcaactttattgtaagttttagttgcaaaactgttagacttattagtatagttcttagtttcaaacataagaattgatctaaaatgatgggtctgcctttattagtgtaaaaattttaggggttcccgtgtcagttaatgttgcttccttttttggcagggaatatttaatgttcttacttcttacttttagtttaacgagcaattatcttacttgatgcgtcccttcatcattttattgaaactgttgcgctttcttcagatgctattactcttaattctttagatcattaattttcttagttatttatatgctaactgatgcatgttttggatggaatatagtacagaagcattattgtaagcttagattccatcccatatttatgcattgttttctgcttgatttgttaatttttgtttctcattaacttaggcacttctcgagtatgaaaaatacaaagtccgaactggccagcttcaagtaccattgtctgctttaccacagcctggtggtactggccgtgaggtaattgttctaatagtgcagtttttaataagagctctaatttattaattcagtttatattttagttcaatactgtacaatttaacgggattcaccctatttgtgtaaatctttaataattagatgaacacatgctgtccttttaggacctgtctaattcgcgcctgcgccaaaagtcatgatcagttacggacaggatgcagccacgcaggacttttttttaaaaaaaaaatcatcactggaagaatagtaagacgagagcacccagaaggcctcaatccagttcttgtgtccccaactcgtgcagcttgcatctcatttcttgaactccccagtcacagtcacgcatgggcatggcacatttgtttatagcttttcgtgcatagtctcccctaatcctttccctggaatttgtagcccttcttgttctgcatcccgaaaagggaaactttcaacttctcattgcaaaaaaaaaaaaagatgctactaaaaacctttgattggacaactttcatctggaactgaaaactttcacctggaactttcatctggttactgaaaactttcttttggagactaagctttctactagagattgaaaagcttcctattggagactaaagagcttttgatcggaaaactttcacatggagactttcatctcgagctaaagctttggagcacacaactttcatatagaaaaccaaaagaataaaacggaaaagagaagggaaagcataatcaatgtgcttgtcaggggcctcctgagtgaatgccaagcctaaacaaaattgcataccccttcgtgtcgatcaggcccgtatgctagcattcctcacaatgtgcgtgaggggatttacttttttttttatatccatttgtttatggaatggtgttacgcctttgttagcatgcacctcattagtcatgtataaatgaaagctgtgatatttacaccaacctagctgaattaaggacacagtctggttatatccggaaagaccaagggattttagtcactgaattccttctgaaaattgagtgttggttatggatccaattttattgacatagacgcactaataactgatttaagatgcctgccatttgttaaggtttccatcaagatgtgtggtgttgcgttgttgccaaaagtgttttcttgtcgatgcgtgtaaactactagttttagctagcttgacaagtttgtttactgccttgcagattggtatgaatcaatcatcttctgccagagttagaagggattctgcagcgcgtgctatgcagggttggcatgctcaccgtctccttaccaatggcatatatggagatcaaatgttgaaggttaaaaagatcttgctctttgtttacatgtaccttttcaagtcaccaactatttaatcagaaaagattcaaacttgtacaggaaaaagattcagtcccttcttcaagtcgtggtaagaacctaaagtatttggtatgtttgataagttttctttcagcagtgcatctgttgttttttctcatttatttgttttgacacatttaggagtactcaagaggaagaaagcatctagtccagagtgtgctatcaaggtgtctcgtacaaaaataaacaaatcacagttaagacttcctttcctttctgttggttatatagcattggctgataatgacttggatttagctacggaatatgtcattacaaaattttataggaaaatcctaaaaattacagttacattttgttcaattaagcttctcagcagaatttaaatccatatatttggatacttagcctatgaagcctgaacttgtatttatgtaacgggattctcaatttcagggatgactcaatggtcactgatgttggagaacctgccgagtgggtgaagattaatgtacgacagactgtaagtctcatatggtgcattgatattacagacaagtttttcagtgctcttctgaaatcctaatagcatatgagctggtttttctgttgagttgccatttttattcgggagaaatctcttcatttggctgtttctttcctgcagaaagattgtttcgaaatctatgctctggttcctggacttctacgcgaagaggtgaaaaaatatctttaatgttgaacgcatcacttcaaactgttccattttcctaaaataaatacctgacttaatttgtgcgtaacaaacaaaaagcttccacttcttgaactgaggcactacctgcgagaagaaatgaattgttgaattttgttctaaatggtgcaggtgcatgttcagtcagatcctgctgggcgtctggttataactggggacccagagcagcctgataatccttgggggatcactccattcaagaaggtgatagcagcaatttgaatactaatttgagcacgtttgcattctcttcagataacatgaagtgattactctttctcaggtggtcaatctgccattgaggatcgatcctcatcaaacatccgccgttgtcacgcttcatggccaactatttgttcgtgcaccatttgggcatgctgatatgtagatagtttcctttgagtgcagataccactggcccggtggtatttctggaattctttataggtttgtgattcaccgttgcatctatcccttgcttcaaattaagctcgtcatgctttgatatcaggtattctgtttttcatgcaggctttagacaattttgttgcagaagcaagtttttgtgtgagcagacgctcaatgccgagctgacaacggaattttgctgtaatcagtagcaagacttggggatctgctataatagtattgtttatagtagttgacataagtaggctggtttattttggtttgacctaccggagatttttgttttgttgtttatttttagtcggaagcagagtatatcaaaatagagagatgaaaataggttaaatgaaagcttaacttctttattttttggaaaacaaaggattagtttcttaacattattatttactattttcatagtaatgtttataagtgcctctgggcaatgcttgtccttaagcaaattttttatgcttgcatttgattcctcgtcccaatggactattgaattctaaattttgttgctggctatcatcgaatattaaggtccatgttcttttcagctatttcactagatattgtttgtggattatttgtttcatgtgtccaaaaatattgaagctgttgctaacttttctctaaaatttacatgagccatctctaatgaatttcgttggatttggtgaaaaaaattccacatatacaatcttatctacatcgaatttataccgtattagattacctgatagaggcattattttccaatgctattgggtgggttgatttgatagacttcttttgcttttgataaataatagcgataaaaataccaaactaaaaccccttgaaatcaagggcagccccatcgtttggcatacttgaggaaaaaacggaacggcatatttgcaaataaaaaataattgtgaataaaacttttatatacatgttttcaacaatccaaaagcaaaggctggaaaataaactatgatgaaaaattcccaaaatcaacttcaaatttaaggttgaaaaatttaaattttggttgataagtataatcgaaaagatgagaatgcgaggttgcgttcgttggaatgagttgggaactaatcccttgcacacaaatggaacgaattgtagcgtatgattaattaagtattagcttatttattttttatgagaaattaattaatatgattttttaaagtaaatttcatatataaactttttacaaaaggcaatacgttcgagatgtgaaaaaacgaggaatgtgagttgagaaagccggcaaaagaacacatccctaatagctccagtaactgagcccacttgtaactgcgatcctacggcccaactcccagggcccatcaattagtagtgaaacaaatccggtggtgggcccgattcgcaattcgccaaacggcagggacccgacgcgaccgcatcggcatcgcggcagcggcagcgtgcggtgccgacttgtgggaggagccgcctcctccgcctccgactatataacaaaaatcctcccgcacccccggcacatcgtccccgctagtcgccgccagtcaccaagccccgagcccacccccccaagctaccagcacagaacgaatcggagcgccgcgccgcgccgcgctgcgtcaccggcgatggactccgactacggcgtgccgcgcgagctctcggaggtgcagaagaagcgcgcgctctaccagcccgagctgcccccctgcctccaggtccgcacccacccattgccgctaatcctccttcccctgcgtgcgacattgcggtccctggcgcggcttcccggccctagatctgtgtgcttccggaccgcgcggcgccagatcccgcgccgctccggcgtccggatcagtccatctcaccggcgctggtcgtgtatactgttcgtctgcttccgatttgatttctcgggggtcttaggccataggtttacgtgtatcagctgtcagtctgtc

SEQ ID NO: 42067 - DNA, 18009 bp, Oryza sativa
cctgcgaggtgcagggctctgtctagcaatgtactagtagatccaaccggcgtgcctggcttgcgggaggctgcgtgcgcgggggaatttttttttttgaaagctcgttttgccgtgttggtattgtcgtgttgctgttttatttatgagtttagtagtggagcgtagcaacttggaataaacagtagatggattgattcgtctacagcaaccatggacttttctttttggactagctttcacggtcctgtgttgtgttgtttacttttgtggtgacccatgaatcgctatcaaatcgtaagactttctcctgtttagttatgctgtttgactggtggctggatcggatgaattcatgataattttgcgaatgattttctcgcgtgcgtgtgattggtggtggatgaatgattttgtgaattcacgctctgaatttcttcactccatgtaaatcagggcaccactgtgagagtggagtatggtgacgctgcaattgctgctgatcctgcaggcgctcatgtgatcagccacgcgttcccccacacatacgggcagcccctggcccattttctccggaagacggctaatgtccccgatgctactgtcatatcagagcatcctgttgtcaggtatatatgtattttttacttgtgatattcaatttttttacttgatatgccatctgctgcaagacaagaaactgttttgaaaaaaagaaaccaaatactagtagtaaagtatttgtcaaattataagagaatgctggagagaaattacatcaaattatttgtcttcgcctctcactgcctgcacatataagacatctgattgttttgttttggatgcagggttggtgttgttttctgcggaaggcagtccccgggaggccataatgtcatctggggactccatgaggcaattaaggctcacaacccaaacagcaaacttattggttttcttggtgagtcctttgatatgcaactatgaatgtattaatagttcgttccctttgttctcatgtctgcttgttgcgtccaatcagactttcagcgtttgcttaaatagcttcacaagctacttagcacactatgtgttgtcgacttcccctagcagccaccagtgttttaatttgaattaactcagcatttttgttatattttatttgttttcattaccttagcaggtgatcacaactgtatagcatcaatacatcatttagtatttttgtcacataagtagtgacatctaaagctcttcaaccgaactttgctaggtccacttaatgaaattaacaacacagtgacatacctatactaaaaaaaaaaaaacaatcagtgatgctttgctacaagatcttggacagagtacctatctttcttaagtgtctaatccaaatcaaatgtgttaattttgtgattggcatcctgtgcatgaatccccccaaggcgggcttctgtctctcatgcctgcttttctgaacatgtctaacacttggagctaatgcttacagattttctttaactgtttcttatgtttgtgtttatttcgttcttttgttgaaacaggtggaagtgatggtcttctcgcacagaaaactttggagatcaccgacgaagttctttcttcatataaaaaccaaggtggttatgatatgcttggccggacaaaggatcaaattagaacaacagagcaggtcaatggtgccatggctagttgtcaggctttgaagttggatgctttagtaatcattggaggtaggctttgtggcattagtctactaaatagctacattgtgtatattttttttaatcctaacatctgtttaatttctggtttctgaaggtgttacatccaatacggatgctgctcaacttgctgagacttttgctgaggctaagtgtgcaacgaaggtatatcataattcccttttcttgttgcagtccgtgccttggttcctgattccctatttccattgcaagtgtatgttttacttgcctgtaaatggcatgacacaatttattattgaacaggttgtaggtgttcctgtaactttgaatggggaccttaagaatcagtttgttgagacaaccgttggttttgataccatatgcaaggtagctttacattactatgctggggctccatttacctttactgtccttccattacctctatatgatgcataactgacctgttaggcatgtttggttttgtcaattgaggttgtttatgtatgcgaaagtgtgttttttgtgctatggataactttccaagttgcccattcaaaaatactacgcatttaatttaccactttgcaatttttatttattgttgaacttatttattattataacaggtgaactcacaacttataagcaatgtatgcaccgatgctctttcggctgagaaggtaatatctaatatggttgatccgcttcttctttagttggatgtactttcgtgtctgtgatactatttagctatggtcaattcctttatttttttctcagaattaaataatcaaattgaattgagacagtaaaaaaaactctgaattgatactgttaagtcccagtacagaaagagctaaacaaatatagaacacgggctataatttgcggttcactccttaattcggcctatgtgggaggttcacacttcacacacaggtgtacacaatctttgtataggcaataaaggatgccaatactgattgataacaatgcaaattcgcctaggtccattagacaactgaattatcctttttcttggggttccatggtccatttgttcttcagtatttctctcagcgtggttattcagtagacatacttttccagcaaggcctgctgagccttcctgtttacaaattcacattacaaaagtaacaattttatatgccttgtggttgtattctttctggcagtattactactttattcgcatgatggggcggaaggcttctcatgtggcattggagtgtgctcttcaatcacatccgaatatggtttggacttttcaacttttcgcttatgcttcctgagttgctgcaaattcttcttgcatttgtttgaacctgtatcatatgttcaggttatcctaggtgaggaggttgctgcatcaaaacttaccatctttgatatcacgaagcagatatgtgatgcagttcaggcaagggctgagaagggtaggggccttctattgtgatatgctcatgtaaccttgctttcaccaatgaaatgccattttgtgaaaatttatgaatttacttaaccttatatttgttgcacagataagtatcacggagttgtacttattccggagggactcgtggagagtattcctgaattatatgctttgcttcaggtaagtttgtacatgccatatggctattcatttacaacatttctaagtggcatctatgtaattgtaggaaattcatgggcttcacggcaaaggtgtttccatggagaatatctcctcacagctttcaccttgggcatctgcactatttgagtttttgcccccatttattaggaagcaggtgtgtattgtctgatactcatctatcaactcttggacattcataactctcatcaggtctctgatattgcattgttgttttctgatgcagctgcttctccatcctgaatctgatgactcagctcaactttctcaggtatattatagtatatgcagcaatactttcagtcatttgcgtatgctttttttgtttcatttcattatgtctgattacaacctccacatggttaccggtgcagattgaaaccgaaaaacttttggcccaattagttgaggatgaaatgaacaggcgtatggtatgctttctgcagcctttcttgtaactgtctcttggttctgaggcattactgatgtctcagtctacatgtggagtgagtaatatttatattggctcatgatgttcttggtatctctgcagaaggaaggcacttacaaaggaaagaaattcaatgcgatctgtcacttttttggctaccaagctaggggttcactgccttcaaagtttgactgcgattacgcctatgcaagtttcagctcacctttctacttggacaaagcaattttattttgctgttgattaattatatgtatgttgtttggcttcaggttcttgggcacgtgtgctaccacatcttagctgctggtttgaatggttacatggctactgtgacaaatcttaagagtcctgcgaacaaatggcgatgtggtgcggctccgatttcggtgagattactactgtgcacccccttttggcaaaattagatgagtatgatatgaatgaagggaacacctaacccacaattcttttccctttagtctatgatgaccgtgaagagatggtcacgtggtcctgcggctactcaaatagggaaacctgctgtccatatggctactgtcgacttgaaaggcaaagcattcgagtaagtgtgtacacaatctattaatcccatcttatattcgatcgctgtacagttgctgtcattggtctaaagaagatgcataatctcattgacaataacaaacttgtgtttacaggctattgaggaacaattctaccagcttcttaatcgacgacatctacagaaacccaggaccactccaattcgaaggagcaggtgctgattcaaagcctatttcactgtgcgtggaagatcaagactatatgggcaggatcaagaaactccaggaatacttggagaaggtactttccataatcccaataattgatcgatcttcgtatcgaacaatctgaattcctgtggacaaatggcacatgttggtgtctattctaactgttgttgctgcgcaggtgaaaagcatcgtgaagcctgggtgctcgcaggatgttctcaaggcagcgctgagcgctatgtcatctgtgaccgagacattggcgatcatgacatcgtcttccactggccagggaaccccactctgagtcaaatggattactaaatccacattcgcttgtgtcatctgacatgtggggttagaaacagtgatgttgcaaccccacggctttctttttcgtgttttttctttggagagttttgccatttttgagccggtagcgtgagtctgctattgatgtgtttggttggactggaataataattgttcagacagcgatgttcttaaataaaccaaattttggtaggcaaaaaattacagtttgtgtttttcttccctccttcgagagggttgcactggaggagtaatggctgatggtacataactcgtgaggccaactgcgtggatcggaagagcgctggtgtggaggatcaggaggcaaagctccggccgcaaggtttggccgggaccccattcgctgcgtaagccgaaaggccaaaaaggaaatttctagagtccctgatcgctgataaccgatagtattgggtctgttcggcagccctatacagcggctgtgcagctgctaccattgatcttctataaatttcactgtagcagctggctgccaattagagctaccgaacaggccaattcttttttgttggagaaacgttattttctttcccgatggcgaatccctactgttctcgagatacgttggcaaatgaccatttgataatccttggaatggtaaaacatagagcaggttaaaaatgcaaatattaaaaaattacctaatatcattttttcctatcaaataaataaaatgagtaagtcctcaaacccacgctggttagcccatcaaattgttgagggaaaggagaggacctgtcactcagttttgaacctttgaaccgaattaacgaaatattaatttttgttccaagatgaggttcttgttggtaaagctgcgccgttttggtttgatatcaaaatattgccataccaatgttttggtagtttaaatagtaaatgtgatgatttggtttaaagccaaatatttggtaatgcctatactcaatttagcacaattctagaatgttcttcaccacaatttaaaatttggctctcaattggcatcaatccaaagacactcatttaacttgcctagagtttggcactaacaatatattggtagggtactaaaccaaacaagcccgctctgtttttacccatttttcttcctcttggttgaatcttcaagaattcccttccatcagccagctgaacatagtattattgtgtccaggtccaggcagtccagctgaacataatagtattactgtgtcacactcttgctaccttctgaactccacaagtccttttcctcatttgtgtgacgagcattcaggaagtttagtactttagttcgcagcgtgcagccggaaggactgcccatatttccataatactcctatttattaaagtaccgtcatagctctagtacagacatcctacgtgcaagtgtacaacaatcattggcgttaatacccatagaaggattaggtataggtcattttcgatgggtggaattcttgaagttcttcaaaccggggggagtttaacacggtttaacagcttgttggttgtgacagttttttttccccacctaaccctggctatgatcatatataacctgcaattctaaaggcttaaatttacccaatcgaacagcattgcgcgctggacgcctagatttagtacaagtggtactacaaatctaccatctgtttgcccatgatccatttttacgagacagttgtgtggacctttgtgcgagaaaatctgcattcctcccctagccggccatccatgcatgtgccggccacagccatctgatctagccgagcaatcaatgcgacagcattgcacggtatcgattgctacagtagccgctacatggcatattggcataggttgtgtttagtttcacgttaaaatttaaagtttgaaaaaaaagttagaagtttatgtgtgtaggaaagttttgatgtgataaaaaaattagaaattttttaaaaaagttagaaactaaactcggccataaatcacagggcgtcccgcagtcacagtgacgtcaccgttggctgcgtactcggtaaccgcaaagttcagaccttcatatgtgagttgtgacgccgccgaatgctgcaaaaccagccggtctgagtacgggcgtgggacgcccctttttttctgctacgagtagtggatgaaaatttttatcattgtgacatattttttaaactaccaaacaatatatttcttacgaaagttattctaaaatattagataaatattttttaattatacattaataccatcttatttaacgtaaaatatttaattttcatttttattttcatttccaacaatattttcatttccaacacaaaagaacaccgcgggtcgctttcctgatccgatcccgtttcttttaaaaaaacacgatcccgtctagtcatgtccgcatcttgcgagtcagctgctgagctaatcaatagcggcaacagcaacagcgagataaatcacggtaatcacagcaacagcaacagcaacagccggtcccggtttgcactgagaaatcactcggttagccagccgttcgaatccaaaataaaaaataaaattaatcaaaacgcaatcattttggtactaaaatttatcggcaaacttattccgaaaaccctgcgtccagcttacctcgccgattcgcgctgatccgcacgaacgggttcgtcgtcgggcgcacgcacagcacaaccatcccatctactccatctcatctcccttattccaagggatggcccacctgtcagccgcgccggctataagttggcagcgtggggcactgacaggtcaagcccgcgagccacagcggagacgacgcgacgacgcatcgaaatcgcccgcgacgcgagagagaggcggacaatactagaagcatccctcgacgcgagacgcgacgtctctctcgtcgccagcggcggcggcggatgggggcggggaatggtgaagtgcggtacggcggcggcggtgccggcgccggcgaggcggcggtgatggcggacgacgggaccacggtgttccgggggacggcgcagccgccggtgcgcaccacggttgcgctggcgctgtggctgggggccatccacttcaacgccttcctcctcctcgcctcgctcttcctcttcccccgccgcgtcgccgccatgtaacctcttacccaaatctctcctccagcttcttttccctacctcgcgctctgctcgccgttgacgggttgggtacttgggtctcactctcgcctctccgcgctgtattatccagggtgctcgccacgcagctcttcttcatgttcgcgccggtcaatgatatgagcaggttggggcgcaagatcgccaggttcgtctcctcgatttcctcggctgccaacgtttttttacctgaccgcattgttggatcttacattttggaggacgacgcatcctcaggttcatcagcaagtgcgtgattgggtacttccccgtcacattacatgtcgaggactacaaggcttttgatcccaatagagcttacggtgagcttcctctttatctcattccatctctggaatcttgattaattcttgaatcacattgatgattgataccgaggcttttcagttgattcctaaagctaaacagaaacaactactaaagatgatattgtgatacttgaatctttttaatctttaaagtatcaaacccttttggcctatttctaaaagctaagtaaaggagtagtaatatatagaaaagtatggagtcttttatatagagggcactgtccactgggttggtgattatattgtgctgtgcttgcagtgtttggttatgagccgcattctgttttgcccattgcccttggggtccttttggagcttgttggattcatgccattaccaaagataaaggttcttgcaagcagtgcggtgaggttcccacttcccagatttccttcctaggagtacattcttaagagtttgatctttcgacactctattactacatatgctatttattgtggctgcgaacatccatctggatatagaggccaggttttaatccattttctaaataaagatatgctctttactggtgaattggtcggtgttaggtgttctataccccattcttgaggcaaatatggacatggttggggttggttcctgcatccaggaagaatttctactcctaccttaaagctggttatagctgcgtcatagtgccaggaggggtgcaggagatgcttcacatggatcatgattcagaggtaactgcggatttcttcttttattatcaataaagacattgccttctttcttgtgcaaaaccaagtgaaatacttacatcttttaccggaatagtgatggttaatttttgcaaatgacaggttgcttttcttaaatcaagaaaaggtttcgttaagatagctatggaaacaggttcccctttagtccctgttttcgctttcggacaggtaatctactcttgcacccaataagttcataaatgcaaaattccttatccatatagtaaatttattcatggtattcagtttgctgatttttttttggcactactttgactagagctatgtttataagtggtggagaccaggtggcaaattaattgtcaaaattgctagagcaattaaatttactccaattatgttctggggaaaatttgggtaactttctgcagtttatatatattttttcaatattttttatttggtcaagagttcatatgtccttgcacattgtgatgcaggactcccattccgtttgcgacacccatgcacgtggttgttggaagaccaattgaggttaagaaaaatgctcagcctacctttgatgaggtgaaatatcatcttgacattatgccaagtacaccttttgatcagtctgcacactaaaaaactgaaattaaatgatgttctaagataaatattaccatggaaagtaggatcttttttgttttaattgtttttgaatggtaaaaaaataaaaatgtatatattcttacaattaaaattgggtaattccctgatgtggcagataaatgaagtccatgaacaatttgttgtcgcactacaagaactgttcgagaagtacaagactaaagctggatatcccaacctccatttaagagttctatgatggcttctgtaagttccagcagtaagctctaatgatctggatttacggaataaaatggttatgctgttaggccatcaattcaatccctcgtagcactgaagctggagtgtgttcagttcaagagccagaatcagaattcagtagcttcagacatgattcgccacattcccaacagcagttcagtaaggcaacgtattgactgacgaattatcctctggtggtttggctttggcagaatagaatgcattgtatgtaaagtaaatgtgtacatttgtttattactcacgattctctcacatcattatcagcaccagtgattgaatcgtgcacagaaggggaaatctcagggttcatattcacagacctggtgtacttccaaagctccaagttagtgcattggcagcagcagctaactcgagctgagagcattgtgtcgtcatacagaaaacactcaattttctgtaacaatatttcacaaaataaagacagcgaaaccgcagataaatcagttcaaatagtaaagtttttaacaacctagacttgaacaatatcgctgactcgggcagagagcattgtcgacttgtcgtcatacagaaaacacaatttctgaaacaatatttcacataatacacaagactgccaaaccgcagaacaatttgtacaagttttaacgatcaagactgataccgctaactcgagcagagagcattgtcgtcacacagaaaacacccaatttctgaaacaatttcacataatacacatcactgcaaaacagcaaaacaatttgtacaaatagtacaagttttaacaatccaggcttacacaacaccgataagaccccaaagcatgggtttctcatccgaactgatttattttggtcggacaacaaagtgccgttctcggaagtcgaggaactgctgagcacatagcaatgaaaaattaaacacataacaacagttctgataccgataccagtaacacaatagacggtagttctgataccgataccagtaacaccatagaagatagtcctcgtgacctcgctaccagttggtaacgagtaacgaccctgagcagttccggtagacacttgggttacagatacaggaggaaggaccatcttggtccaacattttggacatgatgagtgaagcggacgcaataactatttatacctccaaaggccgatcaagcatagatcacgacgatgaccatagacagacacaagactgacgggacgggctacatttgttggacttgtgccagacttcaacactgggatataatcaaccacatagtagcttgatgattcttcaggagtttaggtgaacaatcatatgagtgcatcatgactaatccaaggggattagtcatcttacagagtgctggactccattccagcatccagtatatctccatgggctaatgagctgtcagatacaggatcaataatgctgtatctagagcttcaagctgcagcaatggtcgcagtcccattgagacataggatgtaaccaagcaaaactgacaagagcaaccgttgctcttggatcattgtcccatccatcggggcaacatcatgattccaggtacatctgatgaccatgataagggcaacctgcagaaatttcatagcgaagattatcataataatcaaaattacagaaatagaactcaggtcaataaaatgaaaacttgtatatgataaaaaacaagatgcatgatcacattagtatacacgtgcgggcacatgatccaattggcttacaataacttcagacaaacacgtataaaccatttcccaatgttttgaaacaagaaacaaagaaagcctgaagcaaacagaaagaatttctctgggaaatttttgctatttagtgtcgaccatatcatatcacaagcaaacagattgattaagattcagttggctgtttagtctgtatgttcagagtaatgatgaacgccatgatgccatcaatgtacttatcttctgttagatgcaaaactaatctaacatcaacgttaagaatgaatttcctggtttggtttcaagttaattatgggaaagcatcacccagtatcgaatgcaatactattggagcataataggagatcctaaaaaacataacgagattaaggagtacaacaatgagaataagagacaaaacacaagcatattaacatcaaagtttgtcccttttgagttctgacaagttagaaccaataggtaactccatcattttgttctgaaactaaatgcatctgaacttctgaagggcagaatattgatggactaatttcccataagagtaagattggcattctatgaatgtaagcatggcttctcagtacagcataattggtaccttatgaatgcaagggggattacttgccaggtaagaaccagtactacaaatacagcagcactgctcttttgtcctgctgcaatctaagggtacctattagggacagaaaaagaacagttactaccagataatcacaagaaaagataacagcagtccagacagaacaaacctcaaggtacaaatgtttggcagcatagttcagcttgctctttggtctgaaccactagcctgtgtaaactgaggtgagtgagctgggaggaccaagtgcgggtgagtaggaaccggtgctgctacaaaggccaagtaatatgaagttattcacaaaaggagaacacttaagcagacactataaaaagatgcagggtgacgaatgaacgatagcatccatgttagcctggtaaatttggtgtgagaacatatagcataacacagtattgtgttttctggaaagacaagaggaatcactaaatactaaaaaaaataggcaaagaagaccacattaccaactaaaaagggggcctgaatggtgggccgaggtgtaggcgatgcactgctaaagtttgatccagttaactgtacaaatggatttcctggcacattgtaaccatgaatagccacataaccattacccccaccagaaatggacgggctgaactggctaaatggttggctagcagtatttgctgcggatgaaactccataaattggaacatattgctgaccaacatatgggtttaatgtaccctacaaagagatctctcatcagaatcagtcgatgctttgtaaaacccttatgttgcgcaaggaaaattaaacgtaatatttttcacacttcaacctgtggatagatgtattctgtcccatatgtagtgtagctgcaaaaggaggaaaatgaatgaccgaacacactttattgacttccaaaacagcgatattatgttccacgaagaaaatgaacatatttatttggcaattttcgaagaggagcagaaaaaaaataggatgcaggctatgcacaatctacacaaagtaattgccacaagattatatgccaaatgtggacgcctaagtaagaactacttgaagattgtcacaaatgggccatctaagagcaggaagctgcattggaaaagttaacacatcatacctgtattgcggaaccgggaatccttggtaatacccaagaggaagtgtccggtgctgaccataaccccctacataaacaccccttggaactggaacgccaaagtaggacccagctgatcttggcctccctgaaaagattgtgcatgtattcagaacaaatgcttacagaaatagaactattatcaccgcatgagcacttccaagaactgtttaaggtaccaaaatggtatattagtagtcatcgtatcaccattaggggtggcatactgtaatttgtagttttttgtttgcaaaacaaaacaagcacatgccaaacaccaacatcatcagtacttctgttcaaatgaatgctcagtatcattttagctcacctgtggtgttattttaagtcccaaacccacttgagaaggtatatagttgactgtacctatgttcacttgattatcaatttttcttctttccatagttgtcttattctaggaggacgagtgcgggtaactaaattctagagcaaacacaatgtagaaccgatcaaataagtttgcagaaggcaacacaatcataccacagataccactgcagtaacttgctagcaagcaaatcctcacggtggtatcaaaatgtgctcataatctactcgaataagttagtgcaaatcagtgtcaaggcagggagatcaataccgagaggaactgcaggctgagcgcggccaagcgacgccaggttacaattggcacgcctgccgtcgatcaccggcgtcgggtcctcgcatgccttcctcgccgactcaggatcgcggaacgtcacctgcacaaggtcaacatgacacttgtataagccaaccactgtttacagccagcaattccacgaacaaacaaacaaacacccggaaaaagcaggatcaacagcggcgaaaaatcgaagggcactgacgaagccgtagcccttggagcggccggagtggcggtcggtgatgacgacggcctcgaggatctccccgaagcggtcgtagaagcggcggagcctctcgctggtggtctcccacgcgagcccgcccacgaacaccttggtgtaggtggtgtccccgaacggcgacgccagcaggtgcagccccgagctggagctcgacgccgacgccgaccccgaccccgacccctgctgctgctgctgctgcgccatccggcgagctacgcagcgatcggctggaatcccttcgaggatcggtggtgcgggtgggctagcttcgctgtccccctctccgaccttgggattggagagggttcgcgagtgggagcgaatcggcggtgggattttggaagggggaaaaggtgggcgagtcggcggaggaggggaaaggggggattgtgactggggccgacggttgggttggcgcgccttcttctgctacgggaacccaagtcacgttcgtttgccagcgaagaagccagtgtgtgtgacagtgtaagagggagagagctgtttgggtttttcaaatggatcacgcggttgacagcgaaattgcgggcgcttcgaaatattagaaacgaatttggaatcgaagtgttcgtggatgatgagcaaatttgctacttgtcgtaagttttggtcgatataaggtaagttggattcggacatgtttgagtagattggcattgcgttgcatcacggtatgataatataattttaaaagttcgttgcatgtttttcgcgtttttatactgttcatatgatctcagttagcatgtaagcaattgattttatataaaacaagttgaagagctacatgcctcttctatttggattcaatggatgtgatgtgtcatttttctttaatttttggttcaaggatattctgatgaggttgtatttataattctaacaaaattaattacaaacatgtatattagagtatatataacatgtaacttactagctatttctttgacttaccaagtcatgagaaaggtgtttttaaggattaattaactatctctatgcgaaggagaaaacatctccatactaaagtggaattgagatgttgaagtggtgttatgctaagataaattactaccacattttccataaatatagggatttctaactatacacttagatgaatttttataatcgtggatagatatagtacattcaatatatctttatacatgatagtgtggttgctgcagtaaacatagcttttcctatagataaattatcttatccgtagaatgacatgaaaaaaagttagggctaaaaattactcattttatcttatccgtagcatatatagagtacgttccatacatccatcttgatacatgatagtatggctgctacagtaaatatggtagcttttcctataaatgaatcattttgtccgaagaatgacatgaaaaaacttagggctaaaagttactcatttgatcttatccgtagcatatcctattttactcactaagttgtcgcaccctttttacgaaaaaagagctaaaagtagaagttatatagaagacctaaagtatgcacttaacacttctaaaaacatctaatgtagtataatagtaacacacaacaattgtcgtgaaacatgtacttcttaattctttatctttattcataagagaaattcaaaattactttagaaagttttatgaccaccattatattgtgtgatcagtaaaagtcctgtgaacgtatgaaataatctcatacgaatttgatcaaaaaaattttagggaatagatcatatactgtactccacctgtctcaaaatatatgattcgtagatatataacttctcatactaaattaatttattttggacgaagtgaatatttgttttaactatgtgccttatgataaagattctgtgttcggcactcactgctgggaacatatatgttgcgcacgaaaaatagagcggtccattagcgcgtgattagttaagtattagttttttccttcaaaaatgaatcaatatgattttttaagcagcttttgtatagaaactttttgaaaaaaaataccatttaacagtttgaaaagcatatgcgcggaatatgagagagaggtgttgggaaccaaatgtaccgaactgggggtttggatggaaccatgtcacatcagatgttggacactaattagatgtattaaacgtagattattgacaaaatccattccataactctaaactaattagcgagacgaatctattaagcctaattaatccatgattagtctatgtgatgttacagtaaacatgtgataattatgaattaattaggctaaaaaatttgtcacgcgaattagctctcatttatataattagttttgtaagtagtatatgtttaataatctaaattagtgtcaaacatcggatccgatgtgacaggtactaagatttagtctctgaacccaaacataactgcctagtcaggatgtaaaatatttccaaggtgagcagtgactgagaccaaaatctcgcacaccattcccatgctcgagcgagttcatcacatcaaccacacatttcatcatagattaccgagtagagagtgcttctcgttcacacttttccaaacgatcgactgcataaaagagagaagaagaaaaaaaaacacatttctcgctgagctccatcgatgacggatgactcacactgctgacaaaagagcagatttgcaatttgcaaacagcatcggacgtggaaaacgcccgagcctctcctgtctcctcccggtcttctgcttggaagaaaagaaagaacccgccgcccatccgcgcgcgggccccgtgccgttccccctcccccgcccacgcctctgcttgcggcttgccgcttagatccccctgtcctgtcctgtcacgccgaacatctgaacgcccgaggcgagcgagagagacaatcccgcggtcacctcccctctctctcgctgcgccttccgtgtacaccaccatcacaccctcccgtccgtccgatccccccctccgatcgcgtaccgagcaaacacgcacacgcacagccgggaggggggaggcgaggtccgcgtcgttcgcgatcgccttgggttgggttgtgtctctctctctgtctccagtgatcctgggccaaggaggcggatggacgtgcgccggggcgggggcggagggcgcatcgtcggggcggcgcggagggcgctcacctggggggcgctgcccctcccgatgcggatcaccaacggcctggccatggtctccctcgtgctctcctcctgcgacctgctccgcctctgcagcgacagggagcggcccctcggcggccgggagttcgccaccgtcgtctacctcgtcaggggctgcagg

SEQ ID NO: 42068 - DNA, 11379 bp, Oryza sativa
gtttttattgaatctctttaaaaaattgtggccgtgtgtttcaaagttccaaataggtccaacagttagttcctaggtatgctgcatttagtatactttcctaatatcctcacttgtgctattttaccacacaagccacttctgtgatttccacaactttgttgtgcagatttttcatattcatatttttctttgatttttcgtatccagttattcagacactgtacatatcggcatattattctaccagtcaaagtcaaaggtgtctatacatcttatttgatttctgatcttttaaactgtacaatgttttatagttgttcttggcagctagaaccatctacccaataccgacgcaactctatgggttgcatatatgggcaagtgtcatggttccatggatacctttttgcatagtgtattctccagggacttttccggagctaagtgtgagtttgccattgacattgttctttcaacctctgcatttcggattgcatatgtttcagtcttagtttttgatgtggcaaatgtcacacaatatggttgctatacagtgttgatttggtactattgtttgaagatccattatactgtgagaatcaatctgtttgtacaacttatctgattgttatcctcctctgtgccctatataagttctaatttagtaaatttcatgcatactttattgttggctgtgtacactcttgtggagtgtagaggccggaatgatatccattatctaaaaaatgtatactttattgtggaaattttcatttgagacaatcacgcagcttgcttatctaaggccccatttaatctccacatttggagataaattttggttgcacgtaaaacgagaaagctcattagcacataattaattaagtattaactattataaatttgaaaaatggatttattttcttttttaaaacaacttctatatagaaactttttttaaaaaaatgtatcatttaacaatttgaaaagcgtgctaacggaaaacaaggaagttgaagaatagaacagggcctaagtcgttcttacatcatcctttttttttcttttttgctctattgtttcgcttccttagtagaaccaataactccatatagaggtcatcttctattagaattgacataaaaactgttttaatcggtgtaggtccagcagatttggtaggcttcaagacattcgttgtgcactcgctgggaggaacctatatatgagatttagctgtatcactggagatgctatgggaatgaacatggtgtcaaaaggtgttgagaatgtcttgggctatctgcagaatgtcttccctgacatggatgtcatcagcgtatctggttttaactcttccccttgaactttgcatgcttcagttagttttgctttcctctctaagtcaatgcctccttttagcagaaaacgaataaaaaatcacattctttaacttctgtttggaaatgttgcgaaggaaatgatgaaaaacatatttcatcagcacccaaaatatttcctctcctattgctttgtaacttaaagaaacatgtccctaattagatttttccgatctagagaggaaacccttggcttcatttacagaaagcagatatcggttcttagaagattcagcaggttataagatggatttttttcatccctaagaagtatttttggatgcctttttatttattttctgctcattgtgcactagcctagttcaattgtaaaatatattctgattaccgaataacagtgaatgtactacttttcatcagactcgcatcaaacatggtctaatattctctgataatatatttgcgtgtatcaattaggcatttgtgccgggggtgctttttttgaaacaatgggtgttcacactatctgttttcatcaattcaccatgtattttcttgtctttgcatgcacattgatgaattaatctgtgtgcatcaggtaactattgctcagacaagaagccgacagctgtaaactggatagaaggccgggggaaatctgttgtttgtgaggctattattaaaggagatgttgtgcagaaagttcttaagacgactgtagaaaaacttgttgagcttaacattatcaaaaatcttgctggatcagctgtagctggggctcttgggggttttaatgcccatgcgagtaatattgttactgcattattcattgctacaggacaggatcctgcacaaaatgttgaaagctcacaatgcatcaccatgttggaagaagtaaatgatggagatgatcttcatatctctgtcaccatgccgtccattgaggtgattatttattcgttttactttccgttcctacctgcattatgtagattatagcataacctgctagccttaaatggagctgcaaaatctatagcatagagatcttcttgtattaactgaagtaatattttgttttagcatgcagtttgatcgtgagagcaatatccgcatcgatttttatttatttaatttcttcatgttagtaaaatggttcattttttctctcaggtaggtacaatcggaggtggtacatgtctggcctcacaggcggcttgtttgaacctgcttggtgtcaagggttcaaatcatggctcacctggtgcaaatgctaaacgtttggctaccatagtagctggcagcgtgctcgctggcgagctctcgctccttgccgctcttgcctctggtcaccttgtcaagagccacatgatgtacaatcgatcaagtaaggatgtcgccaaggctgcttcttgagcagcccttcgcatcattcaaatgctggacatatttagacagggattgccctgagcttgtggagaagcgaatgagcaatgggcttgtacatactgctgataagagagcgattctttagttccaaactcaacctgtattatactagcataatgtgtgaggaggcattaacctatagtgcagcttctgactgtaattttacccttcagttttttttttcattcttctgtaaccaatcaaacttatttttccattttttctggatagcagcaggtcaggttaacttatgcttttgtgcagtatagcagctcagtaatttttgtttacagcatagagaacctgactgtgtatgttcattttactgttcgttctgccttttgttccctccatgtccctcagttctgaattttgtagcctgtattgcatcttgcctgactgcctgttgcctgtgaccgagtgttgatagtgtggatcaaatcagaacgccttctctttttattttttcgcaatggtgtgcctgttgctgtcaggtacttgctttgatttataaggtaagtcgaatatactggtccggttcgttccataagcacacagatttcaaaagccaaatgtgctgtgattccttgagctcacagatttcggtgcgaaaattctcgtgttcaatcacgcctgctttctattgttgttgctgaagaatatcctcgccgcgctatgctggttcctacgccgcactagaaccacttgaaatcttgaatgattctccttatctttaaccaaaatcctactcctagtagctaaataaatcctacctcgaatctacaagtgcacatataataacttctgttcttgtgtagtcgctttcaatacacaagtagaaaaggcagattggatcaaaatcccggaaatttccacgctgttgaagagaaaacgaacagtcttcgggccagatttgtagcccaaaacagcccataaagcaccccaacaattctcccgtcttctctccggcccaagagaccgaaatgaacagactttgggccagatttgtagcccaaaacagcccataaagcacccagtcaattctccttcacctcctcctcctccagtcctccaccgtccagcactatctcctgcaactgctagtgcaagatcaaccagccctcgcacggcacaaaaatacacaatccttgcgaaaagtttgctccaccaccagtacaccacacccccaatgcgcgatcacgtccgcgtgaggcacggacgccgccacaatcccgcacgcgacgacatcggagcgttccgcgccaaggcgatcgagaccgcgatcagcagctgacgcgacggcacgggtgggtggacggatgatggtggcctccggcctcgggctcgcgcgcgcgcggccacagtggccaacgccgctccgggacgcggcatccgccggcatcgtcacgtggccgcgcggcccacggccacggccggcccgtatcaaaaattcgatgtgacatatctcggccccccgtcccctccacccaattcgcctcgccaccgcgcggggccgtcgcccacgtgtggcgcgtgacccattccccgcggcgttacgtgcgctctctctctctctcttcctcctgcagtagcctgtgcggtgcagccaacagtagacgaatccccctgaaaaagaaaaaaactgtaggcgaatcccagggtcgacacctgtcccatatccttggcgtgacacttcacgcatggctttttctgatgccatttcatcattagttagggttcccaaggtttacttatgaataaagattagtaagtactagtactactcctgaacaaacaattatttatgtagtagaattgaatcatcgagccagctttatatatagagagaattaatactgtaagctttgggagccaggcaaattatacgaaatgacaggagacacaaaagaggcacaaatgagtacgtgcttacaaattaatgtgacaattgagaggttgcctgtctctaacccagattaggtcaccgcagattacgacctccccgcgggtggcaactgggcgcatatctcatatcatttcaagtctcttcccgaccgataaagtaatcaactggctgcttaataaggtcattaacaatcaagtgctaaagtcagacggcttcaacgaaaagattagcattatcatcatcaggttaaccatggcgccatgcacggacaagcgagctaccgatcgatcgagagacgcttggcgccgcaacgcgacaggcgagggagctagcacatgcccggcgatgagacagcgcgccgctcggattatcttaatcctgcccccctaatctaatctaatcactcctccccacttgcatccacgcagctttaatcagcctttcgcccaggcactaattcttaattagccggccggccatcggatgctgcctagctagcttagcttatctcttggccatgattggttaaggtgcagaaaatatttaatcatatcatggttctcttgctcccctgtccagtcgcgagctaattagcttaattagcttgactgcagctagctactaagctgatgtacattttttgctgtgctcaaattcgatcggattctgtggttaattaatcaaaactaaagcctagaaatttgcgtggctgggagttaattagtgttaacttattctgatgcactgtccttttcaacgcagtgagttattcccgaaatagatcgtgtgtgttcttttccggcggtagtgtatttttgcatatatatggatcgtacgatctgcagtttcagcatgcatgcacgcgctgatctgcgcgtacggaagggaatcggacgtggaagaaaaagatgaaacaaagctatgagtttcgccttttcacagatttgtatattgcttaagtacttttctggctaataagcgacatcatgacaggctttttgattctgtacgtacagattgattaattaacttggtgcctgcggctagctaggcatatagctgtagttgcttaattggctgctgcctgctttaaccattgtgcgccaaaacaggctgtaaagaatggttttctctaagattaattctggtcgtatagcaatactcctaagcaatgactttagttcatatcttcgtatatcgtacttcctccgtttcatattataagactttctagcattatctatatctagattcattaacatatatatgaacgtgggcaatgctagaaagtcttataatataaaatggatggagtagattcaaattcagttgtactatgctctagtagggtgtgcagactttgactatttagaggcaggcatagtgttatctggtactggagtaagatggctaaattagctatagttatttgagttcaatgaacacataggaaaaactgcacgctctccgaaataagaaaatagctaaataacaagtcatggtataaaagttaatataataattgaataaataaatcagtactccctccgtttcaggttataagatgttttgacttttaacaaagtcaaactgcttcaaatttgaccaagtttgtaaaaaataataataatattttcaattcaacacaaatttattatgaaaatatattcaattattgaattaatgaaactaattaggtattataaatattattatatttatgtataaacttaactaaatttgaagtagtttgactttataaccatgtcttataaccatggaagtggagggagtagtacaaaagttgatatatgaattaaatagtataaaaattaatagatatggaataaaatacggtctcgatatcacaaagctaccttatattctgcgacaaggcaaaagtaagattcatgcatgtattgcctctgaggatcttattgattaattagttattatttcttgtgcttttaaattagtagtaatatactccctcagtgctcagaatataagggcattcccaacccaatgactaggatggtgtctatagcattaaataaactgtcacctatgatgaaaaatgatgtgacaagtgaataaatgaggaaagagaaggaaaccatgtcttgcatgagacatagtttctacacaacatccaagacatcatgtgagataagtagcattaaatttaagtatagaatagtggtgtttgcattggaagagtagtgtctagtactccctccattccaaaatataaggcacaaccacccttaacccaaagaccaagaagtaattattatcatcttgtagtttggatcatcctcgtaaatataatgcatgcattcaataggattagataatatgagagtggaggatttaaaaaagttataatttaatgaagaagatgccatagttaattgcatatttgcatgcatgccttatattatggaacatgtaagaaaagtggttgtgccttatattatggaatggagggagtactagtttcttgatgatgtggagtttatggaaaccatatctagtgtcttaggttgggaatggcctaaaggaagtcgttttggacagcgatacggtctccaaaacacaactttgacttcttgtttctataaaaatattttattgaaaagtgatatacgtataccttcataaagtatttttcaagacaaatctattcatataatttttatatttttaaactcaacaacttaaaagttattcatgatttatattcttagggtttgatttaaacattgttctaaacgactttttttacgagtacgaatggagtaatttacagcaatcgaaacattgaatatagtcctatcttgcctgctggcggtgatattgcgtgtgcgctccatcatatggttaattacattattattcgatacattgatctttgcgaattttagaggcacgtacgccgtacaaattaacatcagtactggatctctgagctatatatccctctatgtccaacttgcggctgtatgggtgtgtttggttgcaagccacactttgccacagtttgccacgcctaagagcatcaccaacagccacccaaaattcaatcccctaaatcattttttttagatctctaaaaaggatttaaggtatgagaataccttttatctccaagagattcccaaaatttaatcctcaaaacaaaaaaagtaggccacatcgacaactaccaacagaatcgtcattcctctcctccactcacgctcgcacacgctgcaatgctgcatcctcctcacggctcctttcaggacattcagtgatcaatctctttgacatcataactgacagtttaagcattgaacaatgtttccattggcttcaggtacgatctgagtatttgccccaaaatgatatttcacttgattattaccacgatctcctgtattttacatggaaaaatattggttctgcaatcatcaacaatggggttttcagcccagaaaaaaaatttcagcttttttagtgtgaacggtgttaacaacttgaagttttcagcagcaagcagcaagatatttcagcagctgcaatagtacttttcagtactagcaagcagcagtttttagcagcaaagaacaacagttttcatcagccagcaaacaacaaatttccagtaccaccaccaagcagttctcagcaatagcaagctccagatttgagcagcagcaacaatcagaaatcgactccgaccgaggtgcacgatgattcgatgaaggccagagactgggcacctccggttgtcgccggctgctggtcgcatcgcatggggcctttgtcgcctgcacattaccggggggagcgcagcgccagtctgacgcgagagacaggctgtgctgcaggatgcggtagggtcgagggacgattggagatgaataggggcgacggccgattcgagtcggtggtggtgctgggggagcgccgacgaaggtccgcccaattgggttggagatgggtctggcgctgccgctgagaaaaaaatgtcgacgctggggaagcttgggggagccatggctgctttcccagacagctgcggggaagatgaggctgctggcgtgatggattgactcacaggtagacgaacgcacaaagaagaacctggtaggaaaattttcacacagcgcgcgcgaagtgcatgcggttgaaggattgggcgccgagtctcttccctacaagtggagaacgaaatatgcgggtttggaaacgccaagcttttaggggtgatttaggtctactgttggagcgattttttccaacaaaactcctcaaaactgatattgggaagagtatcgggaaactgttggccatgctctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttagacaaagtgtggcaacttttgttggcaagtaatggtaaagtgtggctgggaaccaaacagcccctatatctataccggccggctgggcacttgggcagtagtactgctggactactggcattagtgcattaattagagccgtcagacaaattaacttagatctacgcgcacatcaacttactttctttgttaaaaaataaatacatcctgactacgaatctgaacctagcctatatccaaattcgtaatcagaagttgatgattttttcttggacggatggctatgtgcataaattaatgttgaactcgacttaattttccaccaaattattggtgaactagttaattactactcccccgtcccataatataagagattttgagtttttgtttgtattgtttgaatttgtgtaaatataaaaaataaaaagttgtgcttaaagtactttggataataaagtaagtaaaaaaataaataataattttaaaaatttttaaataagacgagtggtcaaacagtgcaattaaaaactttaaatcctttatattatgggacggagggagtaagtaccagcaagctactcgcgggccatgatagtaataatagttttgttggatcttaattatcattgagtttgctgtagatgtttaactattggcagttgaatacctgaacctaattagctgcaggactattcgcctgtacaagctggatatccggaggcaaatgcgtcaaactaaacaaagcagcggagctagtcgcagcgcaccaatcgtcaactctgaaagtctgaagtcgtcatgagttttattatccataacatgcaggcatggatcgattaccttagcactgtcttatatatgcatgcctggtagagtatagtattactacttgatttttcaaacctaccagaagaacatgcaacatgtatctataactgaatttgtttctcgctctctttctgcattcaaaacacaattttctttgcaaccagaaagcagaaaaccttacacgcatataatccgtactacaggtgagcacagattcccttttctttagttgagttgccgctcattgtttatgtccctgtacgtacttgacttaataaacgacgaaataattaaaggcagagctagcatgctcttgcatgcacagccaccaacagtgagaagaattaggtcatggcagtgggcatggcatggcatgtaaggcagtttttgtcgccatccacgcaaggcgtcacatcaaaatatagcttccaagtgtagctaagccgagttggcccggccatctagctcgcctgcccaattttataacccccctagataacttaatcataagctcgaacacataaacaatggtgtttagttgaggaagccaacaccagcactctttggataatgaactcttaatcaagtgcacaactgctcaattattttacaggccagtggagagatcgttccaacgcttttgtccaccctatgtacaattctatatctgcaaaaatacaagcgagagccaataaacccctgccatgtactgtatcgtttgttctggtgtctttgatatgctataaaacttaacgtaccttggaattggattggaagcatgattctcgtagcttcgattcaatactagcactagctagtaaataaatatgccaccaggaagagcaaactacccccccccccctcccctatatgtatgcgcatgaggtcactcatgggtgcattcatggacgatgtttgtcgctttaatttagaggcagagctatagctatatagacaacaaatcaacaatcactattcgctactgcaggataatgttttgatttgatcttgtcacccacccaaattaatactgcacagtaactaaactatggaggagagtaccagcctagctaatcaattaaacgatatccaacaacacaatgcttcaatcgcatgcatgttgccgatctatcagagaggcgctcgatcggcggcctcgcatgcgtaagtgcagtgtggcagcagcagcacgtactgcttgcgaatggatcacactgtgcgtgcgtgcagagtatgctgcaggcagagatcaataaaagagcgtgctagctagctagcgcgcatgcacgggaaagaccgagaaatcaaaggcgctggccgggcgg

SEQ ID NO: 42069 - DNA, 9903 bp, Oryza sativa
ctagcttgatacagggggcgtcacagctaggtatacagagctcacatttgcgttatcttgctgcagacttgcaggaggaatgggagaggaagatgcagtgataaatagcagttacaatagcaggctattagccagttgtaaacatattttaatgagataaaagatgagagagaagagcagcgggctacagatctatagccagctacagcacgtacttcaagatacaatgtgtgtatgacatgtgggaccatatattaatagtatagtaagcaactattgtataaattgactattagattggctatatataaattgaagctaatagtgggctatactattaaacttgctctaaaacggccgtttgattcaggcgaggccggccgatgccagtgccaccgatgaatttggggatcgcgagagattgatgaggagggcgagatgggcttaactgtggcccgcgtgggcgtggccgcgagggcgatcatatcatatcatcgcggtggctgatcgatctctcgctagctagctgctcgtgctagtagatggtgaccgagacgcgcctgcccgccaccaccacgtgtctgacagctgtacggacggtgtagccgcccatcacccccacattgcgttctcgtttattttgaccggacgagagggtccccctagcttatccttgaccgcacgtgacggtgatctagctagctcttgcagctacgaggctcgatatcggtccaacggagtcctgccagatcggtgcagtagtactttttcttcgcgtgcgtactacggagaaaatcaaatgtacatatataatcatttcatcctaaaataaacaaatctaaaatacaatgcgatgtagtagtactatttgaagtataaatctgtttgtttcggctgatttgggatgaatcggaatggcgatgcatggctttaattttaccacaataccaccgtgtatatagatggatggattcatcttcatatatactagtactgtggagtatcatatgaccgagttaatttatgtgctccgatccagtaaccaattggttatttaatttaggatctaattgatgctagaagtgctgacatgcacgcgtgacatggcactgtgcacagcgctttctttaatttcatggtgccaggtctgcaccaattaactacatgcagctatatactatctccgtcccaaaataaatgcagccgtagaaatccgtgtccaacgtttaaccgtccgttttatttgaaaagtttataaaaaaattttaaaaaatagttacacataaagtactattcatgttttattatctaataacaataaaaatattaatcataaaaatatttcaaataagatgaacagtcaaatgttgaacatgaatagtgtaaaactgcatttaatttagacggagagagtaactcattcttaaaaaaaactgtgaaaaagaataatacaactgctagaggtatccatttgttgacatgatatgttatggtaccgatcactttcaagaagatggttaattaattacgtctgcaccgatggctgttttaatttagggcaaagtggcaaaactgatctataattgatgctacagctattgtaactagcagccgagaagttctgacatgcatgcacgcgtgacatggcactgtgcaccgtgcagaaatgctttttaaaaataaaaaataaatcatgatgcatgctaggccaggtatatgtaccaggtgcatataagagcaagtttaatagtataaccaactactagctctaaatcatctatagccaatataatagccaatttatacaatagttgtttactatagtattaatacctggttctatctatcatacacacattacgtcttgaagtccgtgctgcatctggctacagatttgtagcccgctacttttctctctcttcatttatctctttaaaatatgtttatagctagcttataacctgctattgtacctgctctaatgcaatcaatagttagctggtcaacagttaaacgatctcaagatatcatgatctcttgtcttttaagaattactccgaacaaaagagattcaacttaagagtgtccagcgcgtgtttgtggtacctgcgtttagagtcaaaatttagaaattactagtaacatgcttactccagtatgttactatacggccgctgtcaaaaaaagatggttaattaattggtgtatcaaagtcaacatgtgtactggcccatgcacgtaaaaaacggggaaaaaactggccgaccgaaagacgtactcgcctttggatttcaacctgttttgttgcgtgctagctcctcccttttttatatgctcgtgtagctttcattgacatatacaccattcatgtctccactctgctaatctgtggcgacgatcattaagtcactgttcgtgattgcgcggcactaaactaataccgctgcgtctcgagatccagccaatcaggccgtggtcattcaaatttgtttgctctctctcatgcgtcacatgacaatgacccgtaatccgctattaaaaattaattgaacacttgagagcatacgcaaagcgacaaggttatcttggcttctccacgccgagaaaagcctggtcacaaattgcaaaactcaagttttcgcccagctcgtttgattaatttccagttcctgaatgggacctctcaccaaaccggacctatccatgcatgccacatgccagtatttgggcgcagccgataatacctcgagtcgtccttgattagttgagaaaccacttcatttctaaagttatccaatcttggaattgtgaacagctgcttgtacccatgttgaaatatttccaaacgtaagccgatttcttatcctaaacaggctctagtacatgcagtttggtttaacggaacatatcaaggctagctctagaagcttgcgatacacagcgcatgtatataatcgttggacaattacgtacgtacagtgctccaaatgggggccaaaacggctgcgttctttccacaagtttcccaacccctttccatcgttttccgcgtgcacgcttttcaaactgttaaatggtgtgtttttttgcaaaaagtttctatacgaaagttactttaaaaaaacaaattaatccatttttaaaaaaaattaactaatacttaattaatcacacgctaatggaccgctccgttttccgtgcggtggagttgggttcccaaccccaagtatcaaacacagcctatactagtactaaacgaacccaatactcttggatatgatcgaatgaaaaagccttcatgcgaaacctagctactcctattttatacgcgtcctagctgcaaccccatactatatagtataattaaactacatatatataaaccgggcagattttttttaatataaaaaagcttcacaaatcaggaccggttcgtaggttttcaagtagtagcaggaaggaagcgtacgttgcatacatacttcctccgtcataaaaaaaaaaaagacaaactctagtttacgtgtccatcgtttgatcgtccgtcttatttaaaaaaattataaaaaaaattagaaagacaagtcacgtataaaatattaattatgttttatcatctaacaacaataaaaatacgaattataaaaaaaattatataagacggccagttaaagttggacacggagaccaggttttgtctttttttattttttttttgacggagggagtatgcaggtcccgtgtagtattatcttatgcggattgcttgtacttgcccgggtgtatataaaaatcaccggtacagtaaaaagcgacgacccaattgtttaacacgccttgtaggtccaattatttgcttgcttgtctgcctactgtccagtgactgaccgagccctgcacaccctacgtgacagcaccactaccctcgacttggcaccgatcgatcggtgcatgcacatgcaccgcgctgccgctaccgcgcacgcatttgggcggccgcctgcgcgcgagagcaacggcgcgcccgcgaatttcacgacgacccgcgtcgaccacgacgtcgtgggcgaacgcgtcgcgtgcagctgcagtgcgggcgcgtcccgtgggcgcgcgcgggggagggagacgtactccacgttttttatgttcaacgaacgcgacaaacgagtccacggcgcggcgggcgcctcgttcgctcgctttggcgtacgtggcctctgctacttcgggttgcccccacacgcgcgcgcgcgcggtggcctggcctgggcggggcaggccggcctttccgttccccgagcgagcgagctgctagtaaaaaccggggagttggtgtgggtgggattggcattgtatcgtgagagagattgatagagagagaggcggacctccctgaccttatcggcagcgccatcccatcccttgccgtccccccaagagctcacccctccgcctcgcttcttcatctcctctcctttaattcggccccgcgccgcccgcttcacccccatcctacaccgcgtgcctccttaccttctctttgttggaataacgatcgtttcgcttgctgctccggggaggtttttcttgggcgatcgatcggctgggcaggttcgtcggagggaggtttctgccgcgcgccgccggggtgtcgacgtgtcgagcggtgcgtggaggaggagaagcgtgcggcggaggtaaggaaaacatgctagctacagcgatcgatcgttttgagagcttcatcattgctgggtagcttagctatgctagctagagctagctgctagatgtgtggacaagtcaaaggccaaagctttgctgttgatgaaaagatctcccatttcgctttggttgctttgctttgcttcgctgtttgggtttgggctgcactactgtgccatgcaaattacttcgagattctttacaaggggcttaatctcgctttgtcttggcaggttgtggtggtgatggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcagaagccatagcaatccaatgcagatatgcaagctaagctaatggtacaaaattgcgacatgcatgttggattgttgattggacgatcgacaggcctttgtactgggtgcaacatacgtatgcatctatcatgcatgcgttgcaaattaagatttcaattcatattcatgaggaggtttatcatatacacatattttaacatctgtgggggcaagaagctagaggagagttgcaagagcaagctcggaataaaccaaaggtcagtgagattatccaatgttttgtgtttaattctaccaagtgtttttttttcatttttttctcttttgcattctgtaatatggtactatcctattctagtttgtatcttttgatcggtagaaccatgtttctgaaaaactcttgttcccttttttcaacctctgaaacatgtgcaacaccagaactgtcttatggtcactttcactggtctgaattcaagctcacgatttggtggcgttgaatattattttttatttttattttttgttttggaaccagatggtgatattgaatggttctcgacctggtcaaaatttcgaaccctagctaagctaggtcgatctgaagcatgcattttgaacaccattttttttgcaagaaagtaggagtagtagtatactcctagcttaaagtttgctctcaacaaattcaggatagtatacgatcaagtactgtactatcctgtgcttaattttggcgttcttgtactgctactcctactatactgtactgtacttagttttggcattcagtatataggtccagaaggaaccagccaccaggaggcaggagccttctgccctccctctttttgtttcacctgcagcttttataatggcctctgaatctctgacatcttcagtcagtttttggcgtttcattgcttggaattatatgtgtgattgaatactgtagtatatatagcaatacttaagactgtgtctaggtgaggttccgtttaaccaacaggcaaagctgtagcaaggcagtggcagtgaggttccgtttaaccagcagggcagagctgcaaaatctggaaagctgctggccatgagatgccaagcccaaaattgacactagctgcaagattctcaccatctgctatggtacttgtactatcatgcatcttgcattctcgaagtacaaatctggaaatagggtctcggtcccttaatgggaaataaagaggagagggacgtttcacactttcgcataatttgtggggggagagagaaggcccagagctttggaacttgctcatagctttgcaacctttgtcctctcggagtcctggagatcagatgccagagcatccccacaccaatatctggtggtcaagcctctccaaatccgggatactaagctagtgccatactgtcatagtatctctcccccctttatttggagcatcatcatgtccatttgttcagtacactttagttttcagatgtcgatgtgttcagccacctttccaaagcaactgtttagattatgaagtatattttctgaattaaattagctggagtaatccaaaccagcacaagtgttaattaagtttttgcacccatgcatgcatagcactagcttgttggcattatatatctttcaatgttactagctagctagtactatatgcgagttatagtagacatgatttggtctctaattggatatattattaatgaaatgcaagttgcgaaaggaaaacttaagacgaggtctaaccgtctaatagtactagctaagtgctaataacagtgcatatatattagggtaaattgtattagcatgcaccttgtctctagttgggtgctgccatctacaagactacaactaaatcttgtggaattccattgagtggcattggatgttgtgtcatctacaactaaatcttgcagcaagcgagcaaactgtatttgctattgtctagaggcctagtattcagattaaacataaaatatcgatgcagaacatgcaaaaacaggattaaaatatgcagtcggcaatagttcaacctacattcatcttatgaatgataactgtaccttgcaactttgccttaaacagaatatttttgtgatgaatgaaatacttaacttggtggttaaaaaaccactatatattattgtttgttcaccataatgccggccgtttatttgcttggtaatgggtggtagtgataatcatgtggattaatttttaattttcatggctttaatcagcttatgttttaaagagatgatcatactaaataatgtactgtttcacctgatttgatcccgttaatttatatagagttttgttaacatttctatgttatttgttcccggtacattgacaataatgtaagactaagatcttgctcgattttctacctgatgatgcacctcttatgacttctttcgtcaagaaggcctttgtcaaatcacattggagtcaagcatcagattgccaagttttcctaatttggtctatatatacatgttgttctctatattatggtacattaaatttgaaagaaactaaaggaacttagtagcaagggcagatccagaataagactataggggggacttatcttctaagaactagcttgggatttcatggttgctgaagctagtctcttttcttttactagaaaaaatgcccatgcgttgcaatgggtaaaaatattttttatcgcctatacattatactccttatttggttttggaccgaaagcccattattttcttccttttcagccctatcgtcttcaacctccggaagtgcatgtacgataccggagccgatcctcccatcaaattcggtcgaatctttcacgatgggttagttgagggtttttatccactcgatctcctcttttcctttttaaaaaatggagcaatccacaaaactcagaataaaaatagtgattgagattaaatccggtgaattaaagacgaattttaaggagaaatcaaggggaaaatgatgagggagttgtggggaatcaatttttgcaatcaattagaggaggaaacgcatagagggatagatcaacgtggcggctgagctagggttcagcccgacgacagaagaaaacctagttgataaaaaaacgaatccttaccgcatgcgaaaaaacgtaatgtaaaaaaattgggatgaaaaaaaagcgtgccaaaaagaccgcgatgtaaaaaaaagtggatgaaaaaaaccctgaaaaaatggcaaaaaaacatgtgaagagaaaactgcgatgaaaaaagtagatgaaaaaaaagcggggggatcggcgaaataatacggatggaaaaataccgagaagccttatgtatctttttattagccttatgtatattttattatgtatttttttattaggtatatagagatatatatttgttagcatcatgcggttctaatacatgcacagataaaccaatacaatttttctttatctttatatgcgatgacaagatgagtggagttggatggataaatttgttatggaggaggcataataggaataggggaggaaataaattgaaggtgaagtagatcttagcgtgacactcggtgcaacctagcttccagctaagttagctagctcccaactgtaacatggacattgttttttttaaaaaaaatcatttcctagaaaactaacaaaacaagaaattttgtgcactcactgggtaatggataatgtgagccagatgactctggtagagaaaccatctttg

SEQ ID NO: 42070 - DNA, 6470 bp, Oryza sativa
aattcctgcagcccatctctgatgtatttcttttcaatctgtgatgcatttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactggaagaggaaagtaggaacttaccgcgtgtactgctgcccgcccagatgatcaggcgtacgctgcgggcgcaggtacggaaactccctcccccagaacgtacgccgggccttccgccgtgcagcttgccgctaccgcgacgagatgcgtcgcacactcgcacgcgcccgccgcgccgggatgcctggtatagttgtacggtgggcggccgccggccggcgctgcgcaatcacgcagaaatccggtcggttagattttgtagggggcaccggccggtgtccggtggccaagggctaaagccagtagaggccgcgatatgatctgggctgagcgtacccagcctgcgagccctgtaacataggctggctgggccgcacaggtagttgggccgtgaaggtgaagagaagatgtccatgcagaggcctctgatagccccgcaagcaggtgtacactgttacatacatgtctagactctagagatggcaacagggtgctatgacccgacacctgactggtttttactctattagaagctaattatctattatatgctaattatgttttaactcttatacccatgagtttaccgacgggcgaaaattcttacctattaggtacatgggtatgggtctattctttatctactcgtacctaccaacccgagggtgaaaaaacctgtagattaagcctaaatccatgagtaacataaaacttctttcttatcttaagttctattctagttatatgaaattattatttgatttcttgattatgtaatatggttgtagattttttttactcgactttgagcgctaatgttaatagcattgttgccagaagaattattgatgggttacggttcaaaaatagctaattatagaacaaaactataaatggtatgagtcaattatatgggtatgggtacccgttacctgcacgggagtgggtacagggatgatatcgaaagcaatactgttttgagatccaatgtgatccgattttgtataattaagaatgtgttatatcttgtattccggctcaggaatggttttgaaacttgacaataaaatgaaggagctcaaatgaacattttcctaggctggctaggctgcataggtcgtttggttcgtgaaatgtccacagggtttctcaggcgcaaacatgtcctggtgttttctctcaaaaaaaagcgcgcgtgcatgcacagggggagagagacagagccatccattaagattgtactaaatctactaactaataacaacgtagtaaagcatctgtaaactaggcaaggcactactagatggaactaccaattttgtttagattttggagtcggaactcctatccgatcgagtacgtgtatgtttcggcaaaatttttttttacctaatccctttcctgttcggtcagcccggatgtaaaagatacagtacagtgcctgcttttctctgcagcagttttgcacagagggtccaattttgagtggcatcttatattcttatacgtgcggcctgcctccggttcgtcgggtctagatatggtaacggggaattccccatcggaggttactccaccatacccgcctccgcggtggagaattttccccatcaccatcaccgtgaaatgcaacggggcaacatctttccccatcaccgcctccgtgcgggtaatttatccccgtggagcctccatccccgctatcaacttactcaacagtcaacatgtatgcatttctcatatcaaacaataatttagatacaaaagattaacactcaaaataacaattctagccatcaatttcagcacatcaacaacaactacaagaacacaagttcacaaattcgcaaatgcacatcatcagttcacaaatgcacatcatcaattcatcacttacaacaacagtgcagcaacaagcagtgcaacaaaagtgtgcccaagaatacaatatccatcatattcccagattaagcaacaacacaataatacatgatcattcatcattcatcagtcatcactcattagttatcaccacattgcagcagcaacacatgttgtccaggcatacacaaaaccatagtcggagtaggtcttttgtgccaaatatccaaaagcattgccatggtttacaagtttatcatgacacataacaggggttacaaacatccaaaatcattgcgagaacagtgcatgtccatacattcatggcttcaaacaagagcaagtccctaaattaaagaagtagcaaaagatattcaattagtcaagtactagaaaaaaaatgcccgtgcgttgcaacgggtaaaaatattttaaaattgatatacattatccagcttgctcggtttttttagttgaatactccttggttttaggctgaaagtcccattcatttcttttcaaccctcagccttgttcgctagctccatccgctcggcttgcctctttggcacggccagtgttggacacaggatgttgcggatgaaaaaatttaggtaaggacggacgaatccttacatacttttttattattaggtacatattaacaccataaaaagtgaccgtgggtcctttgcatgtgcagcaaccttttgtttctttcatggaaagaaagggcattaattttgtatacttgaatatgtattacatcctatatatcggtaagcatatatttatatatatttttgtgtatataatatgattatctttacttttcgaattaaaaaatggttcattataagatttcagaatcaataatttcgaattaaaaaatggttcattataagatttcagaagcaatctgttgaagaaagaggtgcaatactttttatttttcagcaatgggatgtgcatggtaatatgatttgacacgagggaaggaaagtagacttattctaggatgggcccatagacatagtgccagcaataataggtgaaaaaatgcgggagatttgacacgagggagggaaagtagacttattctaggaggggcccattagcccataggcatagtgctagcaataataggtgaaaaaatgcgggagaggaaggtgggaatcgaaccctggtcgccgggatgaaaactttcgatgttaaccatgtaggcagattactatatgtgctacgagattacatggaacttacatatagtatataaacctcggttttggagtagattgaaaactgtccgatccgtctattaatcagattaaaacggatttagctacacgtgtgggacagacgaaaaaaacgcccagaatccttacatattttttaattaggtatatagattttataaggatataacaaataatggcggtaggagtttgattgctaattttaagttgttgaaagaatagctcaatccgatcttggatatcttgaaggcaactccaaaagcttgctgcttcttcgttatcagctacaagataacaattataagaattattttgcatccattgcattgtaaaatctatgctaagcatgatgtatgaataaaacagcatatgtacctcgatacttgttttgcagccaatcttgtgagcacattaaggcctccaagagttctgaagtaagccggctacgatgctcactaagaacccttccacttgtgctaaatgcagattcagatgcaacagtgctaacaggaatagcaaatatatctcgtgctaccttcctcaatgtaggaaagcttgtcccaaccactttccaccaatcaagaatcttaaagttttctgtattaattgaaaccaactcatcctctaggtacctgtctagctctgatttaacgcgtattgctgctggtgtcctactagtaacacgtgctgtgattgaagacaataaatcagaattgacaagtggaggagctgaagattccgtgttatcctcatcatcttccacttcatactccatcaaatcatatagagtgtctttcacctcagcaactttcgttgcacactcttcacttgactgaccagtgatggtttcaatgaacccaaggagatagtcaatcttaaacctaggatcaagaatggtggccaaccccattggcccttgaatatctttccagtacttatcaaacttttgaatcatttcaactgacatttcctctatagtagaatcaccacaaacagcccacttcctaatttgctctttagcctacagattttaagtagttgaatattggaagtcacataatttgtgccagaaaatactgcagtgatgtcattaaacaacttgagcctatcaactacctcactagcaaaagcccattcttcttcactaggagcacaaatcttcgaaagccaatatggtcaacaatagataaaggatactcatgtaatattgaacctcaatgaagattgtgcaagtgtctttggccccatcttgatctttctcaatgtgcaaattttcaaatggtcatgtagatgtgaagtcccattgctgctcttccctccaagccgcttgtggcaatgaaggcattcagtcttgacatcaccacagactttgactttcttgaaatccttccaaacaacagaagtaagcttcctctttgtgccaaaattctcagaatcatcttctggctcatcatcttcaacttgtattggctcagaatcattaacagactctgcttgtggtggaagtgattgtgattcttgctggctgctactcccacaaccagtaccagcagttgaattcgtggtaaatctgacaattgacaaataaatatagatcaatatatctttcagcctatagaataatcttggaaaacttgaaatgaagaatctctacacataaagcatactgaaatctgctacagcctatagaataataaaatttttatgagctacactacacagattcagattcctttaatttcaaaaacttaagttcataacatatttataacttaacaacattcaatgtacaaccatacaatatacatgtaaagatatctaattttctacagatactctaaatacaacattcaatatctaagaaaatcaagcaagctgcaaattaataaattgcacatgctaaattgttaggaacttaggattacaaaagtgaagctacaatatataaagggttagcgtgaaatcgaaccccatggatttgaataagcgcacgccgttggtggaagatgaagcttctggagttcttggagcagaaggagctcctgccttagtcgaagcagaaggtgctcctgcaagatggctttttgcctagtggtggtcctttttataggtggttgcggcggccgactgcaggcctttgcaccggagttggaggaaccagatctgcccacatgaacaatggcagatccagcaacaggcacaacggcaggtgtggctgcagctgcagcgcttatagcatgcgatggctggtccaactccgcattggcgtcccttattgtggatcgccgaacgtgagttagtgactcaacgagacaacgatgtagccatggaagaggaatttagtggagggggagggggatatggtactgtagttaggcgtctagggaggggtactgagttgggagtaggacagctagatgtgctcaccttgcatcgtcgtcggagcttagcagtggtgaaggcgaagccatggtggactcgagcggctggtcgtcgtgtggactcgtcgttttcccctttcttgccaccgaagccttcacctacatccaccatcagcaaaacaaataagcctacatgacggatcagatattgacagagggtggaggaggaggccgacgtccggtggccggtgccgagtccacggcgtcctcggacctgggaggctgcgagtgaagggaacgggacggcgcggcgtggcgctgggacctggccacggggctcgggagctgggagctgggccacctgggaccgggcggctcggcgctggtgcggtcaccgacacggcgggcgcggcggcccggcgctggcgcggtcgccggcacggcgggcgcggcggccctgcgcgtgcgggtgcgagatcgggagtcggcgccgcttagccgctgtggccgacggacggtggcgtggcgcgtggcggc

SEQ ID NO: 42071 - DNA, 7066 bp, Oryza sativa
atcatctattacggatctattctgcaccgctagtgtttgtccccaaaaacctgcctcgcttatccctcgttgaaggcatgcagctacagaaggttgttgccccctgaaaaccacatcatgcctatgattccatagcacccaaaagcagaggaggtagaagacatggcagtgctttgccggcagaagctgcgtgtgacttagccggtagaagaactgaaggtcttggattgagggttgcactccaatatttgtccagaaactgaccacaaaagggcaagtgaagcacaaatggtttgccgtctcgtcgccactgttgcagatcacgcaagacgctgactgaacaatcttcttcttcaagagatttttcattgtggacagtctatttcgaaccagcagccaagcaaacagttttaccttcaacagtgctctgctgctccaggtgaacttccaatttggcgaggtaatacctgcaggaaattttgcctcataaatttgtttagatgtgagtgtgccagaacgatcgtcttgctctctccggtcgccgacggccgctactcgccgccgctagtccgccaccttccctccttccctctctaagctaaatcggggcctttgtacctggtcgccgaccacctctccaagctaaatcaggccatctgtccctctacctctgctagtaccgagtaacagtctccaacccaaatttcgacattatcgatttgattcagttgaatcgaggcaaggtagaatcgtttaagatcaatccaacgtatccggcgcctgtttttttaattttcactctctcttctacctaattgctgcctctcgtcggcggtaagtatctctctgtttttttttctgtatgctgaattgctgattgaggtctcctgagcgatctatttggaatcacatacctccggttttcccacctaaattgacaaagtatagtatttacttaatttcgttttgaatacggaaagacacaatccaatttcaatcaatgaaacgtgtcgtttttcaggtccggtgacctgttttattcggtttatcatcaatctgcaatggctaacaagggagggtatctaagcgtgttagcgcccattgaaactacaccaaccatcaagcaagaccacattacttccgtaagcgttttattttgtaaatctacgtcattcttccccctcccccgtccatgaatcctccaacttttccttcgaatttttctgcggtcatatagttcccttctttgactgtggtcggtatttcagatttcatctttaagtttgcttaatgttttcgcaccaaatgcagaatgctgacctacaagacaggattagccagttgccagatgatattttgctagccatccttgatggactcaatgtccgagatgctgcaagaacaagcctcctctcaaagcgttggaggccactccccactatgatatcacatcttacaatagatgtttctgactttgatcccaagagcatgtccagcttctctgatgatgaactgggtcggatcaatgcaacagtggttaaggcaacgaagagcatattggcatgcaggaagtcaaatgagcacactatcagcctcctatccatgagattctacttgagagacgatgactgcatatcctttggacacactgttggccacgttatggcaacccaaaaagttgagatgattgaatttacaattttgacagagaaagatgacaatcagtgcattgacgatgatttcatcgtctatgggagacgttttgcgttgttcttcagttattgtccaaatacattcggaggtctcacaggactccaacttgagaatttgagatttggtgaaccagaaatcattgatgtcctcaacacttgcaagcgattaaactatttgcgtttgtataactgcagctcaggaatttccacttttttggaagttgaacacttgcaactcagtgaacttagtattattaattgccgttttggaataatcaaacttagttcactcccaaaactcacacggatgatctttggtggttggatagctttccaagatccactttcttttggacatgttccattactggagtctgtaaccctcaccaatgttggtcttagttggcacaatgcggtgaagttgagcgaatttctgagcaatatctctataagagatctgactttagattttaatagtgaaaaggtatatcaatgttattcttatagttccatctaaaaaggattattcttctgctctgatggctttacttgtatgtttgtaccatgtcatgtactcatgtgttcttttccttgttgcatatttgggttcaaccagaaggcccaaaagcacttgcatctgcattccacaaactaagggttgtgaatttagttgatcttcctgaagggtatgatccctcgtggacaatgttctttcttgaggctgcaccctccttgagggagctatacgtggcggtaagcacctgcaactgatgcttgattatctgctaagccttttacatcaggggcgtagccagctaggtggcaccgtggttcacggaccatctaaaaatttgaaattatagtatatgtgctggttaatatagtaaaaattgtatagtggaccacccttttaattgacatattacatatagatggactacttttaatttaaattttaactacgccactgttttacattttgcattgactgcaatttctgagatatgttttgcggcctgcaggtatgggatcatctctgcgaaatagagacggatgatgagaggaggaaagcctactcatacagcgagaataagaacgcggattggaatgcgtctgcgtcagatttcaagaaccacagcctgtcaacgttagtcatgtttggctttcagtcgaacgacgaaaacttgattaggtatatcagacttgtcatggatgcagcggtgaaccttgaggatatattcctgtataagaggatggcgtgtgaaaagtgcaagggcaagaatccaaggcccctgaggtacccgtcgaccaagaaacagagacaggcactgaggaacagaattgctctggggacacattcgcttgctacgatccatttcccaactgtattaagggctaatcactatgcaaaactgttgtattaagggctcaaagccgcgtactaagttatcaattttttttttcatacttcctttttaagctctaataaatgtcatcggcgagcgtctaaaaaataccataccattgtactccctctgtcccctaatataaggtattttaacatcttgcttgtattatttgatcattcgtcttattcaaaaaaaattaaaattattatttattttatttgtgacttactttattatcctttattatccaaagtattttaaatataactttttattttatatttgtataatttttttaataaaacgtgtggttaaatgttaaaagaaaaagtgaatatctcttctattagggtatggaggtatccatctttcctaaagaaatgtcatcgccgtcggttttccattaatagccaatcgtgtttactgtcggtcaacacggtcaaaatccgccgtaacaaaggggagctagatgcatctgaagaatgccgtaaacgctgagatcgactgcatcctctccatgtctggccgaacgcgagtttgccgattgctttgcagctggtgatctagcggccgattcctcgcacgttgcatcgacatggaggagccccattgccggcaacgagaggagggtgggaggagaaagggaaggagagatttgtacacagctgcagccaggtgagacccaccatggtacgttgcgccgcgccggcttccgcgcggcggcaacatgccgtggcggtggccgcagatgcctcgactgcaaagcatgtcggcgcggggtgcagcggccagctgcagccgtggtcgtcttaccgcgcgcggtccgcggtgcttgccgtgccaagacgtggagctatgccagtatgcctctcgtgcgtgctatgttatgagcaaacaccacgtagcatcaatataatccctccattttatattataaaactttctagtattatccatatttatataaatatttataaatctagacatacatatatatatatacatatatacatatacatatatatatacatatatatatatatacatatacatatacatatatatgattaacatctatatgaatgtgggcaatgttgaaaagtcttataatatgaaaaaggggaagtatgtcgcaaacaccacatagcatcaatatatgtcgcagagttaacgttgcaggtgcggtacgcctcaccaaaacacgtaaagaataagtacgtggcttaacctagtagtaacagataaagttctcgttgtcactgctgagacttcacatagcccggcaataacctagaggccgcgatatgatatgggctgggcgccctgcctgcgagcccctgtaacataggctggctgggcaagtaggtgtacaccgctacatacatgtctctgtattctctcagggttagcaacctgctagtgaacttctaattactcctctttccaggaaaacaatagtgatatccaccatatcagtagcattgatcggaatggtcttcagaatacacaattccttgctagtttggtactaaaaacgccaaatgtcacaataactcaatcataagcaaatgcagaaaatgcggatacccgcaagcaatacgtcgtcttcagcgtaaatacagataaatctccagcacatcaaataatacgacgctaataaggggcaggaaaatccggtagaagcattcagaagtcagaacagcccatggcataaacgttcagagtgtagctttcagcagcgacaacgttggacttcttgaaacgctggtggtcgcttcctcctgagatagtcaatcggccttgccctcctgtgcaccgacctcctgcagatagtgctccgcgtccaaagcagccatgcaccctggatacaatgatgagttagaagtctgccacaaaaattttatgctcagcagtagccatcaatgatgagttagaattgatcttgtcgacagagtcatgcatatagacaatttctctctttttttgaagtgcatgtctattggatcaaactcctgaaacaagctagcacaaaataatagtaataataataaggcttcatcatgtactaaccatactgaccatgtatcaaccaacatgaaaatcacaaaggaaaaactctgtatgctgcttctgagatgaaaatcttatcatcaggctttttcctttcacacgacaggtaacaaggtagttctttctgaagtatatagaaatggcatactgctttcattctacatcagcagtactggccttattccctgattccaatttttgctaaacaaccagacatcaggattaaaatcagtctcctatgactgtgtccatcaaaaatgccaatttggattgtttctgaccaagaccatacttggtaacattattactccctccttccctaaatgtttgacgccgttaactttttacaacatgtttgaccgttcatcttattcaaaaacttttgttaaatatgtaaaactatatgtatatataaaagtatatttaacaatgaatcaaatgataggaaaagaattaataattacttaaattttttgaataagacgaacggtcaaacatgtttaaaaaagtcaacggcgtcaaacatttagggatcgagggagtactttgtttatgaccatccggaactcaagtttacagagcatgcatggaaagtgaacccagtctctgcttattcctccactatgttgtccatcaaaaaggtcaatttatttcagcaagtccatacttggtaacatattagtttactttgtttatgcccatccggaacacatgttcacagcacgcagggaaagtgaacccagtctctgtttattccaattcattcttttatgcaataataagttcaaactccatctctgacaggatcaagaagggagaatggcgaaacatgaccaattattgaagtttgagcatggagaattttgcatgtgccctctaaccacatgaaaatgtaacttgcactctagtaaaaatacttgctgcaacatcagttagcatgtaaacgcttaacaaagttaactcacatcacaggagtgacagagtgatgtactgaccatacttctgtttttgatttttttgcaaaaatacagtccgtactttgtagtgtagaaattgaaatgcactcttctatactaaatgggaagtagcacttttttttattcctaacaatatttggaatgccttaactatgaaaatcccagaatagcttgaaagtcacttatcccagttcaacaaattccatgattaactaccagctacttattagtcaaacatatgaacctacatggtactttggaagcattaaccggcctcaaatacacctaactttttttaggactaatacacccaatcctagcttggaaacagagcacgcattcaacatgcccaaaaggtagttagtatatctaatcaactatgctagatacataatgaaagcacttatttcagaaactcaaacacgttaactctatgatagcttaaaaaggttctaattttgaccatcatcattcgctcactacatactcaagccctgaacaatttctattgcaattcgcactagcaaatagcaacccatgaagcgactgatctctaagaaagtgcagaaaaaaattaatcacaggtaacctgaaaaatcatcaattcacaaacctgatccagcggcagtaatagcctggcgatacttcttgtcctgcacatccccagcagcaaagacccccttcacactggtgtgcgtggagcctggcttggtggccacatacccatcagcatcgagctcaagctgcccgccgagaaacttcgtcgccggttcatgtccgatggcgaagaagagaccggacacctgaaggtcggagatcttcccagtaaccaagttcttcacctgacaccagccaatggacctccaccctcgccgccgtaggcctcgacgacctcaga

SEQ ID NO: 42072 - DNA, 5587 bp, Oryza sativa
tgggcgcggcaccgatccatgagctcgccgccgaggatcccctcggggaaccccgggaagttctcgacgtcggtggtggtggtgagctggccccccgccgcgatgtcgttggcgagccagccctcgaagagcacgggcttgagctccgcgcgggcggcgtagatcgccgccgtgtgcgccgacggcccgctcccgatgatgcacacgcgcgtgcggagcggcgccccggcggatccctccatggcttggctgcggcggcggcggcgcgggtcggagtctctcctcaaaattacgcttcctacccggcactggtcagaccgtcagaccgagaagggaggaggcgacgagccaatcaacggccaccgcgctcggtcggtcatacccccagatggatgttgagttgttgaccgaaactattttctttttctttggacaacaagttgcagaaaatccacaataattgacaaatggcaatttttttttaaagaaacacacaaacactcacaacacgatgcataccacacttttaaacgcgccgtactcctataaacacctccaaaaaaactgaactgatatatctccatatgaacacacattttatctctattagcacatttagaaatctggattaacatatcttgagtttcatgaagttgttgcgagtgcattactatcaacggctatattgtctactgttgaaagaataattaaccgtaaaagcgagcatatgtgtcaactttataacttcgatctgagttggatttgagctacgctcacttgacggcaaacttttcaactgcacagtatgcacgcactagattcacagatcgcaagcgagagcgatcaagtgatgttaacaaactaagctcaaaaatagagtttgtggtgtgacgacacaagcaaaatcatgtcggagtattaggattcgtggtgcgatttgcacatacgtggatctgcaaatcttgctccttccgaccagcttcattcagatgaggcccgccaaaaaaagaagggcttcattcagatgatggcgagaaatagtggcttccatcttttatctttcggatggaaacccaaacagatcgatcgaaacttccgctgcgtgacacagccaaagtgaatcactctcttcccatcactacttccactctccgtgcagtttcgttaagataatggccagtacgtgcgccatgtttatttggatttggtcgttctaatgatgatgaattgatgatgatgtcctcctccattgctgcattacctgtcgagcttttcaggattcaggcaggagagacacgagcacaggaacatgctgccgactgcccactgctttaatcctttttgttcatgcagccgatcaaatctcgctttcgatccctttgctgtaaacaaaaaattcagaggcagcgtttcgttcaaacggaccagaataaacaacactagccgctggcccatgagcagatttttctctcgaccaaatccacgatactaattgtagcaacgggcttttctactactacccgtgggcttttggctaatgacccagccttgtctcagcttcagcatttttaccatttattcacgctacatcattgaaaattttaaatgcagttctttcaggatgatgcaatggcactttcagacaaagaaaaacctgatcgatagcagtgtcggtgtccggctgtccgctgctcccgtgctttcactaactagttgacaaagataaaccagcattgtccacagaacagctagtgacaaacaaattaagccgataagaaaaatcagtaacaggtgagacgcaaagatttgtttggccagactagctatgtgtttctgactttctgtaattggtgagaaattaaccccatccatttgggcatgcattaatttttttgccaaaaaaaaagacagatatcgtcaaactgactctccatcgacacttactttcagcagaagaaaatggagtacactcacacggcagaacaaagaaattggcatgcaccattaaaaaaagagagagcatgcacgctgcatggaaagttttttttttttgaaggaaatcgctgcatggaaagtatatctgtaacagtctgaaacgttaacacgtatttgaatattcagttgtattattcttgccccgtccttttctatcgaataaaatcccatggacctggacggctagacggccgttcgtggaagaaaaattttgtcacacaaaattaaggtctactctaatacagatggcagttggaaaacaagtgttaatatctatcttgaaccaatgagcatggcaaaaaaattcagattatgcggctcacatttcacgccctgttaattacatcctcatgtgtattaagacatgagtgtcgtcaatccaaaaactagtttcacatcttaatttagacttcattcgaagcacacatttacaaccttttaactaatctgtatctttgttccaaaaaaaattgcagccattccagactttgatcagattgttgtcaggtctaccgatgatctcctgccgctggagctggcgtagtcctcgaccgggactgagttccgcttgatgaactcgaggcagtcggcgatcgcctgcgcgtagaacgagttggaccgcatgaacgacggcggcactgtccgccgcccgccgtcgacgtgatgcttcccgccgccgacgaggaacctcgtgctgctgctccgtgagcagccgcctccagccgacgacgaagacgacgacgacgaccgcggccgcctcaccgccagcagctggcgcacgtaccggccgacgaggccgaggaacgtgagcagcttggcccgcagccgccgcaccgagaaccggttcctcgggcacagccggaaccccctcgccggcggccgccgcctccgccacctcctccctatcctcacgtagctctccggcgaagacgcacaaccctccatctctcttcgaatcttcgatctcctttacgtgcgtgtgtgaattgcgatcgattctgtacggcctcctggatcgcgagctatactctgcttgatgctgccgctgccggctgccgctgctgctgctggtcaagtggcagcaagcgaagcaaactggggtatatatagctctcgcgcgcgggtgtcgggggagaggaacgaggcaggaaggtaggtttgaatcgagccttttcgcgagagcgacatgcgcggggagtagcttaattaagctgctactccactaattaacacgcgatgtgaagccggtacggacaagcaaacagccagtgaagccagggggggcagtgtgacgtgtccgtgtaaaatgtgaaacgggtggccagcctgcacgccaaatttcgccgcgtgattggttgggtcatcgaccaagcagatcaaacagcagctgctgacagtgttactactagtagacatgagtgaattaattagtgggcatgcgtccgtgcgtgcgccctgctcagttctacgtaactgcgtagagattacgtatagaatagtgatgtttcgtccagcagagtgagtggacttgtaggggttaagcgcagcagttaaccataaacatgcgagttggcaggagtttggcagggctagttaaaaactcaaaagagccattaacaaatgtactggcatgacggatctgtcaggagatctctcggcacacggtatatggggaggtggatggagtttgttcgtaccggcatgaggccagttgctgcagacagtttgattcttgtgaccccatgaacttgaataataaactgtgtgcgtatcagcgaagagctagtatatctattgaaatactatgaaatgatgtgcgtggatactctgatatccagctggtgtgtacgtctttgtcccgaccaacaacccaaatattttcgtgttgctgtcctctcgattcagttttcatgcatacatatattcagctcaacgaacgttaacacgtaacaccacagcaagaacacacgtcagatcatatccttgacaatctccctcttgacgtacaatgcatgcattccagaacttttttcaagcagatcgatggaaaaatccgtccgtacataaattagagtcttggatcgattagtcaaaccgttgagcttgaggtcacaggagagccacacgtaccgcatgccacgcacctgccgatcgatcgagccgcacgcaacgcaggcacgggggctcgcgcgatccgcaaagtcgcgatcgatcgatggtggccgcgcgcgcgcggttaggtacgccgtgagccggcgaaacggccggagccgaacacatggcgcgcgcgcgtgcgcgatgcgagattgcgaggaaataatcgtattctcatgccgaggctaccacgggagacggagttggtcgtacgtgcgccggtgcgccctgcggaatctcgcggctcggcacgagggcggacggggcgtggcatgcgcggccgctcacctacgaccgcgaccgtgcgtgcgtgtgtgtgtgtgtgaaggagacacggcttcgcatggaggggaaagggggcgtgagtgaaggggacacgtgtggtggactgggggctgggactgacggccgtgtgggtgagtggcgtggcgccatgtcgtttttgcctttttgtgtccgtgttgggccgatgagtgaaaagcaggagtagcacgttttgtttggagcacgagccacaaggtgtgcgtataattaaagaaaaggggatggtttacttttggactttttgagtctaatggcatttgagtacatgcagcactgagtaggagtacgttttaagctgctgattagtagtatatactttgctcttagagcaggtacaatagcaggatataagccagctgcaaagatattttaaagagataaataaggagagagaagagcagcgggctacaaatttgtagccagttatagcacggactccaaaacgcagtgtgtttatgataggtgggactagatattaatagtgtagtatgtaaatattgtatgaataaactactagattggctatagatgaattagagatagtatttggctacactattaaacttgctcttacacggttacacctattgtgttcttccggaaacacggaagtgtgttgacgacctagagccgatgttctccctgaagactgaagaccgaaaagagtacagctaaggtaagctactgattatagttggccataaggcccgaggcccgaaggcccggcccacggcacgcctttttggcccggcccaagcacggcacggcccgacttgggtcgggcccgtgccggcccggcccgactgtcgggtcgtgcctgggcctccccaccagcacgctgggctggcccggcacggtcgggccgacccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggagaaaatttagacttattctgaggaaaagcacgatggcccatcgtgccttcggg

SEQ ID NO: 42073 - DNA, 4583 bp, Oryza sativa
cacatggcaaccgacagggccgaatctgacgtcaaatgccaataggccagatggaggcccaaaagtgattacggcccattataaactggagcccaccaaaacgttcagcttggcctgcaacgctacgagagggcccacaactcgcgaaaaaagtacacccaaggtccctcaacttgtcatcgagatacaaaatcatccccaaccgcaaaaccaaatatatgacatccttcaacttacaaaaccattcactttagatccttcggtagttttgaccccggttttgtctaacgtggcagctgagtcagtatgggtccccatatgggccccacatgtcagtgtccacgtcagcaccttctctctttttttccatcttctctctcttcctcctctctcacattcttcttgttctcattgccatcgcggtgctgcatttggatgcagaggatctcgccctgtgcgacggcgagctgcatctgtagctgtgacacctggttctgcatgaaggagatggccccgacgcagccgtagactgggtcccgcatccggtcgttcgcctcatacaccaggctgctcaccgcgtcgccttgctgccgcgccagcagctcctgcattggaaacacgcatcagacgcaagcatgcatgcacggtggcgtgggcgccgccattgatgacgaccttatacgtgttcgtgcataggccatgcaatgccaatggacatatacacatatatgtatgttgggtaagaagaagtttgatttaatatacctggaggctggagcatcttgctaacattgctgtgttagacttcaggagtcttttattgcttggcttcactattctatttgggatttgggcctgatggccttgtaaggtggctggtgcgtgagtgaaggcccagctgtgagctgtgtactagctggaacctttatatactttgccgaagcgctggtcgtaggcaacgaataagaaaatacaatatcaccaacctcctctccaagtcaattccccactctgttcttgctcagttcctcttttcttcctcccgagttgctcgatccgtgcctagtttggcgtttcgccaagggagatctcactgattcgtgacaaatctggtatcagagcagtggattttagggcagcttggcaaggaagaaggcgaatccaaccttgacggagcgcatggcggcggtggaaggagaggttgaatcgctgacgacgagggtggcggagctcaccacaagcctcaactccatcctgggatccctacaaggtatggagaagtggattccggcggtggatgaaggcatcaaggacctgcgtcaagctgtagaacaagttgcctcgcgggtgaccacgctggaggcaaaggcgccggcgacaactatgccggtgactattccgcccgttgggcacggcgcagctttgaaccaccagggagctgcaactggtaccccagtggaccaggggcgcgccctggtcaagggtaagctgcaatttcacaactcgccagttcattttgatttgggggattgctctgaaaaagggatgggaggattgcagagtcctggaaggtctagtggatctaggttacccaaaactgatttcccaaaatttgatggagacaacccaaagctatggaaaactaatagtgagaagtatttcagtatgtaccaggttccttatgaaacttggtcatcctttgccacactccactttgtagggaatgcagcgttatggttacaaacctatgaggagttgcactgtgtagagagctggccagaattgtgtgtagtagtgcatgggaagtttggtaaggacaagtaccaacaacatttagaggagttagaagggttgagtcaagttgggggagttgatgagtattatactaaatttgaggagttgatgcatagggtcttagtttacaacaagagatatgatgagacattttttgttactagattcatggggggtttaaaaactgagatcaaaacaactataaagttacacaaaccaagaacggttgatctgacattatctttggcaaaaacgcaggaggaattattgctggagagtagcaggaagaactactccaaagaaggatacaaggatgcttacaagccggtgattaaacctgtttatcaaggcaaagggattctgggagcatcaccagaggaggctaagaagcctgaggagaaacccaagtgggaggaaagatttgacacactgaaggcagcaaggagagctaggggagagtgcttcaagtgtggagaaaagtatggcctagggcacaagtgtcctaagtctgtacaattacatgttttggaagaattgcttgaagtgctccaattgcaggaggatggttcccaaggtgatgatgaagaagaacataaaagtgatgaagagctagttttgtctgagtttgctgtggctggaaccatgggaaggaagacgattcgatttcatgggatgatacagaaacaacaactgctgatactgctagattcaggtagttccagcaactttttagcagagaatgtggtgaacaagttgggacttcagtgtgaaactgtgccagcaactcaggtgaccattgctgatggtgggaaaatgcagtgcaatcagcttgtatctggtgtggaatggtggtgtcaggggcatactttcaccattgattttaaggtactgaatttggggggatatgacatgattctgggtatggaatggttagaatcattcagtcccatgtggatagattggagaaggaagaggatcagattcacatatatgggagatagggtgtcactaaatggagttaaaccaaacctctcccagaccacaatgctatctgttaagcagttgaagggcttgcataaagatggggcaatatcacagatggtgcaactttgtgcaatagaggaagttcctgatattaagcaagagttaccagcagcagttgagcttgtagtgaaggagtttcaagataggttcaagaaaccaactgagctgcctccacaccgccagtttcaccatcacataccactgcttccaacagctaaatcggttactaagaaaccttataggtatgcccctcagcagaaggatgagatagaacaacaagttgtacagatgctacagcagggaattattcaggccagttctagtccttttgcttcccaatgttgctggtaaagaagaagaatggctcttggaggttttgtgtggattatagggggctcaatgacataacagtaaagaataaatatccaatgccagtggttgatgagttgctagatgaactagcaggggctaaatggttcactaaactggatctaaggtcaggataccatcagataaggttggctgaacaagatgaacataagactgccttcaggactcatcaaggtctatatgagttcagggtgatgccatttgggcttacaaatgcaccagcaacctttcaggggttaatgaacaccatattcactgctgccatcagaaagtttgtgctagtatttgtggatgacattctaatctatagcaggactctctctgaacatgtggagcatttgagatgggtgttcactctgctaagacagcatcaactctttatgaaggcaagtaaatgctcttttgcacaacaggaattggagtatctgggccacataattggggtcagaggtgtggctactgatccttagaaactgaaggctgtacaaatgtggcaagttcctaagaatttgaaacaactcaggggattccttggtctggcagggtattatagaaagttcattcaaggttatggcctgatgacaaaacctcttacaaatctgcttaaaaaagaagtcaagtttgtttgggaggaaacccatcagcaagcatttgagtctgtcaagaaggctttaaccacagctccagttctagcacttccagatttctctcaggaatttgtggtggaaattgatgctagtgacaaggggataggggcagtgcttatgcagcaaggtcatccattggctttcattagtaaagcattgggggtcaaagcgcaagccatgtcaacttatgaaaaggaatgtttggcaatattgttggcagtcaataaatggagaccatatttactgcactctgcatttgtgattcaaactgatcacaaaagcctaacacatctgggagagcagcagttgaacacatcaatgcagcataaagcttttgtcaaattaatgggcttgcagtacaagattcgatacaaaaaaggggtagataatcaggtggcagatgctctttccaggaaagttgaggatgaagaggtgctggtcatgtctattagttcaccaaaatggatggagattgtaactgaaggttatgagtgtcggtgacatgggatcaggagtatcatgactagaggtttgaggcagacacaatcgcccacgtggcctggcaccctcgggggacgtcgggcccgagggtaatgtgttcgccctcctcttagtccccccgagggggtcggaccgcacccgcctcagccccgagggccgaggcgccctgacccctcgtggattttttgctctgtgtgtatgggttag

SEQ ID NO: 42074 - DNA, 11640 bp, Oryza sativa
tttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcatctggcgcgccaggtagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggcctcgcgcccggccgtacagcaagacggtgctcaatcacctccctggggaccccgggcatatccgccggtctccatgcgaagacgtcagcgtttgcccgtaggaaagagacgagcgcgtcttcctatttgccgtccagaagaccaccgatccgtgtggtctttgacgggccgtcgcccagggcaacctccttgaccgggacctcattgcacgtgactatccgctgcctcggggcggcgggggtggatgtgccaagcctctcgccgccaccctcgggcttggacacgacggcgaggcggtccgcgcgctgctccatacaagcgagcgcgactttgaggtcgccatggacagagatggggccaccggggcccggcatcttcatctgtaggtaggcgtagtggaccgccgccatgaacttcaccaacgcgggcctcctcaggaccgcgttgtagggcagactgaggtctgccacatcgaagttcacccgctccgtgcggaagttggcgggtccaccgaaggtgaccgggagatcgatgtgacctaacggccacgtgtgccctggcgtcacaccgataatcggctgggatggccggagcatcatccccggggccttgatagcgtcaaaggctgcgggggaaaggatgttgagggccgctcctccatcaatgaggacacgccccagcttcacgttgcaaacagtgggggaaaccaccattgcgatctgtcctccccgggcaacgcatggtgggtggtcggtctggtcgaaggtgagggcaacctccgaccatcgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggccatcatcgccgtcatcgatgtcctcggcgggggccttctgcttggcctcacttcgccgattgccggaaggaaccgccggggacttgccctctcggcgctcctgcctcctctcctcctcccacttcctcgttcgctcagccaaacttttgaccgcacggcagtccacgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcatcggaatggactgacctcttcttcctcctcctgtcacgccgccctgtctgagcggcggatccaggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcatgccccccctgaacgcgtagattaccgcgtgtgcagggatgcatggtatggtgttgcggacttgacagaaccgctgaatgtattagcgaagtgactcatcatcccttcgctgtactgcgtgtaagtccgcttcttcacctgggcgcggatatgtgccctgaaagttcatggtgaactgttggcacaaatcctcccaggagtggactgacgtgggtggcaagttcattagccaaccccgcgcctgcccctttagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcgatcattacgccgccgctcgatgctggtgcgggcgtccggccccccacgcagatcttcccgggttgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgccttgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcaccactcggcagggcggctgttccccgggcccctgtcgcgggacccagaagcacgaccccctcccggggtagattgttccccctgcggctcccgcctgcgccgtcgtggccctttggagctcgctcctctgaggccccgaccgccatcataatggtcaggatggagacgcggtctggatcgctgcagagggggaggattccttggggaatgagggacgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcaaggggggtgtagaaccagtcgctcttccagtcgtcccacttcttgcggagggcgcaggggatgtagcgattcagcaccggctcccgtggctggaagtagcagccaccaactaccgatggcggcgacaccgactgtacggtgaagaaccaccggaacagccgaagagatgggcgcaccccaatgaacatctcgcacagatgcgcgaagatggccaaagtcatcaccgcattgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagatcccggcatgaaacggcgcgccagcccagcctgcctctcgctcacaatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccagcgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcatgcgtgcgttaattacgctcgccgaccgaagcgacgttaccatatctccagacgaaatgaatcgccatgtccagattcgtgtgctactcgagtaatgtggcagtctcgaagagaccgctcattattgacagccgagttaccactgccgatgtgcgtgatttgtgaccgttgggtttctgcccaattgaggagaccggtcccgcctgtcaccgggccttaggagtggcgtcacgcccaaccgcttcccttaaagagggcgatcgccctggcataacgccgggggctactgtcggtgacatgggatcaggagtatcatgactagaggtttgaggcagacacaatcgcccatgtggcatggcaccctcgggggacgtcgggcccgagggtaatgtgttcgccctcctcttagtccccccaagggggtcggaccgcacccgcctcagccccgagggtcgaggcgccctgacccctcgtggattttttgctctgtgtgtatgggttaggtgagcacagcggggctcacctaaccacatttattgcggtttggctgagcgtgtcacgctgcatgtaacgcagtgcagtgcactcatttatccggtctgtgaccagtcacagaccggtcagatcgcgggttaggtggcgacaggcgatctgacgcacgcctcgccccatcccgtcaggacgagggcttctaggcgcttgtccccagctggagctagcgtgttacctcccagagatggcacgttagccctggtcagatatatgccaggcttcatcctaaccattacaggcaagatgttgtgtgaagaaggacgaacatatagattgctaagctgacacgtggtggacaagaatgaccgacgtgactggtctgacaccggtcatgtcgtcagtagacagccacgattccacgtcgcatctgctcccggcgaaagtggaggtagttgtggaccgtcccatcagaaggtgactcggatggcaactatacaaatctccgtccatttatgaaaagggtgcatgtggtatccccttaagataaaaaaggaggaccttgcccacttagagggaggaggagacttttccagattgggaacctagaacgagggagaggctggctcatactttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcaatgagcatgatccaaaaactaaacagctcttggaaattctgccccttcagcctaaaggatgtgaccacttccagttggttaatggggtaattcgatacaaaggaagaatatggcttgggcatcataaggaagcacaacaggcagttttgcttgcattacacaacagtggggttggtgggcattctggtgttacagctacctatcagagaatcaaaaatctgtttgcatggacagggttgcaaaaggatgtgcagcaatatgttgctcagtgtactacttgtcagcaggccaaagttgaacactgcaagtctccaggtctgttgcaaccattgccagtccctatgcaagcttggatgactgtcagtatggacttcatagagggactgcctaagtcaggcaaatatgacacaatcatggtagtcgtggacaaattttccaagtttgctaaatttatccctcttgcacacccttttactgcttatacagttgcttaggcatttatccagcaggtgtatgatgtctttgggatgcctcaggttatcatttctgtcagagacaggatttttactagtgctttctagcaggagctgttcaaactagcggatgtcaaacttaacatgagctcttcttaccatccacaaaccgatggacaaactgagcgcttaaccagtgtttggaaggtttcctcagatgcacagttcactttgctccatctaaatggtccagttggctgtcccaggctcaacactggtataacacctcctaccacaatgtgctgaataaatctccatatgaggtcttgtttgccagaaagcctacacattttggccttgtggatgtgggtgcaagtacagtgccggatgtgcagctttggctccaagagagagctcatatgaatgaacttttacatcaacaattactaagggctcaacagaggatgaaaagtcaggctgataagaagcgttctgagaggcaatttgctgttggagatcgagtttatctgaaattgcaaccatttgtacagatgtctgttgcccgaagatcttgtcagaaactgagctttcggtattttggaccgtatacagtgttggaaagggttggcgctgttgcttaccgcttggatttacctgctactagtcagatacatccggtggtgcatgtttccttactcaaggcggcaatcaaaccaggcacccaggtcagttctgatctccctctcaactattctgacgaacaatctaccattcagcctgaagcggttcttcgtcgaagtctgattaaacgtggcaagagtgttgttccctgtgggctgatcaagtggattggcatgcctgaggagctggctacttgggagaacctgcgccaactccggacacgttttcctgatgctactgcttggggtcaagcaggttcttaaggggaagggaattgttagactccaggagtcttttattgcttggcttcactattctatttgggatttgggcctgatggccttgtaaggtggctggtgcgtgagtgaaggcctagttgtgagctgtgtactagctggaacctttatatactttgccgaagcgctggtcgtaggcaacgaataagaaaatacaatatcaccaacctcctctccaagtcaattctccactctgttcttactcagttcctcttttcttcctcccgaattgctcgatccgtgcccagtttggcgtttcgccaagggagatctcactgattcgtgacatgctggcgccgaagaccttgtggactatggtgaacttgtggggttcgtcggccgggaagaagggcgcaaagatgcaatccttggtgcaccgccgccgcagcagcttgcacgacgcgcacggcgacccactgcacatcgtcccaatcctctctatctaatgttcacacacgtataaaacgcttatacgaatgacagtggcggtcagtgacgggccacgtggcggcggcggcggcaacgacaacgtgggagaaggagacgcgcctctgctgtggggatcggctccgacggcggattgctacctctccgcccgctgccgcgctgctccgcccctttggcttcgagcgccgtcgctccacccgccgccacccaatccgcccctttggcttcgcgcgtcgttgctccgccctgctggctttcgccagcctgcgccgtcgccccgccggctttgggcgcatcgccattccgcccgccgtcgccccacttcgccttcctacgccatcaccccactccacccgccgccaccctgccacccccgcttgcttcgcgtgcgtcgccgctccgcccgccgtcgccccgcttcgcctgcctgcgcgccatcagcccgctccgtcgttgctcgcctgctccgccgttcccctcatcgcccaacgctgcggggccgcttcgccgccggtggtgacacaacaccattcgtgaccggccgccgccctcgccttctctcgcgtcgcagccgccgcctcctcctttctcgcctcgccccggcggcctcctccccagcagcgccgctggcttgccagagaagagaagagaagagtgagagagagaggaggaggaagggagaggagaatgaagagggagggtgctgatgtggcatcttgacaatgtggggctgttaacaaccaaatttggtaacatctatgtcaggaaagaagattggatcaaagcaaagttggaggcggagatcgagttcggaaacagagcaggaatcggctgaagtccaaatcggctacgattaggatcagctgggtctgagtcgggttgagtaagccgatacagccgattccgacaatacgaatcgtacgcgacatcgggttcaagttaatgtatttcaagatgattgccacgcacgaatagagtcctgggaaggcaattgtatctattaattagaatattttatgtaaattccttatagataaatgtcggtgacatggggccgggggtatcgtgactagaggcttgggtagccgcggtcacccacatggcctgaccccctcggggggggggggtcgggcccgagggtgacgtggccacccctccctctgtctccccgaggggtcgggccgctcccgtttcggccccgagggctagggcgcccccgtttcggcccgagggctggggcgccccgaccccctgtggttttggcgccacgtgtgtgggttaggtgagcacagcggggctcacctatccacatttatagcgggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcgaaatgatgagagcttcctggctctcgtccctagccggagccggcgtgctaactcttggagttggtatgtcagtcccggtcagatccattccaggcttcagcgcaagcatggcaaggaagtcgctggccattgaatgaaggttgaaatgggcgtccaccgggaaagctggcgagcggggcaggaggcgtgtgctctgcttgtcagaggtcacttccggctgtagactagccctcattgtaaaaagcatgtttcctttcttaggcagctggaggcccatgtggtgacccctgaccagataaaaaggaggcccaggcctaggagagggagaggagggagaaaaaaacaggagaaaaagaggaagaggggttgggactctggcgaatgggggctagagcctgaactctctctcgctctccggctctctgtattccttcacgcacagatccaccagaacacaggagtagggtgttacgcttctcagcggcccaaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcaataaatataggcaaaagtctgccgcaaagacttgtggtatcttagagtttgatagagataatagtcgtgtccggtatgggcatatcttgtaattctcaggtataaatagaccccgagccttatgtaattaacaacacacgttcaatacaatcttggcgcatcgccacccttttgctttagttttgtttcgacgagttcttgctttcgggttgagctgcattggtttcgatcttcaacaagaggtaaaactcgttatgacggattatgtttttacgattagtgcttccatctttatgatactctaatcttatttatataattcgtcgagttatcatatatcttatataatctctagcaatatcgccacctaatctactatcggctaacatctgtacgcagagggcagctgattgggttagatcttgatgttgatctagattataagagatatctaccattctatgaaacttctagcggcttgattgtctagatatcgttattcttttcatacttaatgttgtatcagttgagtttgacctattgagtcgtgcttagaataccgatctatagcctgccttctagttgccgattagaatagcgtcagagtttcagccgatcttatctgatttacttatatttgttctatatgcttcattgacatgttaaatctgccctctatatcaagatattgttgtgtctaagtatattaggctcttgttcagtatattattcttactttaatatcctgatatagagtagtatcggagtattagccgatacatgctagatctatctgatcggctatgctataaacatatatagtcctgttattgatatatatttcgatctaagtgatttatactgtctcggcatgatgaccgatctatcccaatcacttgatttaagtatacatcgatataaggagtatatatcgtgaatatctacagccgatcgagtagatttagttcttctttacttattcatgactgtcgatcgatgcacagatgacatcggcttaaagataaatgatatgtcatcggcatctagccgatcggctatcatttatagatttaaccacggttcctttgcttatatttcttgttgattacaggatcaaatcaactggcacgctaacacatctgaaggcgagctttggatctgcactggagttaagcagatctcctaggccacgtgttttctgtcaacagaggcccacgtgggtctcacgttgactcagccgccacgtgggacaaaaccggggtcaaaaccactgaaggacccaaagtgaatggtttttataaagggggctactatataacggaatcccgttttcgaacgggatgatcccgagtaggtatcaggtgtaatacctatcaggtatcagacgattctacacatgtttcaggtgatacttgcaaagtatcatgtgatacttatcaagtatcatacgatttctaccatgtatcgcgtgatactcgcaaggtatcatgtgatacctatcaggtatcagacgatttctaccacgtattgtgtaatactcgcgaggtatcatgtgatacctgtaagatatcagacgatttctaccacgtatcgcgtgatactcacgaggtatcatgtcagatatcgatgatttctactatgtatcacgcgatacttactaggtatcggatgatacctaccaggtattaggtgattcctactagatataactggacatctcgttggggagaggagcatctcgacgcgcggccggccacctgcagtcgtcccttgtagacggcgacgacggcggcggcagcgatggacgggcgcagcggcgacggcggcagcgggcgcggcggcgacgacggcggcggtgagggacgggcgcggcggcggcggcggcgagggacggcgacggcagcggtgggggcgggcgcggcggcgatggcggcggcgatgggggacgtggacggcggcggcgggggacgggcgcccgttgatgccttcagccgcgtcgcatggatgagaa

SEQ ID NO: 42075 - DNA, 4928 bp, Oryza sativa
tctagggggtggccatatcccagtaccgcccaccatccaaacacctccaaaatttggacggccatatcctatcccagccaatctctccatccaaacacatccttaagagttcccgttaattttgtccgctttagacaaatgtagacgtgtgcacggcaaatgagatcggcatgttgtaggattatttacaccaccaagtggtatgagaaacagagcctcacccgatccttttgtctgcaggagacagccactcctacactcggtcacgacaaggatgttgtggttgtctatattcattcgtaaaagttaagtgaaggaagtatctcacaaaccctcttctacaatgtcacattaccatcaccggcagatagagaagccacatcatacgattgtttacatgatatactgtcacagacattattaacttatgacgcaaaggctatatggttgtccacgcatcatcatctgaaaatttactgaacatgatctagccggcgcgttaattcttcctgaaatgcgtgatctggacgttctccacgtccagcttcttgaagttgctgttcttcctggtgctgaagaattcgccccagttgtaggggttgtacctggccgggctctcgtcgctcacgacctcctccagtggctccaccatggtgtggcccgccgggttgaagaagaaagggatggagaacctctccttctccacgttcaccgccacccggtgctccgcgctctcgtacctgtcattgctccacacctggacaagcgcactctcaattttttcagtcaaattcaaaatgcaaataaaaatgatgtcaaatagtaacaattaaactacaatgttgttatatatttattaactaattctcttttaaaagtttgtcaactatgaataccgttataattgtagtgtaattatattataacttgtatataactgtaatataacgtgtatgcacataattttaaatcgttagatttacttcaagattcattcaacttggaacgacctccgtttcgtgaaaatagcgtgttaccgtagaaaacttatatgtaagtttcacataattttaatctattagatttactttgaaatttatttaagttggcaagaaaaaaaaatcatatgacgcgcatgggtgaaaagatacggtctcacaatctccgctttcgcgaaaataccatgttactataggatttctaaaacttacatataaggacacacaagttatgatacaattattctttcattgtaatatatttatgtccgataaattgttagaagaaaatttgttgataaatatgtagctgctcaaaaaaaaaagtacctggatgatgtcgccgacgttgatgatgaaggagtgagggacgggcctgacgcgcacccactcgccgtcggatcggcggcggacgtcgaggccgccgacatcgtcctggtagagcacggtgagcgcgccggcgtccttgtggcggccgacgccgagggcgaggtcggggctcgggcagggagggtagtggttgagccggatgaaggtggtctggtcgtccttgaagaagccatggaggcggtcgggtctcaggccgaggctcctggcgatcagctccagcagcttgaacgccagctcctccaccgcttcgccgtactcctccattgcctccctgctcaagaattcgatgaggttgaactgaattgatgcgaggatgaagaagacgatcgatcgatgtggtgacctgacctgaatcccggcaggtcgtcgggccacttgttgtcgaacaccaggtcgccgtcggccacggcggtcgtcggcggcggcggcgtctggcgcgggacgaggtcgaacacctccttccagtccctgacgttcttggtgtgctcggacgcgtagtaccccatcggcgccgcctcgctccgcgccacggccgccctccgctccggcggcagcgcgaagaacgtcctctgcgcctccgccgcgcgcgccaccgcctccgcgggcacaccgtggcgcaccaccacgaagaagccccagtcccggctcgccctcccgacctccgccgcgagcgcgtccaccccgtcggcgtcgccatcgccggcggcgaggagaggggagaggtcgatgaccgggatgccgtcggcctcggcgacggacgccttggggcggtgctcgggggcctgcacgaacgcctggtccatggagaggccgcccatggtcgatcagtagctggtggcgagaagctgtagcacaagtgttcgtctcgtgtgtcagcgtgtgtgtgtgtgtgcgtgtggcttgggtttgatatcggcgaggaaaaaggacgtgcgatgggttaggttggatagctcagttcatggctggattcaatgaatctggatgggtttcagtgtgacgcacatttggcttgtgtggtggaggccttctgatcggtgcgtgttgtctgtttgttgtagtgacgtcgatggatgatcgaccgagctagagagccgagttggcgacactgcgacacaacacacgatcgacaggaaaaaggtggccggccgggttgagagaaataacacgtacggtaccgatttgcaaatgaaaaaaaaatatataaataaaacttttatacacgtgttcataacgatctaaaagtaaagactataaataaactacgatgaaaaaaaaaatctcaaaatcaacttttaatttaagattgaaaattcaaactttagctaggagtaataagtacaagtataagcataaatgaaaaaaataaggttgtacgagttcactcaggatacagttttaacgccgctagcgccgccgccttacgtgtttatgtccttggcacgccgggagatcggccaccggcggcgagcttggacgccggcgacgcgaggcgtccttgaggggatcgaacggtcgtgttcagtgcgtggctcaatgatatgatgcgctgcggttggtgacaaatggctgggagcggagagagcacgacaaattatggttgtagcttcctcgtcaggcggacgcgacgcgagcgagagtattcacccggagctcgcggtcagtggaatctgaaatcagcacagccaccgtagtttctctccttgcaagtcgcaacaacgtacgaccacctgtgctagctagggagtcagagtaactatggaagcgcgatgaaatcatattccctccgtctttaaaaagaaactaacttaatatcaaaggtgatattttttctaaataatatatctgaatagaatattgtccagattcactgtattaagaaatatcactttcaataatatgttgatttttaggacaaagaaagtatgcaccaacggggtgctggtgtgctcgtgggctaaccaaaaaattgggccggatgatgtagtggtgactgtggtgttagttgttgtgcagagaggttgtggctgtagcaggagaggaagccgaagcgcggcggggcgctcatctcatctcgtcctgtacgccgtgtccatcagcgaggccgctcatgcatgtgcgtcttcctcgctcgacgggtgcttcgccgccgcggccaccgtccgtacgtgctcgatctggaacgtgaacgtatacctggaagtgaacacaaagaacaacaaactaataatgatatatgttatccatgagaaaattaggccaaagctgttgaaaatatggtcacatttcggtatattttaatccaaattattacgataataatcatgactttaacagggaataaaccagtacaattatcaaacagatgtaacaaataaatcatgcttaatatataaaaagtatagatattcaccataaggcaatgcactaaaaacattgcgccaaacataaacttagtagacatgaaaagtagtgtagaaagattatacccagtcaatgtccctccgctggattgtgaggcagaattgcctccgttggtgttgtcgcctggagcgccgccgttccctccagctcctggtgcaccatcgccagtggaagccatcgcgatgcagaggaagcagagcagtcacgtcgagatgctccctaaaaacttgatcgtccgcctacccgtgcaggtttctcaggtggacggagttctggaggcacctactcgtcctggatctcccatgcgcgcaagagatcagaaccggagaagacagagtagcagcgcaggaaacataagagattcagcgacaggaggaggaagtgtgagagacggagagcggaaccggagctctgtcgcggtggtggctttttatagcgcaggagggggcgcttctcgtccattaccagagtaacagtcgcgcccgcattgaatcatattcaattcccatccgttgagccggttcgaaaggaattcaattggcctcgccacggccacgcccacggcctcaacccggcccggcccggcaggcgcgcgcgtgcgcccgtgtggcagtccgcccactatctcaaccggtcaacaggggctcttctctagctccctattttaaattgagatctcttcacttaaattcctgaggtagttttattacctctaacatttattgcgggcctatggattttaattgaattaaatcaggcctaacccatttattccaacaatccccaccaaatttcatggctcactagaaatgctctcgatagcccatttgttttttataccagtgtttcggtggaaactgttaagttgaacttacacctaggaaaagagctacaccagatcacaactgaacaatggactatgccttgaattgtcagtcttgtgtaattcaggtttcactcaaacccttaactaatactgggatgccgtttgcatcccctctgtttggagcgtatgagttatactcccggccttttcatgagtatctagagatcacccaaatcttatagactgtgactagcagttggactcatataggtgtgttccttctaagatgt

SEQ ID NO: 42076 - DNA, 1059 bp, Oryza sativa
acatgcctggatgacttcatgttgtccttcgaactgttcactttgataatcactgtttgtttatcacagttcatcaggattgttggtactggtttttcaaccaccggcaaatccatcaggagctcacgaagccattcggcctcaattgtggcagtatctaaagctatgagttctgcttccattgttgacctcgttaagatggtctgcttgcaaaacttccaggaaatagcgccacctccaagtgtgaacacatacccacttgtggcctttatctcatcagcatcagatatcaagtttgaatcactatagcccttcaatacttttgggtacccggcgtagtgaatctcatagctcattgttccttttagatagtgcactactctttcaagagcatgccaatgatcatctcccggatttgagacaaatcgactcaacttgcttacagcaaatgagataccaggcctcgttgtactatctaagtacatcaatgaaccaatgatctgtgagtatctcaattgatcccttgctattcttcggtttttccttagtagcacactggaatcataaggagtagaagctgtcttgcagtcactataaccaaagcgactcaggaccttgtccacatagtgagattgcacaagtgtggtcccaccttcatctcctctcagtagcttaatgttaagaataacatcagccactcccaaatccttcatttcaaagcttttagacagaaagtccctgaccacctcaatcacattgaggttggtcccaaagatcaatatgtcatcgacatataagcacaagatcagtccctctcccccaccatagcgatagtacacacatttgtcagcttcgttcacaacaaagccaacagatgtaagtgttttgtcaaacttctcatgccattgcttaggcgcttgtttgagaccatacaaggacttcaacaacttgcacaccattccctcttgaccttctagtacatacccatctggttgatccatatagatctcctcctccaactctccattgaggaaagctgtcttaacatccatctaatgg

SEQ ID NO: 42077 - DNA, 1122 bp, Oryza sativa
cttgtgttagcctacttttgtccctaaaccagtcacttgtattggatgtatggttgatggtaaaattcagatgtggtggttccattggatgatggttaattgatatatttttgcatatttcatttctgggagcatatggcgtgttgtatgtgtgtgctcccctcctgttatgtgtgttaactggtaacacatatgcatgttaaaaatttctgaaaaaaattgtcttgggttcatggtccatggacaaatatgcagacaagtaacatgaatgctcatgagcatcttgtttaattttaattttctgttctcaaggtagacaacaaatacgttatgcatttgattatttgtacatgcaaccatccaattttccaaagtataccaggtaggaggtattctcaccatttccatccaaaaggtgatgacaatactcatccatcctaccaaacaaaaaattggctcaccatatccaccttttatccatccaaccaaacaaaaacttggctcatcccatctatccaaccaaacaaaaaactggatggccatatccctaaaaaactggatggcccaatcccatccacccttgaccaccatccaaacacatcctaagtgaagagagatatttttttcaagtggatctcttaaatgatggccggcgaattcgctggtggccactaaagagcaccgccattgaaaaatatcgccacattaaaaaaaaatcgccggcacactgccacccaccgcttctccttctcatctctagatccacccaccctccccaccgcttctcctccttctcactgcccttgaaaaatatcgccacatttaaaaaaaaatcgccggcacactgccacccaccgcttctcctccttctcatctctagatccacccaccctctgctcctccctcaccggcagcacctccatcacccaccgtagcacccctctcctccttcctccccattggcggtgggtccatcgatcggcagcggctcgcacaagcagtggcggctccggcaacggcaaaggggaggggtggcggtggtgaggcggctcgtgtaggcgacggtggctctggcggcagtgttcaagagggcggaggaggtgtggaaagatagatccgaca

SEQ ID NO: 42078 - DNA, 11029 bp, Oryza sativa
  unsure (1)..(11029): unsure at all n locations
aaatatatttgatgttagatttaatgtaactaatttgatgttgtaaatattattaactttttctataaacttactctcaagtttaaatatttttaaaaataaagtcaaagtgtcaaataatttgaaagagagtgaatagatgattataattttttgttcacaatgaacaccgaagtgtcagtaaaatcaagtcaacctccagtgaatcttgggttcatagtcacccatcagtttcccttactgccggtaactgcacggttaccgaggttaccatgcttaccacgggaaacggtaatggttaccgacagtaaaatttcaaccaaattcaaaatttcccaaaaaaaatgaaaacaatccaaaaaataatcatggatgtgattcttgatttttagtggcaaatggtgaagaaatttttgaaaaagagtaaagataaaattaaatttaagggcaaaactgataatagtttagaaaatggaaaaaaagaaaaaaatatccattgaggcccaatagagaaggaaatatctccataatatacaagaggtcatgttgaattttttattttacatccaaaagttcggtttgcaactatcctatatatttttctaattatccctagtttctacatttaagtgggttttcaattttttttagcattgttacgttcatctacacaactcacggttaccgtgcaaaccatgtagtaaccacaaccaaaccgtgcaaccgtcaaattttttaattcaaatgcttgccgacgaaattcatgcggttttctcggttactgcgggggtgcgataaccgctctccaagtggtaagggaaaccctagcatccatacagcagctgcatattctgatcacacggcggaacacgaggacggccgggatcccgacaacaactctcgaatccacgcgagctccttgtcccagctgaattctcccgccggcggcgctggaaatgccattgccatgtctgggcacggcacgacaccggacgccgtccagaaaatgtcgccgccgccgctaatggagcatggctctgccgccggcgccgggaacggcgaggattcgccgggctcgccgtgcttcgggccaagcaactcgtcgacggttgcccccatcgccagcgccatgatcacctcgtggtccgtgcgagggccgtccctcgtctgcacgagcgtctgctcctccggcggcggtgggaactggacggacggatgaatgctgccgacctcgtcgccgttgactccggcgggcatcacgtcggcgtgccggtgccgcgagctcgccggagcatggatcagatcgtcagccgcctgcttcctcttggagcccgaggtggacgccgccgcggcctgcaggcttgcctctacttgagcggcgcgaggcgaccggtacatcttgcagaggaccaggccgccggcgtcggcctcgccgccgccgccgccgccgtggtcgacgccgaactccgtcatgcaccacccgagcctggtcaagcggcggccggaccccctctccctcaccccgtaggacagcctgcgcaggtgcccgacgcggcgcccgccggcgtcgagcacggccttcttgcccgccctccgggtgccagcagccacagtgcccggcctccccgttggcgccgccgccgccgccgaccgcgcgctgccgccgcctggccccgacgccgccgccgccgcggtgcaccgggcagaagaagtagtacaccgcgccggcgccgtcgccgcggtcggtgccccgggcggggacgtgcctggcggcgaggtcgggcggcgcggcggagtagacgtcggcgtcgtggatgaaggggagcttgatggtgtcgtcggcgatcttggggcgcaggaacttggtgatcagctcgtgatccggcggagagaaggtgaggccaccggccatgggtgatctctagtttcccgcgcccccgcgcgcgcgagagctagctagggttggaagcgatcaagcgatcgatcaacgtacaatcgaggagtaggagtagatatttgaattcaggtaggttaatttgattcgtgttcatctctaattcggctaggttattcgttttcatctcggataggctggtttggaaaaattaattgggccttcagcttaattggctagggtccaatttgactctcgttagttcgttggcttatagagtacgatgcattcaaatttgaatgtcagaagttaattaaatttggaattgcttcagacctcttccgttgttttttgtttttaagaactggcctctgtaccaccaagattgaaagtataataaaactgttactctaaaattgtttttcgtcatttaggtcgtgtcttctgcttataaggtgaagaaagaaaaaaaaacatgctggtgatggggttcttttgagggagaaaattgacattatgtcattgtcaaaagttggttttgctaaaataacatttttcaaatagacttcgttaaattaccactctttaatgttcatcattgctagaatacctttttggatgaaaatacccttcttacccatcttctctcccaaatatgtgcttgtcggtgacaatagagaaacaccagtgacaaaggagtggttcgggatgaaggcactgagcagcgagccgacgagcaaaccgtggtttcttgagctctagcatgatggctggtgtcctccacctcttgtgcctccttgagaccacttaggccccgcgctgctgttgaggtaggaagcggggatggcggggagggcaacacagagagtgcgatggagagagagggacctgagtggaggcaaagcatgagtgcggcgagccgtacgaccgtggctgcaccaaagaggtagtcaacaagagacaagcgcatcggagcttgatagaggcgcccgacccctcaagcacatccgccgacgtaccacgggctcgtcgataccttctgctcctgctgctcgtggccactaggtccttcgtctatggggattgccaccgggttcatcgacatgatgcctccacttcttctcaggtgggatgatgaagagaggcgcacatgcggatggttgtgtccgcgaagaggtgctcgcccacatatggctgtgttgatggagagaggtgttcgcgcacgaatgatggtgctggcggaggggtgctcatatgtgggcagcgacgctggggaaaagcgtggtggcctagtggggagctaggggtatcccgttccactactcaaaacgggatgctgtcccctagcgttcccaaaagttaatggtcaaatagcgattttgcaattcatttagtacctgtttcatattactacttaccattacaaaggaggtatgagagcgatccaccatatgcatacctagtactcatgatgcttctttgagccgtcatatatgtttcttcttaaattctaacgtaggaattttgtattacacgtaatatgacatgcacatgcttaataaaatgctattgaaagtatacatgcttattattagtggacacctggatttaaaacttgatgagcggtattatgcactcatgctgcatgattccatcactattcactacactacctataacctacaagaatgactagcgcatagcgctccgtccgaacgggacattcagatgacacctctgtctccctaaccaaggttaggatatagatgaggataaagacggactcagctagcccaacgaatcaatgtgcatggctctcaaaaaaatccgcatgtagcaattaatggttgctctccacgttgagcgctcctccttgagtttgtaggtcgggacatgcatttgtagtgcttcatcaactatattattaccatccatgtaaaaaaactatattattaccacactattttagtagtactaactagtatcaggtgatacttgctagctattatctgatacctgataggtatcacctgatactggatattttattacctgtttcatattactacttaccattacaaaggaggtatgagagcgatccaccatatgcatacctagtactcatgatgcttctttgagccgtcatataattgctagctatatccaccatatgcttctttgagccaccatatccaccatattcttatcaggtgataattgctagctattttagtagtactaactaggatcaggtgatttctacccggtatcaggtgattactaccaagtatcatgtgatatttatgaggtatcaggtgatattacgagctatcatctgatacctgataggtatcacttgatattgggtaggtaccaggacatataataccttagagcaagtttaataggatagtcaactattggctccaaatcatctatagtcaatttaatagccaattcatacgatagttacctataaacatgtactacataattaatgtctggtcccacctgttatacacacatgtatcttggagtccgtgctgcagttggctacaaatttttagcccgctgctcttatctctcctcttttatcttcttaaaatatgtttatagctggcttatagtatgctattgtacctgctcttagagatattaggacctgataactaaccggcatcatcatcatgctaatattaggatttgatattagcattctcataataagaaaagcacaattcttaaagagatgaaccataaagattaaaaaattaccattagaaagtcccatgtcttctcactttaagtatggacatgtcttctcactttaagtatggacacgttatgttgatttgcttagctttaccatactgtgctgtcaccaactcaggtactggtgtagcctgcctcctcatatcacgtgcccatgagcacggctgcatcacaccttggttagctgcttgtgtccgtgtgtcgctaaaggtatgattatgtacaaaatgagaatgacttatgtttgtatcggaggaagcgatcatacgagacttcataaaactaggatcccatgtagacggtattctgtacaatagtttttctgtatatccatataacaagaaatggtagatctccctttttttgcaagataaaatcaaagaaactgtgtttttctttatatttttgcaaccactgaaccacaaaaatactagtagggcagataggtcgaaatatatcaaaacaaaactccaaggcatgattgttccaccggccccctcttttctgcttgtcatcacccgcctacggcctatacccccacccaccccaaaccccaaaagcccagataaaatcccaaggaaggcgaggagacgccgccatttttcacacccaacaactaatccatccccccctccacctccacgcggtcagcgctcgctcacgcgacacgcaccaacccctctccccgccgccgccgccgccaccaaacgccgcctccgaagaagaagaagaagcctccctcgcaggcagcagggtatttaatacgccgccctgctcgtctcggttcctgggaacttctcttctcctccgatttggcctgtcagtgcgctccgctccgctcgcgcctatccgcggattatcatgggatcgacggcgctcggtggcggggctcctgctcgcctcggcttggcccccaaggtgcgtcacccgctgcgcttccccttctcgctttctttcggctcgttcacgattactgaattggattggattggattgtgcgtctcttattagttggttcagttgtgccaaggaaattgtgtgtgtctctctctatgcttatccagcgagctgtgaacctgacgagttgtacctagctacttctagttagttgacaatcgtagcttaatttgcgtcatcacttcattcgacgaatcggctgttaactcccattatcgccccttttaccactgaataacacagaaaattatactgctagaaatgaatgatagaatcgagaatgtggcgaagctaacaagtgctgttgaaatgtaccactgttgaaatgttctgtaataaggcatcctataaaggggggggggggtcttgctgtatcttgcactgaagttggtcacaagcactgaattttcctttttcctgatgcacaggatggagtctttggatctaatctgaagcaatgcggtggtttcatgctcaaaacaacccctaaggtgaatttttttttcttctttgtcatattttgtgaataagattggttcgttatactcaaaatactaaaagaaatggtcttccctgcaggttggatcctcttcagtccgtgtgagggcatctgttgcttcttcaccgcagaaacagcactctcccaagacatcaggagttaaatcaggggaggaggtgcgcattgcggttctaggtgccagcggttatactggagctgaggttgctacactctttctcctattccggctcaccacttctttgatatggtcccatttcattgaagatttctatcctctttggttcgattgctaatgtgttcaaatacatttgcattggcagattgtcaggcttctagcaaaccatcctcaatttcgtatcaaagtgatgactgcagatagaaaagctggcgaacagtttggatctgtatttcctcacttaataacacaggtaagatctttttctcaatccttggtgcataggtaaatgttttggtggtacatacaattattgtgccataaatttttgctggtcaaaactgttggataatgttgatgctcttttttcatgcaggacctgccaaatttagttgcagtaaaagatgcagatttttcaaatgtggatgcagttttttgttgcttgccacatggtacaacccaggttgttcatcctcgacatgccttatctgaatttccttttgttatctgcttaattgtataaagaaacagttatacattctgtcatatgagtttaagattttagaaattcttttaagccatatctgattgtaattttttaccaggaaattattaaaggtttaccgcaggaactgaagattgttgatctctctgcagtatgctctataatctcatgaattttctacgtaggtatcatttctgattcttgacagtcaatcattcttatgggtgacttaccatgtttgtaggattttcgattgcgtgatatcaatgagtacgctgagtggtatggccattctcatagggcaccagaacttcaggttttcctcgactacttaaacctagaaacctttttaataactaccgctgattatgtaatcgtgctattccttgtatctttaagttcaatctcagcatggattataattatactgacatgctcaatcccctttttgtatgacaattttttggtgttttgatttggacacctgtattcatatcataatttcagttatttattttgtgtcattatgtttgtttatatgaacttatttcctatatggtttatttttctgtttatttagcaagaagctgtgtatggcttgactgaagttcttcgcaatgaaataaggaatgcacggcttgttgcaaatccgggatgttatcccacatctattcaacttcctcttgttcctctaataaaggtgggggactaattatcaatagttcttagttgtgcaaatctctgattctaattgcatcaataacttgtcaactctagaaataggagtcctcagttatgtcatgcagttacattgaatctacaaaaaatcctctaattttggttgcacggaagctatattgatcataattttaagcttgtgagccattcttacatccatagtatctatatttttccttagcagtttgcttaccgtgcaggcaaaactgatcaaagtgagcaacattatcattgatgcaaaatctggggttagtggggcaggtatgcattttgcatgagatactctgactattaagtaattatatatatatatatatatatatatatatatatatatatatatatatatatatgccatcattattagctgatatgctgtgtaacacatgtattttgtaggacgtggagctaaggaagccaatctctacaccgagatagctgaaggcattcatgcttatggaataaaaggccaccggcatggtaattttgtttttttctagattagctgaaatcaacattaattatgtgaccttatactgctctttaacagaattttattctcctgtgataaatgaatatactaataatagagtgtttgcttatatttatcttgttagttacctttaaggtagcctttctttattaacacaatgtgataaaaccatgccagttcctgagattgaacaaggactttcagaggctgctgagtctaaagtcactatcagctttactccanatctgatttgtatggtaagcacatttgcactcttgttgacttagtaattccaggctctgtagttccctctgtgctgtaccaggaatgtatagaagttgctaaatcaaatgactcatctgtatatttaacagaaacgtgggatgcaatctactatgttcgttgaaatggcacctggagtgactgccaatgatttgtatcagcatctcaagtctacatatgaggtttgttgtctgatcatgtgggttaaattaactatatgcatatttgacagaaccactgtattccactgaagtgaattcatcagggtttagattcttttttagagggaatatccatactcttgatatcaaaagtatttatttactttatttattctgcccacatgcattttcagggtgaagaatttgtgaaactgttaaatggtagcagcgttcctcacacacgccatgttgtgggatcaaattactgcttcatgaatgtctttgaggacagaattcctggacgtgccatcatcatatctgttgtaagtgtctttcatctacatgtttctcaagcatttagcaatctaatgtcatagacttcagatgcataatcctatttcttgttttcaacaatgcagatagataatcttgtgaagggagcatcaggtcaggctgttcagaaccttaatctgatgatgggtctgccagagaacactgggctgcaatatcaacccctatttccttgatcctctatgtctgtgttccgtatgttctttgtcgggatgatactttggagttcagctacccatttccctctgtttactgttgagacaaggtgctcaacatcagagtgtaaccaagacaaattttctcaaagagtagcttggtttgtgctgttgtagtttttatagagataaatgacaatttagtagtttaatgagaatattagctcggtggatttgggcattgaaatcctacgggtatatcctgtactgctttgtggttatgaaatcaaataaaagtgtaaacctcagtcaagaggcatcaatcaccccgccttcattggatgtagatagggatatatattcatatttttactcgatggaatttgttttgcttgctaatgctttatgatgattgaagcattccttagtttaaatgtttctgagaagtgctcacatcctaaaccttgctgcaataattcaaccaacaagttatagtgaattgtattttctaggctataaaaataccattacctttgtttgggtcagctttgaatttctcttgttaggtctcaatttttgaaatgctttattaaagccctaatgatgtaaatgggcccttgcggtaattttctcacctgactccaaatgacaaaactagcattttgaactgggttactatgagtttcagtttaggtatttgtttcccatttcatatttactactatttttttattttgtgaacgttgcacatctcagcaaaactttctttctggttatactgatagtacataacctacctctgagttctgcccaaaatatcaatgtggtacatatattgccaggaggctgtaataagcagccaaagttgcacatggtgctacggttggtaagcgctagatatcttagaaacaattccagaaatctgatctggcaagcatgagcataatttgtggtccttaggtagcattcctcaaggaggtcctcacttgtatttctttgttggagaccttgttattggatatagttaggggggtgtatcttgcagatttttccagttaaaatcaattgttgatactttctttctggttatactaatggaagatgccatgtaccatttgacttgaacttgctagatgctaggaaatgcttttgcaacaatgtcagcctttgaccttcagttgtttatgtattatctctgacttctagttcatttctagttcttaaatatttcttttgtttagtttgaccacttgcataaatttaaagtaagatatatgttcgtctgtttctattcagctaatctgggggtatttttggtagtgctatactgtaggtgggccaattgagcatatggatggaaaatgccatttaactgttgatgcatcctactttttcacatgaatacatgattgtattacctttatgataaaaaaggctgattcacctgctgttatgttctttcattttcatgataatgacataaatgtaggcatttgggtattgtgttttctgcagcaggagatgctactggatttttttttcatagctcacgaatcatgatgggagtttgggaggcatgctgctcttacttttattttttatttaagtttgttatcgttttagcttaccctatttgctgcagtagtaagtttcctgtattgttgtcgcaaatgtgtaattgcaaacttgttaaatcagtagtagcaatttgcatgttcagagtaccttgttcaccatttcatgttattgttttgtatatatggttacacaagttagtaatgaaaactttccacatatcaaaatcttaaatgcttgtctaactagttgatgagaagcctggcaatggaaataaaattcagaaaaaagtaaaagtatgtttgtgccataaatattcatgctatagttttgaaatatgtttgatgagaaaaattagttactgaccattctattatattgacatttctgttgaagtcaacctataatttttctgatattttctgatatcaaatcaggcttgcaattcatt

SEQ ID NO: 42079 - DNA, 13504 bp, Oryza sativa
ttttcgcatatttgtgtatgatctatgattctaaatttttttttagataatatgtgattctacatttatttctatgtttattagaaatataagatcggtattaggtattccgttattcatgctatgcaatttggctgcatatcagcatggcattggaagtttccgagttcatacttcatacagctaaaaatcagaggtacaagtaatccacacctttggtcccttgaattcatttttctttgctggcatctgagcttcattttttattcccctcattgatcctctgtgtggaacaaagaggcaagaggaataaaaactcttttgaaggcgaaggggcattgcagaaatacagctcatcccttctgctacttgtaggatctgagtcatgtgcagctcctattgttgaggagatcagaaccggatcatcggataattcagattttgtcgggttactgcaaggcagagtccttttgatttcacatgctcagtgattttcaagatatacaactaccataatctgaatattatttttctctcctgcaggtctctggtaatgtttgcctggaactattacttggataaccatcagacagatgtcatattgtctgacaattacatctagcaacagactagcccagtctttgctgtgtccagatctatccagcaaacagtttaatttactcccaaagttatttcttctttaaacttagttcagaaaaaggtatatggatcactggaatgcctgtattttcagtgggctatcttaccatgagacaatgatgaaaactgtgtgcatgtgaagacaaagctcgagatctgcggaggcagtgtccaatcctttttgagctctgaagaatgattagattcccctccatgttcgtgcaagcctctcctggtagctccttgagtttgtttattggacgacttcattgcagcaacattctctacaatacaatctcataacatctgatcctgcattaattgctaagataagcccatgtttgttcctgttttgaacataatgcagtatatacttgttttttcattgtcctttgatgcatctaaactggggatgattttctctccaatcattgaaacatgtccttgtgacacttgcctcttgagctctgattggcttgacctcttaactgtgtctgatcttggggcaagtcactatcctgtctaccaacttgtaacagctagcagttgaaatttttttctaatcctcataatgtgcacaggggttgctatcacccccagttcatctccagccgtgggcatctatttattttaagcatgatttaccatttcttaatcctgcaagttgctgtgcttccattcaaccttttgtcttttcatcaggtataaatgatcctgccataacctgcatctcttcttcaccgagcacaagtgtatcaaactatcaaacacagcacggtcctcacaccacctctaacatctctcacatccaaaacttgtatcagaaatggagtccggaggggtgatcgcggaggcggggtggagctcgctcgacatgtcgtcgcaggccgaggagtcggagatgatggcgcagctgcttggaacctgcttcccctccaatggcgaggatgatcatcaccaagagcttccttggtcggttgacacccccagtgcctactacctccattgcaatggaggtagctcaagtgcatacagctctaccactagcagcaacagtgctagtggtagcttcactctcattgcaccaagatctgagtatgaggggtactatgtgagtgactctaatgaggcggccctcgggatcagcatccaggagcaaggtgcagctcagttcatggatgccattctcaaccggaacggcgatccgggcttcgatgatctcgctgactcgagcgttaatctgctggattccatcggcgcttctaacaagagaaagattcaggagcaaggcaggctagatgaccaaacgaaagtgagttaacctgatgattttttatcatttttgcgataacagtgtattaaggctgctgtttaaattgctggtgtgcagaatttgcatgctgattttgattgaaatggatataatgcagagtaggaaatctgcgaagaaggctggctcgaagcggggaaagaaggcggcgcaatgtgaaggtgaagatggcagcattgctgtcaccaacaggcaaagcttgagctgctgcacctctgaaaatgattcgattggttctcaagaatctcctgttgctgctaagtcgaatggcaaggctcaatctggccatcggtcagcaaccgatccccagagcctctatgcaagggtactagagatgatcttctgaattcactgtctaaaaacgttacagattggcaatctcgctaatgctcttcgtttattggatgcagaaaagaagagagaggatcaatgagaggctcaagattctgcagaaccttgtaccaaatggaaccaaagtaagattctgagaaaaatatcatcagtatttagtactaactgtagatcgttctttttttttaaaaaaagtagtaactgtagatcgtaaaagaatgccgacaactcaaacagtatggatctcattctcctttcaggtagatatcagcactatgcttgaagaggcaatgcattacgtgaagttcttgcagcttcaaatcaaggtgaggcttttcgcagcccatatgacaacttcagattattccctctgctcttgtcaaaattgctcagcaagttgcatttttttttctggtgaaaaaaaaaaactcaagttgttggttttcttgcagctcctcagctctgatgaaatgtggatgtacgcaccgattgcttacaacgggatgaacatcgggatcgatttgaacctctctcagcattgataagaaaacacttctaacagtgtcgagttacagaagaaagcagggatcttacttacaagttacaacacaatttggttaaatcagttcgaagagttcattgatcgttactacttattactaacatatgcaaccggtttctggtcaataaactgtgctgcacaacataatcccaaaagtaaataaagccataaaaggcccgatgcaatgttcttcagaagctgtttttttttaactcgtcagcagttaaccgaaggaatggattgtatggtggccagaaggatattatatatatttacaggaaatcacatagatactggaatactggaagaggctctgtaacttgtcaagacaagagagggcaactttgttctttttcttcttgagaagcaactccaaggaggaatttctctttcattttccttttttcaaatttgctctaggagcaaatttttgtctatagcagtgtatgcgaagtgctagtaccatataatataatgtttttaccttgagcttgcatataatgcgtcgcatgatcgtgaactgtcgttaaatatacattatagttattctaataatgcaatttatttttgtatagtggtttcttttctatgatcccatcttctcatgccactatatttatttgtttgaatcgtaattttaatcatgaagaagcgtggcatgcgttgcacattttctcctcgtcaatggatgcttgtatattgcctccattacctgatcattattgtcccaacaaatgtttaatccagctgttggtttaaattatttattcgatcaaatctaccggatttcctaccctgttctgggtaggcataaaaaaagtactcaattgtttgaaatactgctacaaaaaaaatcaaaatatcatcaacataaagctccactacttgcctactacataagatgcatccatcggcacattatcgacattgacatagttaaacttatagagttaagggaaacactagtcagtcataaacagtctcaactattttcataatcatttttttactcaaaaagttaaagctggaaatcaaaatggcataaaaaaaatcagaaaaccaaaaacagaaatatatgaatgtaaacatatcggtattgataaaaactagaaataaatatcggaaacatttaattataaaatctcacatttaactttacataactatatattatatattatgacaaaataaattcaagattacactatgtaaattataatttgtctcccctttaacctagtcctcaagttagggataagttgaggagttaataagcctctaaactatgaatcaaataaaaaatggaccataaatattgacatatttagatatttggtaattactataatataaaaaatagtcattactgtaaaaatacgataaaatttgaaaatggtcggaccacaacaaaattgtttccgtctatgtttccatatttttttaacatttctaattttgtttttatcagtacccatttttacattgcttgaccggtaaaaatgggaaatgagtgtcggttggttgggaatttccatgactattttcacctataattataagttatggaacaataagttatggactttgggtgttcaaatcccggtgtttgcaattacgcacatgcacaatagaaaatattgaggccaggagatttaccagttaccacggatttgtcttttcgagagtaataatcgagtgcagtcacgtgtgtataatggtgtgtgcacttctcagttttcgatgtaataaaagaatcacaaaatggagaaaataacacttttagagctcatttgaaatcatgaattagaaaacacactaataggaaaataaaaacatgaaagataaattgtcttgtattgttgaattcctacatgaacagagttcacatgaatttacaaagcatgtttttttttaatatcatacgaaaaacataggaactctatgactgaaacaaacaaatcatacggtttcagatgaccatatatgtaaccatgtatgcaggggcggatccaggaacaaaaaattgaggggcttaattacacagtttcttcaatctccaaccatttagggacatttagtttatcattcatggtgaaaaaaatcgaaggggatgctccgggaggtatccatgggttttgtgggtgtaggggtcccctgcacccacgttggatccgcccctgcatgtatggatttttttgcccatagagcatattttcagtttttcacctgtatttgctgatgtggcaaatgtcggggcccactgtaactgtaacgttcacctgtctgtcatgggctggtttcacgcatggtagtgggctaccggccagcccattttgaggtggtttggttacgccaaaactttaaccaataagttcagtttaggttcgataacttaacaacgagttcgattttcgttcttgaactgaaataccaaaaattacggatccctcaactattaaaactggtacgttaaaaaccggtacaacgtagttcatatgacaatatagcgggtgttttgtcagacatggcaaatttacccgagtcaacaacactgagttagcataagccccacatgttagggccttttcacctatctctcttttcctccccctgttcccatctcaccaagcgacgagtggtgaggagaaggccggtggtgggcggtgaggaggccaatggcaggtggtgaggaggatgatgaccgatggcctgttcccatctcaccatgcagcaagcggtgaggaggacaacagggatggcgggtggtgaggacgatggccggccagcaggacgccgcctctagaggtgggtggtaatgacgctctacccacacgctccaactcctgtcccaagtgccaccactgcccgaggtctagacgggatgacgagatcacgggaggtggggcggctgcgattttatccgagatctgcgtgaaatcgggatgaaacgttgcggcatcatcgtcgtcctcctcatctctgtatctgcggatccagatggcccgacgacggcgcgcggctacagcggtcaggggaagaggaaggggccaccacgagcctctctcgccggccgccacccttctccctactggctaccgccacacacctctctcgccgtctctcccaccggcctctccgcattcaccatgtcttccgccaccgagcttctccccgtcggccgctgtgcacctctcacgccagaacgcgccattagttgtcggctgccaaccctggaggtggaggcctggagagagatagagatgggaagagaggggagagagtgaacttaattgacatgtgggcccacgctgacccagtgctgttgactcaggtcaatttgccacgtcggacaaaacaacccgctatactgttatgggacctacattataccagggatccgttgttatatctggtatttcggttcaaggatgaaattgaactcgctgtcagttaagggaactaaaatgaacttattccaaactataaactgtagttatccttcagtaataccgaaactgcagcaaactgctacttacaaagctgcatatgtagctcaaacttgtgaagcatatcctttactgatctgatcgactacagtattgactaattaacatccgtgcaaaatcttattgatttggactacttaattagctagctattagagcaagtatagcagtaggctataagccggctaaatgctaagttgtaggagagaagagaggagagagaggagaagcgggctgtaaacttacagccggcttgaacataagaaccaagaaactctgtgagagagacaagtgggccctgtattaattgtaaagagctaactattatatgagtaggctgaaaaaaagctacaaagaaccttatagctaacaggtcggctatattattagccttgctcttagacgaggaagataattagctagctaagtctaatcacgcagcgagtacttaataaacaagtgctgttatgctgtccaattcgggtatccacttcttttaacccagcagattaggcactggtcccttcacttccactgatactccttcttctaattaagtaaacttccagatctatcagctactaccttcttgtttttgtttagtgttaactatcttatcagcataggtaatttactaccttatcatgcatgcatgcatgcagtagcagcagcactgacccattattcagtttggttaaatttctctgaagccatgtatagatagacagtagtgcacaggtcgttttctggcgcccattttcttcgttcggttgccccttctagctcgctaagtgttgctgcttgcggtcatatgtatataggagtgtaaattgcaatgtgtaattagttttgtgttgcgaactgatctcacctacagagcccagccccacactgtcttgtactcttgtggatgagagatactcatactctccgtattcagaagagaacacagttacacagaagatctatatatatttatgtagggaagagaaggcaataataaattaagctagtgatcatgatcagctagctgatctcattctagttaattaagctgagtatattggttaattaacttaattgcatgtgtgcccatcttgatacaagcacctaatagcagcagttgcatgcatggttacttaatttaaccccatgcattgcctgacggtgaccctaaacacaccccattacattgttgattgtgtaattgtagatcacatgacataactgtaggatcgcagtaaaaactaaactgaccagaggggtttgtgctctttgttttattgaatgccgctaaatgttagaccacctgcaaaggggaattgaccaaaaacattttgaaaaacccaatcgtttcactttacttttccccttgtccctcattagcccaagacactcccacagaccagaaagcaatttatatatgcaaatccagagcatctctaattatacacaagcaaacactgccaaaggacatctaaagagaatatgattagttgattcaattttcttacaaaacttgcagaattcatctccccctccactttctcttaactaattgttctcttaactaattgttctacacatggtaatctccccctgtctgctagatataaaaaatatttaatttgtaggatcgtaaaaggtcttccccatagtcaatgaggtgaggggctcccctacttatgtattaggtctctttcccttttacaaccaatgtgagactattcatcaatctccccttcacacattggtgtccctcagccattcactcccccttcagtccctcgggtatacttccacggcgcatcaacactatgtcctttgagccagagatgttgaactagctagctctgataccaattgtagtattgtaaaaggtcttttctacccaaaagctagccaatgtgatgaggggctcccctatttatatattaggtttattgcccttccacagctaatatgggactatttaacatgattttcagaggcaatttacttttccaaatctttcacctttctgcatctatgacccctctaaaagtcaggattatatacactaatttagtggtgaaactcttcttcttgttatgatgccaaaccacttgatccttcccccccccccccaaccatctaactgataactgttgatcatcattcttaagacaataagcttatcctgtctctgctgattcagatttcttctaaaatccagcttccattcacccttcacaaaaatatcactcacagaagcctcctgatggtaacttatctcatataaatcaggaaatttaacttttagagacaccttgtcacacgatacatccttccaaaaatacacagattccccattgcgcacatctttctctacaagcttttccaaccacttctgcaatgatgtaaccccttctaaaattgagatccaccgtcagcagaacgaccaaaagaactgccattgttcacatattttttcctaagaacctgaaaacacatatctggagccctattttccaactttatcatccacttactgacaagacaaatgttcatcaccctagtatccagcaagtccaacccaccataatcttttggcctacacagaaatgtaggaattaaaatcataggattgttttctatatgcatcattggtttcatagaaatagatctaaaaaatccataaggattatagtcttattaccttatttcataggattcttagtatggggtaagatctcttagaaaaatttataatgattggaatacatgtgacgtcctaatccaaagcatttacctttctattcctatgatttagaaatcctttgaactgaataagcacatggtgaaattagaatcccatctcttgtactatatggtaggggggaaaaacaccaatcatcatcttgccctcaagactcttcacgatcaatcctgtccagaaagtaaaaccgggatgacaaacatatacttggatttcactgtcaattcagcaatgctctgatggaacccgaatgcatcctttggattatattccctgtcaagctgccaaccctaccaccagctcccctcgatatttctcatctagtagttgcttacaaaacttttcctgtcaaaaagatggctgatttgattaattacttggctgttctgaaacttggctattaggatcgactgatccgacaagctagcaatataaaaattcagtgagaaaacattgcagtcagactaggcactataaaggcgccaccttggcttgctccagcctcgcaagcaaaggctcccactgaccccatgccactcgatccgtctctacaaagattacgttattagcttgaaggtttatctcacagagactatctctaggctgagttattttcttcactttcccaactcacctctctcgtattttgtgtgtacgattttcaaaatactaaatggtacattttttgtaaaaaatttctatgcaaaagttgctttaaaaatcctattaattaatttttcaagttatttttagctgatacttaattaattatatattagtaaaccaccctatttttggtgtggggaggagttccaaactcctgaacacaacctcgtaggagaaggagaatagggtacaccgaaactctttaatactacttcattctttttttcttcttattttagccatcatatcagtagtaccctttcctcatttcttcttttcttccttgttttctctctgaatttaatgtattttaatcttttgcttttgcttaatatatcactgactaactaaaactatagtctttaaaaactatagtttttaagggattgacggagtatatgtgcagctaattattgagctagctcgacgatgacacaccgacagacacaacatatataggcttcgtttattcagcgttttgttggaagattgggtatttgatatatacaggagtaggagtcaaaagtaatagcccgggcaatggggaaatatttgacaattctcattgacggtagatggtccacttatatgcatagagtttttgaaatacacatatacaggtctttatatatgctaaattttctcaaataagtattttgcttttgtccacaaacgaaacatgaaatcgggtagttgattcatggttgactgtggtcagtattgagttcatccgtctttggttgatttcatatagtcacttaaaactatggagccgtccactgttgatcttattatacctcttaatagaactgttccaatttcatttctatgtctaaaccagctacggtgatttttagtgacctagtatctaggcaaattttgctatagaaaatcgtgactttgcggttttagctataggacaccgcgtaaaatgacttttgggtgaagacattctcaaaagttagatatttgctggtggatactggacccattaaataataatttttggttgaaggggagagataaattgtgtgaaaggtctaaaatgtccttggacccacatgtcatatctccatctctcttctctctctatcccctccttccacacaggcacaaaaccatggcgacaggcttcggggagcaagaggagggttgcgacgatggcgacaacgagggagagagcggcggccaacggcctaggccttgccaggccagatcggcatcaccgccgtggagccctcatctcgccaagatcgccgagccatcggactccttcgcgtcagcgtcgtcgtcgtcttcctacacctcctcctccttgtcgtcctccgccaagagcactcgccggcggatatcgctgcgtgacctcctcctcagcggcacggcgaacagcaactccgccatcgctgcgggcgccgccgccgccgccgagaggtcatcgggcttctggcacctgtccttttggccatcgtcgcgatccaagaagacaacaatgctagcgctgccctactcatgcccgttcccgccgccgctgtagcctgcgcggcgatccacctcgccggagaggtcgtcggtgccgaccatggctgtgttcctgtgtggaagaaggggataaagagagggagaaatgagagatctaacatgtgggcctaagggcatttcagaactttcacacgatatttgtctcctcttcaatcgaaaattattattttattgtgtctagtgtctaccagcaaatattcaacttttgataatgtcttgccctaaaagtcactttgtgcagtgtcgtacagctaaaaccgcaaagtcataatatcctgtagcaaaatttgtctagtatctatatatgtggcgtctatatgaagcaccatgtcagcttcttttcctaggtataggtacgtggggttcatttgtacttaagatgaagttatggcatggaaaacaaaaagatcattagcgcattagttttaattattttaaacttgaaaaattaatttatttgatacttttaagcaacttctatataaaaaaaattcgcatgaaatgcactatttagtactttgaaaaacgtcctaaagaaaatcgagataaaatataatctatacttaattggaaaagaacaggacttactcactttgtccgaaataaaaatatcactcatcctaagagaactttaggagagaagagaaaaaattgcagtatccatcattaatagaaatatagcatcgatcagttggtatctcgataagagtatcgaagggataaaatctctttgattcataccaagacacaatctctatgaccaagtcatatatacccattttcatcaccaccttcctaggtagtcgcaccgctctctattttccaactaaggcgttgtttggtttagagggtatcgaagaggattggaggggattgagggagaataactccacctcaaaatagatgtgaaataaatctcctctaatctctccctcacagggattaaccgaacaaggtctaatggatcctcacaaaaatatggtgtctcctcttttcacgtgatatgatatagctcggtataaatttgcaggcctcttttaatttcctttctcattgcttcataatgctctaactatttatctttctctcgtctttaaaaagtgttacctgtccatcaggaaaaacaggttatatatgatctgcataatttttctaaggtactccctccattttttaatagatgacgccgttgaatttttctcacatgtttgacaatttgtcttattcaaaaaatttatgcaaatgtataagatataaatcatacttaaagtactatgagtgataaaataactcataacaaaataaattataattacataaattttttgaataagacgaatggtcaaatatgtgagaaaaagtcaacgacgttatctattaaaaaatggaggtagtagaaaggtagaatgccgagaaaattggacaaataaatgttgtttgttttggtttctagctaggctttagtcgatgtgcccccatggaccggaaactacattttagttacttaagtcttgcttcatgaccgggttacacgatcgtaattaaatatatactctttgtttagtagtagtacctacttgtggatacgtggctgcctactaacttgaaataattagggcctaaatgagagctttaatatattttttaagaaaatacttccatcatcccaaaatataatactactatcagtttgtggtaagtcaaacatctagcgaagggagcacgaagtattatatatatatatatatatatatatataactcgatcacatatccgcttatcactactagagaaaccatctttgccaagttggccaaaaaccacattagtcccgatttaacaaaaaccgggactaaaaatgatcttttaccccggttgaaaagaccaacgtcattttatgatctttagtcccgggccccttgcggaccaccgccgctaccgcccccctcgcgggccgccgctgccctcaccttgctttctcccgctgctaagttaaaagaagagggtaagagagaggaaatatgagaggataagaaaggaaaaagagaggaaagggaggagaaggaagttaaaatgagaaggagaggataagggtgagggattatatattatgtattgattgttagtcccag

SEQ ID NO: 42080 - DNA, 15277 bp, Oryza sativa
agcagcgggagaaagcaaggcgggagcggcggcggcccgcgaggggagcggcacggcagcggcggtggcctgcgccagtgcggaggctgaggccggcgcaagagagagggccggcggtgccagctctgtgcgcaggtggttgagcgggagggcagtggccgcgcggagttttttatcagtgatgttttgttgatttgtgatgtttagatttgtaaatttgtgatgtgaatggtaaatttgtgatgttaatctgagtatgttcatttgatctataaatttgttgaagtttttgtaaatgtggatgtttgtttttgagtttggaatgaaatcaatatgcaaacagcaaaaaacaatgaaaaaaaagaaaaaccttttgtcccatttagtgttatcaatagggactaaagatgatttttagtcccgtctatttcaactgggactaaagatcgctatctttagtttcggattcgtagccccggtttactacccgggactataagaggttgtaaaccgggggttagagagggtttgttcagcagtgtgtaattagaagtacgggtttaagaacatgtggttgttgggggagaatgtagtatgaaccataaccatttgattaccgagaaaatttgatctttttttcagttcattgagaccaaattatcttctatgccatccaaaagattatgaattctaaaaatggacagagggcggagggggccgctgtcatcgcattcgcccgccaccgctgctggagcccgcgcccaccgccgtcacccaagccctcacccggccgtcaccgctagagcccgcgcccgccatcgctgtcggaagggaggagagagaggagagaagatgggcagatcgaggaggtggttaaggaatcgtatgtgaaaatgtaagtcgatttttacagacgtgaccagcagttatagtttgtctatagaggtactcgtacaaaaaaaaattatttttttaagtagtatatgttaaacaacctaaaataactcacgttaatggacgtagggagtagctgattacctaatttatcctacgagtgaactagaaggtccaacgtctatagatgctagcccccctgtacgcacaaaccgtgtgatctgagccgtagcctacggctgtgttctaactttttcgttatataaactatttagacacatgcattgagcattaaatgtggacgaaaaaacaaattatacagtttacatgtaaattgcgagacggatcttttgagcctaattacgctatgatttgacaatgtggtgctacagtaaacatttgctaatgacggattaattaggcttaatatattcgtcttgcagtttacaggcggaatctgtaatttgttttgttattagtctacatttaatactttaaatgtgtgtccgtatacgtcaaaaaaaatttcaccaaaaacaactaaacacggcctacccataggctatagctaagccttcaatgttggaaacaaggggacggacggaatttccctctcttgcaccatggtgatgaacaaccaaaagccttgatctgaattgaaagccgtgtttccatgcacatatgaaaaaaaaaaactaacttgatttgatacatgcacgcgtattacgcgtactctcctttgattctttgacccatatctaactctgcttgcaacctatcaatgcaatgtgctgctgctgctgctgcaagtgttcttgccttgccacttacgtggaagaaggcgactgaattccgggaggtgatctgtgtctcctgcacacgtacaggagatttattgggcggacaggagagaattcagggctcttctttttgcatttttgcaagcctttcttcaatgcgttttccggtcgtcgtcggttgcagttgcgtcgacatgacatgaccactttagtcttagatatattttggccaaaaaaaaaaatttcttcctccctgacgaaaaaaatgggtgacagtcgtttttgttgctcacagactcaactgtttgggaccttcaaattctgagcaacattcgcgtaggaatctgaagctgaaaattctgacttacagatcatttttttcaagtttcacgactataagttttatgattatatttttttttaaaaaaacctagatgaaaagctgacatgttttaaaaagttcggactctttaagaaagtgcagctgataggaactcttttaatactatcttcggtctaaaaatcttaagacgttgtaatactatcttcggtctaaaaatcttaagacgttgaatctggacaggggttcagttatggtccgttgtccaaagatgaatcaaattttatcgtaactactcaatattttgtgacaatgaaagtaggttctaatctttcttcacgtcagtttcattggaggctgaagttattgaaaccgtctgcaatatttcattagttttttcccacccttttttcctgccctggtttaactgctcgattcggaggccaaatactggagtactgcgtactgtttgtgcaacagagcagagctacactagtgttgctttactcgaggacaagaaaaggcagcaggccagcagccagctactactagcagcaacctgttgttgcacaggatattttagaacaagctgtttctagcgtcccaaaattcggatatgtctgaaatttctcatggagaaggagaaggagagagatgggttaatagatcgattagattgcctttcattaatggtcccggttaatgacagtacgatatggattgtaggggtgttttcggtatttcatcattacgtataacccactatactctagaaatagcttatattttacaagagtaggggtgtttttggcatttcatcattacgtataacccttgatgctctagaagtagcttacaatttataagaaattcaaacactacaaatagctatattttttattttaagacagcgagagtaaatgtttcattgtaattcctgcaaaagaaaaaagaaatattgctctcaggtagcattactactattacatggatgacaattaaaagaaatcaataatgaaaatcaatcgaacatatactccctcccttcaaatataagcatatttagaatttaaatttatacataatataactatttatggaacattagctttaatgtacgagaatccaagcatttttaaccaatcaggtgcttagagagatcgaaacaatttaaaattttaactaattaataacgtgactaaaagaaaatcgtttctgttattttaacctttactaagcaatctagaaatgcttatatatctttctacagaagaaatgagaaagagagttagttgattaagtgagcatgggtcagtcaaatgtctactcaatagctttcgatgtagaagtttaaattaaaaaaccccaaaattgtcaccatgcatctcagaatcaatctcatctcatctcatctcatctcacttggcttaggcattgtttagttcctatttttttttcaaacacatcacatcgaatctttggataataaaaaaagtaattgtacagtttgcatggaaatcgcgagacgaatcttttgagtctaaatagtccatgattagccataagtactaagtaacccacatgtgctaaaaggcgagttatgaaattagttttttttattcgtgtccaaaaacctcttccgacatccagttaaacgtccgatatgacatctaaaaattttattttcacgaactaaacactctcttaaatttctttctccccaataggtaggtatagctagctggacaaaacaagggtattcttcaggcgcgaatccccgcttgtccgtttgtctgaaactctgaatcaatcagtgcgcatacatgcatacggacaaccctaataagcagggtaatgtagctacaaacacaagtcaagaaagagatcacaactgtggtccattccaacatgcaactgtcatatatatagtaattcagcggtccaaaaatacgagggattatattttggatagatgtgacctatcttattattacgaatatgaagattcataatatcatatgtatcacatatatctaaaatcttttatattttaggatggaggaaatagcgtgctgtcacagtagaagatttgagcaagctagctagcctccatttctattcaattccaagtgccacatgctgtgcattgttcgtgcagataactgtgtgcacattatggtggtgtggtcactgggcaaccattattttcagtgtatgtgtatccatcggtttgtaattgcatatgcggtgtattaggaatggtactgtgtttctgaatttttctttccctggaccctggaacataaattattctttaagttgtcgccatgctcattattatgagtttttttatttttaaaacctttttatcaatatgttttaaaaacaaaccctaaaaaatattcaataattgaaaaagaaaaccactaaaaaaatacacaacatatgaaaccaggaatttaggtaagagcatctccaacagcatatctatcttactctccaagttaaattttagtaattttggatgaaaaacacactccaacatacttgccaaccggatggccaagccatctggttcgccaaactcctccacgcgctagccaaagttgccttgccaatcgtgggccccatgcgtgggcccacgaatttttcctctctctctcctctcccgtactgtctccttcccagatcgagcgccgtcgacgccgtccatcagctgtgctaccttgttcatcaagccgtcgcccgccgccgtccccccgctgtggccacgagctgctatgacaccagccgctgcgccgtcttccgttgtggcagccaccatcgtcccgctctgctccggccgtcttccgcggttgcacgagccgccgtcctcatccttcccggggacaggagggagggcgcgatggccggggtgcggggagcgagagaggtcggcgaggaacggatccacgcctgtcgtcgtcggcatggccatcgcctcgcgcgcccgtcaccgttcgccgtccgagcgttgcctcgcctcacctgtccgtcgtcatctaccgtcaccttacacacacatgaatccgctgtcgccgcggaggtagagggcgctgggaggagctcgtggcagtagtagaggaagaagggagcagtatgggtggggagaaaaaggggagaaagaggaagaagaaggtaatagaggctaacatacgggtcccgctgccatagatttagaatagagagtgtagatagagaggttgttggagtgatcaatgagtttgacttgccaaatcagatggatagttggctatataggtgtttggagagtcaaatttaagtagtctgttggagatgctctagccagcttgggtgttggacgaaacttaaggaagacgctagctcaaaatatatatgaattgtttttgtttgaagactagtttttgcctactaaactgttggcattttaaatagttcttttacaagggtttgctattgaaagttgccaataacatacatatttattaaaaaaaattgatagtggtaaaagttgtcaaggtttcgacaccatttctgataaattggcgggagctatacttttcaatatataaggctcgcaatatctgagtgttctacttggattgtaaccaccagcttaatttctattatcaagaaaaagatacccgagtactttgctttggatgtatgaattttacaggatcatcacaataaacatatcaattcctgtgaaattcctcaaaaatcctactttcgaaatgatgtcctgtaggctatgcgttatgatgtgtttagatgtttcagagttgtgccctgaaaaatggagtcgatcggttcacttgaggattcacgtggacgcttgatgcgtgatttcttgctgttttttttatccaactgtttgtgctgatgttttggtagcacatgtgtttacagtaatggtgattaatttctactgaaagtgaactgtacataaatagtagcaattcaataatgtaatcgcactgcgttatctgaaaaagaaaatagaacggcatctagtagatgctagaactgcaaatcacatgtccttcaggcttcaggatgagtagtgacttctttttttttttttgttgagatcgtagtagtattaattctaccactatagatactcgacagtaattattttgaccaaccagctgccagtgaatttggacaggtcattatttatgtcatataacggcactgatctctgcgaccccatgaaaatacatcagcaaccatttgatactataataacttgtgataataactaagaaacatcaattctttctgatgttaacttatacatttcacatcaaaaccactattagcttgatatgtgcatccatctgacatgttccgtattttcgcggcgaatgaacttgtgagatgggtaatatatcatgcacccgtacgtttgttcctactgaaaaaagtggatgaaaatttgatactcatggcacgctttttaaactggtaaactgtacatttcgtacaaaaacttttgatatgaaagttgctctaaaatatcagataaatctatttttcaaatttacaataattaaaactcaattaatcatacgttaataccactttttttcgtaaaacatttaattattatttcatcttcatgctcgaattggtgcaacaattgttcatcacccatcctttgcaaattgcagaacctatcctttggtggcagagtagcccttttccatgatcattccgatgccaaccaagtgtggatatgaggtggccatatataaggcatgcatgggagagaattttaggtcagagtcctcaagatgccgtgcaacatcagatcatgagattataatcaatcgaccgtatgctttacttacttaaaaaaatgttactgtacaaaactcttaggaataaagatctcaacagttcaatttcaatgggtaattatagaaaatcaaaagtgcaaccatagtacgcgacattaaacatactcagtgaaaagtaaaatatgtactatatatataatatgtactatatataaaagtaaagtagaatatgcaagagaactacgtatcattacattaaaaataataagatttaaatatttacgtgaccccactaactaccgtggtgacagaaaaggataggaaaaaaccatccaaatcctccaggaccaaagacactgagataacaaaaagaactctaatcagtacatcacgaaaacccttcctccagctaagccacgaaaatccttcctccaaaatcaatacatcattttgtataactaccctagagcccgtgcattataacggaaaacaaattgagtttctagcttattgaattaattaattagtctaagtaattgtatgattttttttattgaataagtaggtgattttgaaatttggggaaaatgaataataaaatagtggaggatttgttgaaaggtggtctaatagtatagattgtaaggcctagctgttagtgatagaggtggtgtggaaataaacaccaccactacttatattttaagtagtatatagatcaatatatcaatatttccttttccatgaaatcaatatattttactttatattgaaaacactatagggtttgaccatgttttgcaccactaaacacgtcattacatcagtttgagtatcttacaactttttacactatactaaattaaacctatctcatcacaagttcataaaccactaattaatgcaatttactttctaaattaaatcccccaaattgcgtgcctctaatcgaacaaacctaaccatgatctgatccaatattattagttcaatccagtttgccaagatgacacagctagcgaacacacaccaactctacaatatgtgttttgagatttacaatgttcagatgctctgcaatatttttaggccagatgccagtgttgtctgcattatgtcccaaagtttccttttcttctactcacctttcatcacttcttttctactactgctattagattttttttcccctccaaatccctgggtcccacaacggatgacacgttagtcaagtggcatttgtctgaagctaaggtacacttgcacaagaaatgcagccattatttcttggccacattaagaggacttaattagatcgtcgtttaagtttaacctcggcgtcatggacgaaatcaaggaaatgcgtaaggacatgaaatgctacaaaagaggtggttgggaataccctctcaaaggttgcaacaacaagcccccatttttatataaagcctgcaagcctgtgcctgcctgcctgcctgctcttgttcttgatagatggggcattggatcacgttctgtttagcattagaattaatagccttgaccagaccagagttgggttaattttttttttctgtcatggtgatgtaatgtgtgtgtgtgtgtgtgtgtgtgtgtatatgcctcagctcagctggatgaagattaaattggacaagaatttgttttgtgtcattttttttttggcatccattgatttatgaatgtgtttcagtcttgacaccttggcaaattcgacaagttttaggtgaaaattgacgtgcacagtactataagcatatagttgcaggcttgcggcagatttttgtgtggctaagcatttctttccagtttgatggccgaaaaattcagttaggaaatacaaactgaatttttgatagacacgtcatggatactgtttgtgaattggacccgaccaaattctggttccgcacaagtggtcaagcctagcttttagatcaaagaatttgaagtacaagatttcgtacagtagaaagtacaccactactctttgagattcataaatagtatttgacatttcgggcaggattcgatcaaattttcaaattttctattaaaataagtttataaaatctaataagttcatgatgttataattgtacttttcaagaaaaatatatacatatatcattttgttttgtttttaaactaagaattttgagaagtaccgatgattgaaaaattaaaagcctgactgaatcttgccccaaatatgtttttttttaccagagagagtataccaccttattcaagaaatcaatctgatacctttcaagtgctaaggtactaggaggcgccataatatgctaacagtaaaatgtgtgacaactcccgatattgaagctcctccatttcatgataatccatataattctctagtttctttcggtatggaccatcaaaaagataacagtgaccttgcttgttataatgacagtatgaaattttgctaagcttgagcaacacattttgacgaagtgagatgctcaaggtcgctcacaaggacaaaacaaaaaatagatacactacctctgtctcataagtgtagttgtgattttctgtgaccaacatttgaccatccattttatttaaaaaaattatatatttttttaaaaaatagttaccataaagtactatttatgttttatcatctaataacaataaaaatactaatcgtcaatatttttcaaataaaacggacgatcaaacgttggacataaaaaaccacatctacatttatattgggacagagacagtatttttttaatatatatgtatatgttttggataactaaagaagagtagtggagtgagagtgtgagacactcacttaaatagcggcggctcaaaggcgatgccattgccaccacctcgctctctccttccttctccgaccatccgctcccactccggcggccggagtccggccgggagaggtcgcactcatggctgtctagccggtgagccgctcatcggcggtcgtacgtcatcgctagctaagtagctagggggtcgaacggttgtgggtttgatggaggcagaggacgagtactcggccgggtgctccttctccctcatgtgccaggaggatagcaccgacctcgacgacgacggcggcggcggtggctgcttcgccggcgacggccgcgccgacctgctcctggtttacaatgccgccgccgccgccgacgacgaggatgaggaggaggtggaggagtacatggaccatctcgtgtccaaggagagcagcttctgctcctcttcttcttctacgtcgtcgtcgtcgtgctgcttctccgacgccggcggcgagtcggcggcggcggcggcgccgatggactggttcgcactcgcgcggcgcgccaccgtgaagtggatcctcgaggtgaatgatcgttttctccggtttgggtttttcttgatggaacagagcatctctgacctgacatctcgccgccgccgccgccgccgccatttgcagacgcgagggtgcttcggattctgccaccgcacggcgtacctggccatcgcctacttcgaccgtttctgcctccggcgatgcatcgacgtgggttgatctcgctggtcaacggttgctagctatagcttctttcccctgtttcttggatggcttccattgatgggtcatgggtgtgggtggggtgcagaggtcggtgatgccgtgggcggcgcggctgctggcggtggcgtgcgtgtcgctggcggcgaagatggaggagtaccgggcgccggcgctgtcggagttccgcgccggcgtcggcgacgacggctacgagttcagctgcgtctgcatccgccgcatggagctgctcgtgctctccacgctcgactggcgcatggccgccgtcacgccgttcgactacctcccctgcctctcctccaggctccggcgacacgtcggcggcggcggcggcgcgggcgcgtccgccgccctcatcttctccgccgccgaaggtatgacacccacatcgatcgatcgatcgatccattgatgcgttcgaggaggaaccaatccgtgtgctctgtttttttttttggttgcagcggcgagcgtgctcgaccaccggccgtccacggtggccgccgccgcggtgctcgcggcgacacacggcgcgctgacgagggaggcattggagtccaagatgagcggcctctccccatctttcctcctcgacaaggtcggtcgccgtcgaacacctgcatgctcatgctcatctccatggattattaacaaaatctcccttgttttggtgttcgatcgatcaggaggacgtgttcgcgtgctacagcgcgatgctgagccagccaacttcaccggcgagcaagtcgacgacgacgacgaccggcaagagatcgtcgtcgtcgtcgtgctccgagtccaccgacgccgcgagttcatacgacgccaccgccgcctccttcccggcggcggcgagctgtggcagcaagaggatgaggctggagctgccgggaggcatcctccgatgagcggcggcggcggccgggacacgcatggtttttgtccgtcgtctcgagcacgtcatcaccatttctcttccaatttccttacaaatttttttcacttctttgatcgatgcaacagcatttgccaaacaatttgttcttggcagtgcgctcgctgatcgatcccggattggattggcttggttaaattaatcccagcagcacgcgagatcgagaggatcaaacaaacaaaaacaccaaaaaaaacacaaaggatatcaagatcgatggagcttgatcgagcttctcctaaggagaggagaaaactcaaactgctcgtgtgagacagtgacagagtgagtgagagtgagagtgtatcactgtacacaaggatggaagaaaaaaaaaacactttagcctgcacattgcactcacactgcacttcccgggaaggagtcaagaagaagagagagaagctgaagaacagtgctactaggaacagtagctgcagataaaaacgatgggagtaatgtctaatccgtctgccagttcaatgcaagcgaaggagagagcaaagaaagctgttgctgcagcagctgcaagtaccatggtccatggccttaactctgatttgatcaaaagccttctcctgctcaaagtgagtgtgtgtgtgtgtgcgcgcgcatgttgctactatggcggcgccggtgcatggctgccaaatgcatgtggctgctacactggttgcctgtaacctgtagtagtgagctactgccattgttgtagcctttgcaactttgcattgtattttcttgagtgtgtgtgagagagatggataattcagacagagtttgtagggttcttggttgcaagcttttccagtctctcttgtgtaatgtgattgctgtgatgatcgatctactgatctctgaatacggtggtggtccttcggaatcgaatcgatcgtgcagtgggcgatggatggatggcaaagccgggcattgcagcaggatccgagggcgacttttgccgattggctccacgttggtgctagcttggtcgatcgacaactactctactagtcgatggctgctttgtgtttggatctgcaacattggatgaacagtgggaatggcagagtttgcagctgtacttgagctttcggtcaaggggctccctccctcacacagttatgaactccttccctgtcctaaaatataattatttttaaacttataacatagtcttatatatactattttaattaataatatctataaaagtaagatgttttagataaaaagagttacgtatctctttaatgataaatttagtaacatgagttttacgtgattgattttttttattttttcgttattaatagtcaaagaaaaaatatttgactttacactattttaaaaatgtttatattttaggagggggaagtaatggctagccttgctagtggagtctgaagaacttcgtactcgctagtcagagtggacggcggagagatggggggccatcaagacctactaatcacgtgtagtaactctgtttggaggggaggaaggtgtagatttgttttgtaatttttgggtttgggatcaaatctgaactaaactttaatataaggttttgaatctattatatcaaaatggtgaagtacaaaccatggttaaaaattttgggtctatcaaccctcctatacgaaatttatctcccaaatgttttggattttttttcatttttttgaatttggcaaattttctttaaatttgatcaaaaattttggaccgaaattaccgcaatttctgaaattcctgtcctattggtacccctggtagaaatacacaaaacaaaattttgaacctggtacaaactatggatcaatcactcttttctcaatcgagtatatatgtaaatgaacatggttaattaagtacacattatttgtagatataatcgcagccattgacattcacaaaggttgattgtttcaggtcaataattggaaatagattaacaagggggatgtgacttttgaccggtctttgatgttttatctccactttgattttgtggtttctagtggagagcacagatcaaattaagattgaattggacgtagggaacaaggaaaggaagtgaagtgtgtcggacaatcaaaggatgttacagatgtccaggttgtggtaattaaggctccacaagtcttgtgatttaacttgtgggcagtaacatatttatgttaaaatctgtgaaaaattataatatagttccaattatagtagtagtttattttgtacactatctgttccatattttaaggctttttgatttttttctagtcacatttctttaattttaatcgattatatagaaaactttaatagcatttacaacacaaaattaatttcattcaaactaacatttaatatattttgataatatattaaagccggtgaaatatctatttcacctatttcaaaatactgttaggaggttttgtgaagttccctctcactttttagagaaaaaaaaacactcttcttgtttggtttaccttattgaacaattattggaacggtctcaaggtgttgttttttacgttacctaactctttccacttttttagtgtagtttatgccatttttcttcctatccacttttagggaatatttcttcctatctaacgaacaagtcattttagacttttgcaccgtaactacggagtactatcccacctaccctcagcacgtgaaaggagaagttttattccttcaataccctttaactacctatcactcttacaacttttttcaatgattaagagtattttagtaattctcactttccactaatttctcttggggatgctaggaatggtcgctttgtggacggagggagtatatcttatagctaacgatttttcttgcaattggcaaacacgagtcatttgagaatagtcgtgatgctggaaggccaaaggagggaagtgtattttgacagtggtttctaccggtagtagtcttccattgccagtattatcagtagaagctatctaagccattatttttttttactggaatctaagccattattttgagttgtactatcaaaaaaaaatattccactggtaatataaatagatgtgatccattagataagacaagattaattctactaccaatagaccaccataaaatttatcatatgaaaatgcttaaataccatgatgatttgttttatagaaaattcaaaaagctaatagagtactacctccggctttaatatatgacgtcgttaacttttgaacataaatttgatcattcgtcctattaaaaattatataaatcatcatttattttattgcaacttgttttgtcattaaagtttcttttaaacctaacttatattttttaatatttgtataaagtttttaaataagacaagcgattaagtcactcgtcatatattaaaaatccatatattaaaaactggaggaagtacaatacaaatttaagtaatttcaaaacagagtaaatagcatgctttaaacatgatgtagggaagtgcagattctgagattctcctaaataggcattcatctccatgatcagaaaaggccctaaggctgccctcaccgacccaaccggtgtgcagccattgcatgaatgcaggtgtttcctcgcgctgcccggtgcccgcctgcactacttatgacttacagctggtaaaagggggagcctttttgctctgtttctcagctgagcacgcactgcggattgtgttgtgcgagcgactttctgcaacaccacaaactctgcctccctgttttttctttttgaaaaaaaaatgaaagaaagaagattacgtacatttttacataatgaaataaatcctga

SEQ ID NO: 42081 - DNA, 11571 bp, Oryza sativa
  unsure (1)..(11571): unsure at all n locations
tagcagacttcaaagtcaactatccttctcaatgaagtcctgggcaggtggatcggttgtaagagagggctacgtcaaggtgatcctatgtcaccttacttgttcatccggcagatgtgctccaatgccttcttagagcaaaccctgctctggacaccatctgtaccctcagagacctcgtacagctctgcagtatgccaatgttatattgattatttgacgagcttcgattgcttatgtaacaccactaaagcattgcctagacgagttttctagggcaacaagtctgcaaatcaactttagtaagagcacaatgatatgcatctatgtgggagcggaggaagagtctcagctgattcacactctgcaatgcaaacaggaatccctgctaatgtcctaattaggtcttcctttgtcaatccaaaagttgagaacagcagacctgcaaccaaccattgcgaaggccgacaaattcttagttggctgggaggcgcgcttactctcacaagccgaggctaggaagagctctgtggagaggaagaattgaaaacagaaaaatatactattctgatatcttgatctcgagtgccaactccataatcattatgcgggagatacagtacaacgtttccgatcgtgcttgatgtgtgttcctccaagagccgactcataggaggtgttgaaaatttcctaagcagcagaaaggctcggaaaaacattttccacacaccattgaatgtggcaaagaattccctgaagaaaaatagaatgggggctaagaatgagaaatactaacaaaaaggtatactccatggtacataggggaaaatatttagcatagggatctcctattttgttaatgtaatattcaagttactcacagacaatgtgttataaggtttatctctccacttgtcaatagatgccgaggacaagtagatatctgtagatgtctagaagtagctgttgtatctagtgttgtgcataccgtaaatttggttgaaacaagtatcatttctttaagttggttttattatttttatactttcctaggcaacattttctgcatcactatcacattagtatatctttacgttgccagcgatgtccatgacttatagtatggagtacaaaaccttggagaataaaaaggacaataagtaaataacacttatttgtccatatctatggagacttgaatataaagacctgagagaataaaaggacaataagattcacttgaccacatcctggttagattattagctagcacaacctaaatattccagaagagtattttttttagataatagatattttattaatcaataaggtacataaaagtatctgttagaacttctctttttagatatgcactagcttgctagatatgctcttagtcaatttcgtaaaaatatctattaaactattttctttcaaataacaaagcctaccaaacattttttgttcttgaacatgtaggatagctgcatatgattttatttatagacgaagaaaacgattttttttttaaaaaaaaacaggggtccacccgcttacaactcttatctcatagacaccacgtgaccaacaggaacaatcaaggctgaatttagcagcataacaatgtgcagaggctgagctacataggagagggggatgatcaggaacattgtctaagaattttttttaatatagtttatctattttcactatatatgcacccctcaattcaaactctagcattcgtatcagcctaaacttgatcaaaagtagagtaaagcaagcgagtgggacccctctccatttcgttccgccctgccaaagtgtaccttcctctttaaccgaatgcactactaaacctaaatttaggataacatctttaaaaacgcaatggttgcagtgcttaattccaaatctaccaagctggtaggataatcaaggagtcgagcccttttcgttgtagcttgtgaacttgtttgcttgctcggtatcaccaacttgaaagcctaccaaacatatatatgcacaaccttaacaagatcaactaaggttagattagacggctggcatatactattgggctaatcaaccaaagtacacgaggaacacataaaaaacatctgtggaataggctgtttggagtggttactgcaatgctgcatatggttgttggaaggaaccctgctccagccaagaaaaatatatgcagctgcagcccggtcaccaatgcagtcaaacaatcttggggacaaagtttgctgaaatttgttggttcaaaagagtaccataccacctaggagtgagtggccacctcactcaccgacctgcagaagctgcaggccgccctaataaagcagtgtaaagagacactgagccacaggattaaacaatggagacatctgatctcgcaaatgccatcaaattaaaggaccctctgcaattttgccaagttgatctctggtgatcagttatcttctcacctttttgtttctaccctcatgccaagatcagagaggaatataccagtgtatggctacaaacatgtactatgacactatgtgatgtcttgatgacatacacatgattgccagtgttgggatcctggacaggatagttttttttttccttggagttatctgtagaatagtatagtgaaaatcttggttgtcataacaactgtctccattccaaaacataataacttatagcaatgaatctaaatgacaaatctataaaagtgtttatacatatttgtagttagaagtattgcatttaaggacgaagagagtactgtatatgtatgtaccactatttatatggtatgatcagggttgaaaataattcctcaattcacatcgcaatattcacatatactgattaagatgttaatatcagttctccacttctacctattaaagatgtgttcagtaatgcatatatcattctgatatgtaatatgtacagtacagtagtagtaatctctttgaaagaaatgtactccttggtaaggaatggcagttggaattttatactctcatctcatgtctcaagtctcaaccgaaagcctgaaccagggatggcatgcttgcatcaactgcagcagttgtcagggatggcctatgcaactgcctacccccagctggcaaaggatttgcagtagttggactgtaggagtaagtattcaagccttcaaaggacctcacctcatcacctgctgcccaaagacaagggatccaacaaaaaacacagagataggttgctagtgctagcccagccttgatcctaggcattcatcacgattcacacacaccagtactgccacatactgtaggtgtgcaacctctgtcgtctggctctgaccttggtcaaagaatcattggcattggcatagcatggcaaccaattcagatcctgtgcggtactgctcactgacatgtgggcccgagggtctgtggggcccacatgtcagtgaaggaccctcactccatggcaacctatctgctttttattttctgtctatctgcagcagagacactgctcagctctggattttttttttacattttagccatttttgaaaggttattttacaattatacatatataaaaaacttattctagagattgaccctttttctcggagctagaatcattgacgccaagattcaatgtcttggcaccaatgacactagcactgacaccctcgaccccttggtagctaagtcgttgatgtgaagggggtcgacgcttatattttgaccctttcataaaaaaatattttactaataggttcttgccactggtctatttagtgccgaccgctccacaccttggctgctaggggcaagggtattggcgctcagatgttagaccttggtgccgaggttactggcgctgagaaaaaagaccattcttggtgtaaacttgtctaaagatctatttatcccttgtgtattgtactactccatattgtactccacaatgattcttgtgtattgtactactccatattgtactccacaatgattcttgaaggctactttgatgggaatggccaggtttacttatggtttgttcagatttcaagaccattgcaggtaagcggcggagctaggaaatttttagagtccgaacaaatctaactacacagagcatttgctataaaaattatattttcaatcctacgataacattaaattcaattgtgtatttgctgacgagcacaacagtcgaccatcaattgagttttattttcccttgtttgcttggtcagttcgattggctttcttatcatggccattctgatcttctttctgttccaatgataggatgagattgttaaaatctatttatgttttgagtggttcccaagtgttttatgtttatgttaagttgagagtagtggtgttttcactccattttgtgtattaactggtagggcattaaccaatcatgaaggtaaaagggcgtcaacttagcataactctgctagcaagatcccttatggtggaacgtgtctcaagtctaaacttgacactggtgcttatatttatgactgattatttttccagtggtacacaatttacatatcgataacgagacgtctatgatgactttgttaatatatcggtccagtcttcggaggtgctcataagggttaagtagtgcgggtgtgtctctcatgcatttgtatggggtgtttcggaaaaaaataagctagagggcgaacacatgaatacatgatatatttataaatatcaagtctctgtaattattctgcagtagcaatacatcataaactcaacacagtattactaaaactttctattggctactaatgcaggcaaactcatacaagacatctctttgtgtatctatacctttttagttacctaaaactcaatatgcaagcgtagcaattattaatcctaaaacctaacatgtaagtatatcacatcaatgtaagcacctaaatctaatcttaacatacaatcatactaacttatcattttcgcaatattttaatccaattctatccataatttaatatattcatttataatatttccaacgcactaggcgtcacctagttactgctatgtttgaaccaagaagaaggactaggtacatctattcacaaagtgccctttgcagtatatggactaaattatatccgcccaataagaatacatgatgtaaatctgatgcaaacttttcataaccttaaacataagttaaatgtgcgtttctatatggacaatctgaaatgacattacctgctgggttgacatgaattattcaaaataattggatttttcattcactagcatggaacagctcatatgtgtcggcgagggattccatcacaaatcaaaggtcagtgatgtgaaaagtcatctttgttgggtcggccgccgtcacgaatgacaacatcattgtcgggcttaaataaaagaccatcacggatgacattaccacccgtcacgtatgagagtcatccgtgatggttcataagtatgaaccttcatggatgagaatttatgatttttgaattttaaatgcataaaaaaccctaaaatattttaaatattactaggatattctaacaatggtcacacattactactaagaaattcttgatttttcaagtgatatatgcatacatgtcatacatgagattcaaacctaagacctctcaacacatacaaaccaaccttaccatctcacctacaaaccacgttacattggtaatcagatgttattcttttaactattcatgtccaaatatgaaacacaaatttgaaactctagatgacttcaaatgagaacgctttgaactacaaagttgcagatctcatcaagctctacaactttagtgtagggtacatctccatccaaggtcgtttcaaaattcaaaaaaaatatttttgatatagatcacatcacttgaaacacttattcggagatgaaaacaatcttaagtgaaaatattgtcaattagacagttgtagatcataaaaccctttgactttgatatagacactattacaaaaagggccaaaggtgccgggtcctaaaggggccataggtgccagattttcatccggcaccaatactagcaaccgacacttataaggaaaatagaaccggcacctttagcattgctcgagccaaaaaaaaaaaagagagccagctcgaatccgagccgaactcaccaagcgttgtcaccgcgcatgcgcccatctcaaaatcaaattgatatccccaaaccccaaaatcatccacaaatcatcaccaaaataaattgatatcacagaatgaacatattcaacaacaaattcatcaacaaattcacaaaaacatcaacaaaaattctagcgggatagatccatgtcgatctgaagagaagaaaaagagatcgatggcggtggcggcgagagtagtggatgaggatccagatctagagaagaggggagggcgccgccgcaacccatcgcccgctgcctgccgcctcccctcccgccagatccggtggaggggaaggtgccgccaccgcccatcgcccgccacctcccctcttgcgtcgcctcctgccgcctcccctccagccactgccgcgcgcgagagagaagtgagagagccgagagagagaggcaagagagagacagacgagagagatggagagagaacagataaggttgactcatataggggataaggccgatgtgtcgggctagatcagctcagctcggtttggacaggtcccggtttttaaaaaaaccgacccctattatttattataggtgccgtttttttatttaccgacacgtataatatattnaaggtgtngggtttttttnnnnnnccggcacctatgctataagtgtcggtttttctttagaactgacacctatagtttcttaaaggtgctgattttttgtgttttcagcccgtggaggaggaaaaatcattatatgtgccggttttagctattccggcacctatagtgccgatctctatgggcttttttagtagtgaggccatgtctccatcggagatcatttgaaaaattcaaaattacgtatttcaaaatagctctcaccacttataatgcatattcaggcgtgtaaactatctcaaattcaaatagtatcagttttaaagttatagatctcatcgagatctacaactttcatatagggtaatttgaggttgtttgaaaatttcaaaaatttgaattttcctcatccgtgtcagttcataactactccctccatcccaaaatatagcaacttttgtttggatgggatgtatcctagtactatgaatctggacattaggcttatccagattcgtagcactaggatatgtcccacctaaccaaaaattgctatattttgggatgggggagtatcaccctttacagataacattatccgtgaagggtagtaattaagacccgtcgcggatgagtgctctcatctttgatgggtcatatcattgcacctgtcatggatgacatgttatccataacggggtatggctatgacccgttataggtcatctgtgacatgttagaactatgacccgataaagatgactttaaatcgatgacggggcatggttgtgacccgttataggtcatccgtgatgtgttagtactacgacccaacaaagataacttatatcggtgacggatcatcccctatagttatatcttaagcgggataccttttgaaccattagagatgagtcatccgaaatgggtcgcattcactcgacacagatgactcgtcaataatggtcggatctgtactagtgattctatcccttcctccttccaagttccagcaatggacaagaaaattacactactagagaaataattattaacaacggaagacttggtcgttaaaagcccaaatgggatcgttaaagttcattaacgaccactaattttgtggtcgtacgtggtcgttaaagcctccgtcgttaatagttttaacgaccacatgattttctcccgtcatgatttcattacggcctgtttggttggagggagtttttaggagggattgggagtttagagggatgaggctattaagtgttttgtttggttgaaagacatgggaattttgatgggatggggatggagaattgaggaaggaactccctccttttcaatacctgggtaggggcaggtaattgggagggaattcctcctttactttgtctaagcaaatctcagccatccgtttttattaatgacctaatctccaactaaactccctatcaatttccatcacctttaccaaacaagatatatcgagattaaaaattaaattccaatcttaatctcatcatcaattccctcgtgtaaactcccaatccccttccctcgagttaccaaaacggtgcttttttgccatcgctatctcattaacggcgatgtcttttttacatcgttaattctaattaacaaccgtggtattgtgtcatcataagctttttaacgatggtagtattgcgtcattgttaattattttaaccatctctgttaacatccaatgattatcaccatggtacactatccttgatagtagagaaccatacaattgcagtctgcacatctaggaattaacatgcatgcttatcaccatatattctgacacaaccaaccaaatttattcaattgaaatacataataataatttgtttggaacatccaactaaataactaagtatttcaaacagaactaacatcttagtttctatcaaaattataacactcaatctataaatatgtgattggaggtgcagtggacaattcctttatcattcgatcccatcatcattcgcaggtattgtcttcagatgcaccgttctcattgtctcaccattgattctatacaaccaacaaaaaatgatactagctagttaaaacgagctgtatatgtggtacttcatacataaaattcgttaaggcgcatgagtttacctcttatgatgtcattttaagtacgcatcacttccattcactgcacaaaaattgatatgataaaacaaccccacatactttagaaaatcgtagtgttgagaggagccaatttttgcagatatgttgtgtgcacattttatattcgaataattgtttgtccatgttgaaaataaagcacaatagaacattttgcctaaacaaagctagactgaatttattgtgacctaaggtagaatttaaacctaacaggtgcatgttcaaataattgcttatcttttgcagtaggattaagaaagaacatcttattctgaaaagaagcttaacttaccttcttgctcaaggaatgaggaatgctttgtcaccaactagcttcatctaagtcctgtaaattcagagagctttactacatttatatttcgcaattagtattgtaacatcgttattaacccatgagtactgtaactcatcataattgagatagtgtcagcagtagcttcactgatattgaatagcactgaaggaatcatcaactagttaaaagaaacaatccatcggaggcatagttattaggaccggaccgacagtccaacccaaaaaaaccggaaccagagccctcaccggtttggttcgattaaaaaaccgtctgtgcaatcgagtcggtaaaaaccggatgaaccggtgggttttcctttgaaccgggcggttttttccttagtaaaccgctaaaaaactggcagtcacgtggacgtgcgtggccaccctccgcactagcaggattaaatgccataaaacagcttgaccatggttcaacccatgacctgtgcctgggaggaaagattccctaccactgagctatgacttgtattgtgcatttgctatagaaattactatatataaactggattaagccggtggtctgaccggttgaaccaatcaaaccgtgaaccaagcacttgaccggttcaatgtccggtccagtcctaataactatgatcggaggtgtcatattcctatgtattgcatctaacttgttgtgggtaacaaatcaagcccatgaatgaccgacaatggaggaactattggaaacttggaatcctacctgaaaagtggttgctcccctggtactatatttgggccaggccaatggagtgtactaatcttgggttcctactaaaatagatttgaactgaaaatttctaaatatataaccaatagaataatctgaaaacaaaatgatgcacaccctatgtaacaccctgaagattcgaccgacaaaaatctaaactctaaaaatatgggccttcaaaaactttttaaataaactgcataatgccgattttatttacctattccattgaattttgatttcggagtttgtagaacgcaaataaagaacaattgattaggaataaaacctaaaattaaatgagcaaaataaataactgaaatataatttaaaataaaggttgaggtgaggatagaaatgaataaaataatatcgcgatcatattcgtattaattaaatctaaatacgacggagtgagaattaactctaattaaaatcaagtaaattatataaaaataaaatatgggtacaattaatctagagtggatccattggttgggataatacacatattgagtaaacttcatttatgcaagatttagaaattatagaatcaaatttatataggaaataaactaaaatcgggataaatgggaaaatacactgttcattatggcataggtgttcgatgcagtccctagccttccccctcctctcccacctctgcgccctagccggccttgagcccacgtcgccgccgcccgtcgcgtcgccgctccgcgccgtcaccgcgcgccgccctctcgccgcctcgcgcccagcgctcgcgcgtcactcgcccgtcgcgtcgtcgcctcgcgccacgcgccctgccgcgccgctcgcctgtcgcgtcgccgccacgtgccccgcgccgcgctgcccgcccgtcgccatcgccgcctgccgcgccacgcgccgcccgtcgcgtcgccataagccaccgccccttcccctctccttctccccctcttccctataaatacttccccctctccatttcccccactccatctccctcttcctcccctcttccctctccaccgagccaccgcctttgtgtcaccgcgccgctgcaccgccgccttcgtgccgccgcgctgtgcgccgtcgtcgcgccgccctcgcgccgccgcaccgccgccttcgtgccgccgcgccgtgcgccatcgtcgtgccgccgtcgccgccgccgccgtcggtaagctgccacccccttcccttgttcggccgccgtcgccagagagccgagagagagaagggagaagaagccgggagggagagaaagagagaaaagaagaaagagagaagaagaaagagagggagagaaaagagaaaaggaaagaaaagaaaagagaaaaggaaaggaaagaaaaaaggaaaaagggaaatagaatagggaggttaatagtttagaaattttaaaataattataatttaattatagattaattatagtcgtaga

SEQ ID NO: 42082 - DNA, 24455 bp, Oryza sativa
  unsure (1)..(24455): unsure at all n locations
tggtaatttccataagaaatcaatccgcggtagtaatttagatgtaattaataactaaacaattagatgaattcttatagactattatagattattttttgggtaatctctataagtaatcgattcacggtagaaattcggatttaatcactaggaattttagacgtatattatatttaatcgtttagtcatagactaaattaaatcgtataatattataagataattttaggattccgtccgatatttagctcgcgatagaaatttctaacatattatatggatataatgctagggtagattaaattaaaaacttatgataacaaaatatttatacccacaaaatagtttaggatatatagatcgaaattgggtttgccctagttcgcgaatagtaaagttaatataaaagaatcgactttcgcattcgacttccatttggatttacttggattttatttgaattctaaccgaattcaaatcaatttttgcacgtaactatagagcccgagggagttgcggatccaagtgaaggccaagacccgcaagactttgagcaaggcaagtcatcactattctttgaacatgttgatcccaattgcgaaattgttttgtttacaaataaaatcgcatgcaatgatgaacatcctacttgtgattatgccatgccatgattattgtttatccttaaatccttgtaaccatgatttacgtataagtccctagtcaactatgacaaatgcttagaaatgctactctagatttatgcatactcatatttatcaaatgatatatgcttgggcaattacctttgggaaggtaattgagatgcggcatgtggagacatgagcgccacattgccatgatattgatggcatgatttgtgaaaggaaaatgaaactaaacaaatgttttcgactggggcggatggaggatttgggtggtatccggaaaaggctagtgccgtccctggtcaattaaggaccgagccatgaagttaagcatgaaacgacccccgtacaaccgtacttctcgaatgggtatagacctagcggagtagatagctgagcggaggcagtatccatgcatagcagttccttgatgtgtgaggcaggggctctacggtggggcagccattggtaggaccgcgaggcgggtgtctacagtggtgtcgccatcggtaggactgccatgtgagaatctaaacataattataacttaatgcatgtgtgagtcttcacttcccgggtgcgccagaactcctctcactgctagaaaccgtgtacgtctagagtgcatgaggatgtaaagttcatggagcgggtactgccaatgcgaggttatcaaaaggctttgccgtgacgcgtctcatgtgttgggacgaggctcatgtgttgggcagtcgcggagtgcgggtaaagtgtacatccactgcagtgtgagtaaaccaaatctattcgaatagtcatgctcgcggttattgagcaccgggacatgtattacacttggctagactctaaattcttaacttgtgtggaatgggatattgcatgatgatttctatgctgatggagccacttcctgagaggcgggaaggtggacgtcctcagaaaaccatgacgactcaatggcgggaagctatccttgggatcacaatggatggtggacagaaccgtcattgtataatatgaacactggtactaaaatttgatcagtctgtgctaggtcttaggcttgtgaaaagaattacaaaacttgctttgcgcaaaagaaccatagccatcctttgaatacccttgtcatatgcattgttgttgtggtggcttgctgagtacggttggtactcacccttgcaatatacaaacttaatcagaggtcggagatgaagcttcggaggatccctacgcttactaccaggagggtgatgaagacgatggcgctcagtaggtcttagttacggtcgttgcctgtggcaatggcgtgccgctgccttaactccgctgccttacctacttctgtttttggaatgtattccggaccgctcggtccgatgatttaagactatgcttgcgggcttatgatgtaataattcgtactagacactcgtgtatgtgcacttagtatttcagctatgaattcgtgtgtaccagactacttgatccagggaaatggtactgtttacatgattgattcctgttataaaaacgggggtccacaccctatttatgtcaggatcattcaatcggttatgtcatatgagttttgctgaaaagaggttaatatcttgtgccgtactgcaccattcagttgttcttgccagatcaagctgcctctccattgctattcaatgctcatgaaattctttagtacaccgggtgtgtttagatcacatcaaaattgaaagtttgattgaaattagaacgatgtgacggaaaagttgaaagtttgtgtgtataggaaagttttgatgtgatagaaaagttggaagtttaaaaaaatagtttggatctaaacaaggcccaataaacttgcatgctatcaggtcaataacctaataactctaaataaaataaagcaatcagtatatatcactagactatcctgcaaaaaaaaaacaataatctgcagtgcaaaaaaaactaactcaagaccatgctgcgtctgctgccaagcccagtgactcggtttttgcagtgcagcacctcagcgcaaatcaagtactaactgcttttgtatatagggttcgcgatgttgatcagttggagttttcgagcgtaccaaggggagggtggtgactagagatcgaggagaacaggtggagatcgatcatgttggtgtcgacaagggcagatcgaagatccagacgtacggcctcagatcctctcgatggcgaggtgcgcccctacgtacggcgcccagcctcgctcggcgcaggtggaactagaggcgacggccagcgacgagttggggtgggaggcggcggccgtcgtggattagggtaggtttcgtactttagccggcgtagttgggctgggctgctcttgctgggcgcgatgctggagtcccgtgtagttgtgggcctcattcacgtcaaatttaggaataagtttatttgaggccccttaactttacaccgattccgattttcatccttcaaccaaacaatcaggtacaatcggtccctcaacttctaaaaccatgcaaacgagatcccttgacggtttggaaggcagttttggttgatgtgacgctaatgtggctggtttgacttggtcttcgtcccacttggcatttgacgtggcgcttacgtggcaattcgaatccggaaaaataataaaaatcgtagccccacatgtcagctacacacaaaaaataattaaaaatggtggggccccacatgtcagcctcacccttctcttcatacccgcaagcgagcatgcgggcagcgacctcagcgaggcggcgccctcgacgacctcacgcgccaccaccgcactccacctccgaggcagtgggcagtgtaggccagcgaagcggggcgggaggagcgacagcgaccactccactcctctctcccttccccttttcgacacgtgggcggcagagggcgcggagtggtgatgcggagcggcggcggccatagtaggctggcgaagcggagcgggacgagcggcggccgacgcctgcgtctcgtttgggcttccaccgtttggctcattgatccctccccttctccgagcctccttgcgtcgccggagcggccgtagttcaccgctggaagttcttcttctctcgaagtccgctgctaatgccgccgctactgaactggcatcgtgtagatccatccgtctctgaggctgttggtgatgaactgtaacttcggaccaatctattcattttgttgcggattactttgatttgtgcatacgaaaaaaatttccagaacattttggggattcagctaggtttccatgaaaactccttggtagatcagtctgaatactaaacctggaactggtttgcctttctttgctttgagacaaatggaagaggagatggtgatatgtaaattagcaacacacatgcatttcaccgtctcctttgtcgattgttttcgaggcaaggatgaagttgggttgcgtcgatctcatctggtatacgaggggcgccattgagattcacattctttatatggctagccaacaagggtaactagggtagatgtcacgctgcagataacttagcaaagagggaatggccacaccatcaaatttgcttgctctgctcagcccaggatgagctgtagacacttgctcattggttgttcatagaccaattggacctggatgttattgcgaggctggatgaggtttcaacttcctaaacatatgcaggtaaagctaaaacaaatggtgaatggcgtctatagattgaactttagaccaatttagagaaaggctttcgtctcgctgctcatgatgatctattggctggtttgaaaggagcgaaatgtaagggcgttcgatcagcgcccacggacatctacacaactgttcaccgacatcagagacaaaactaaaatttggaagcagctcgaccttttcaaagctcctaaagattgataatatggagttacgctgttgatttagattatgtatgtttatgcacatattgttatcttatcgacagctagctgtctgtcaaaacacttgttatttgttgtatacattttaaacctccctttaatattaagattcggtcaacccagctgaaaaaaatatgcttacaaactgcagcaatagtcgctgttttttagggcagcaagactgtcgtgcccggatgaacggtgcagtaccacatcttagctcattaagttcgcttgctatgatcagcccatgatgaaagttgtagacattttctcagttaaatcttcataaaccaacaggatctagacattgttgcgaggttggacaaggtttcagattcctggagacatgcgcactgtcatcttatcgatagtttttcgttgaaacgctctataacctatacaatacatttgaaaccttcctttaatattaagattcggccaacctggctaagaaaattataattacattctctaaaaaaatcgcaacaacaaagttgttttaaccgagaagaattggacacaaacaagtgcaagacaatcgtgcccggatgaagggtgcgggtaccacagctaagggtgtgtttggttacctgtattgcacttggcccgcatctggcatgcaaccttcgacctgtttggttgtacacagccaggcccacatgatgtaaaaaggcccatggaaccaggataaaagcggaaacgaaaaagtacaataaaggtccctcatcttgtcatcggattacaaaatcgtccgccaaccgcaaaaccagatatatgacatccctcatctcacaaactggatcacttcggatccttagacggttttgaccccggtttggtctgacgtggcagctgagtcagcgggggacccacgtgggcccacacgtcaggttgtccacgtcatctttctttccccttttctctcccttcctcctctcactcttctctaggaaggcatggtggcagtgcaaggtgggaaaggagggcggcggtggccagcggcgagcgatgcggcgtcaatgttggtatttcttaacgtcacatatagaatccgcaagcgcactgaagataccgatatagctcttcacctgggagtattccagagtatcgatttccacagggaacgtgtgagttcaactcctcgtcaggtttatccaaggacacaaagctaatgtgggcagagagctgagaggattttctaatgagaaatagtgtctacgaaaagcttaattttaatcctaacgcaatacttcaggcactggcagccctctattcccagatgtcgctctacaacgtagccggactcttgagggttatcaccacctctacacccacctcaaacgtactgtgggatacgcagcaaccactgaaaattaattacccagacaccacgtctacgcaattaataactactctagtgcccgatcacacactaaagcaatcactataaaataatggactatagtaaacaatgacccggtatgctaattaggaactaaccaagaagtaattctcactaagcaaatcttaattactcataataatatttctattaaagcagcgtaattaacaagatacaaaagtaggagcagattaccgacaactccggaattcctccgatttcttctatcttactctctccctattgtaatatacgataaagtacactatagcctcttgtaattcagttcatgctttggtgtgtgtgaatgagggagaggagaggggtatttataggtggaaaggtgccttgggagagtggagatgctccaagcatcctatgagcatattccttctagcttcatctcctcttgacaagtgtcctctttatgacggtttccaccggtagaaacggccacaaccgtcattgggatgaggagtccaaccgtcataccaaaattgggctggattgggccagctggagggttcgaccgaaccctggttggctcccctggcccacatccttcttcaggatgctgacatgtgggccttattttatggtactccatgttttggctccaaatgattgcacattttatatgttgtagcttaaaaccatgtgagtccatcaacacaaaatatatttctattctttatgctcattctctcccaactttggtggttgatcacctgcatactaatatacaccaacactcgtgaaaattgttagaaataaatcctaccactatgttggatgctttatatctatggttttatgcaagtattgtcggtgttaatttggtccttaacagccgtcaacagtcgacgacgacatgggagaaggggaggcgtcgcaggcatggaggagggcgttggagtagaggaggcggcggcgacgagggagaagggtcatcgatgatgtggtccaagatggccgcagcgtgcgcggtggcgtctccgggacggagacgacaagccctctccactccagttgctggaagtctcgccggtgcggtggccgtgggtgctgactccggcgcacctcgccggcaccatcggccggtagaagaaccccctcgaagccgtccatctctatgccgatgcgccacgccgctttctgccttcggccacctccacgtcatcgcgcccgccgtcaacgacccccagcaagcgcgcactcatccttgtcttcgacggcccgggactccacgcaccctgcacgcagcgggctcgccatccacgccacccccgccccccggtccccctcgagcttgatgtgggcctaggcgcggtcggcgtagaactcggcggtggcggggctagcctcgattgcctgcgtgtaaagctcggtggcgagctcaaagtcatcgtcgacgaaggccgccatggccttgctatctagatccaacgcaccggcagttgccatgggtgggagaggaggaggtgagccaacgagagggcggggaggccggtggcaagaaacggagagggagaaggcgtggtcgtcgagggagtgggggaagccggcagtgagcgctcacagagagggaggaggtggggccagcgagggaggcggggaggctggcggcgagcgacggagagggaggaggctgggccggtgagaggggtggctggcgagctcgctcgctcgctccacccggtgctgtgtggtgaggagaaagaagaggaaggaggaaggagaaagtagaggaggatgacatgtgggccccacatggggcccatcatttttttattttctaatgtaactggcatgtgggcccatgttttaattttttttttgattgaattcccatgtatgcgccacgtcaataccacatgggacaaagacctaatcaaaaggagaaaattgacattataccattgttaaaacggggtttcgctaaaatgccacttcgcagttgggattcgccgaaataccactctcaattgaggggcttcgccgaaataccattttcttttgattctccctttcctcgcatctttgttgacctatttaaatcaatttaagcacataaaaaatacgtagattacaaagtaaataccgtcgaaataattttacatgcaatttttctccacaccagattacatagtatgcagcatactatcaccacaatataaaaaacactctcaaccggaaactcttggtttctagtgatataaaagttctttttatttatgttgtggagatattgtgttatatactctataatctggtgtagaggaaaaatatattacatgtcaagatatttggacgatatgtactctgtaaaatacatagttgatttacttgaattatttcaactaggggtattttggtcggcaaagatgagaggaaagagataattgaaagagaatgatatttgggatgaagcccccttgttgtgagtggtattctggcgaatcctaaccgcagagtgatattttagcgaaaccccgttttgacgatggtatattgtcaattttcttagtcaaaagagccacgtaagcgctacgtcagccaaaaccttacacaatactgccgagggactcatttgcactgtttttttaagttgaggatgcgttgtatcggttttacggttgacggacgattttgtattttggtgacaaggcacctttggggcctatttagttccaaaaacatcacaacgaatttttggatatatatatatggagcattaaatatagataataagaaaaactaagagcatccccagcagctcctctatccggtcctccatcccgtttttggcgcacggaggtgaaaaacaacgctccagcagaccttccatcacacacgccatttttggaggacctccaaaccaagcccttcccaagccaaatatggaggttctctctcctcatgccatcctcaaccgccgacctcgcgctaccatatggactgcataccgtgggagagaggaggtgcatactggatttggaggtggagatcaccggagtagaggcggagaggcagcggatctagcagtgaggtcgccgctgtccccaccgctcgaggtcttcgcccactccgccgctcctctgaccccgccgcccctctgcctcgccgctcgcgccgccccttcgcagagactggttggtggtggtggcgggccatcggcgggaggaggagggagatggacccaccggccacctcccgtcgtccgtcccttgcgccgctcctccaccccttgcgctgcccgcgccgctcctccgaccgcgctacccctccgcccagccactcctccgactgcgccgcccctctggtcggccctcgtcctccccgtcctctcggcgccggcggtagagaagagagaaagacggggagatcggcggtagagaaggtggggagtgaagagataaaggtggggagttttttttaggaaaaagtacgaattacccccctaaactatcgcggtcgtctgaattaccccctaaagccgaaaaccaggtatcactcaccctgaacttcttataccggacgaattaccccctgactgtatctaaagtggttttcgtcccacgtggtgtacatgtggcagtccagtcatcatttttttaaaaaaaataatcggggggacccacctgtcagcttctctccccctcaccccctttctctctcttccatcctgctcaatctctctatgcggcgaggacggtggtggacggcggtgtcgcggggagggcacggcggccggtggcccgagccgaggagaacggtggaggcgacgggcggcgctgaggaggacactggaggcggcgggcggcagcgctcgcggggagggcgacggccagtggggcccacgccccgaggaggatggtgggggcaacagcggcgatgactggctagaggaggatggtcgcactcgcctcctccgccgccagctcgcctcnccnnncnnctnnnnnnnntncagggnnnncgcncttgncacnctggcagctctgctccgcggcgtgtggcgcngntnttgatccacctncaccaccngnngccnanncagctccncctccgcctcngtagcccggtccaccaccggcctccgcctctgcccctttgtccccaagcatgctcggcctcagccgccgccgtcgccaactcgcccgctttgccactggccgccagacgcccggcgaacttccgtctccgccgccaaccgctcgctcccactggctgcccaccgcccaggcgagctccgccaccggccggtccgcctttgccgtgtacgcgtgttgcgcccgatagagagaggagagagagggattagggaaaagaaggtatcacatgtgggtcccaccattattttaaaagaaaatgatgactggattgtcacgtgtacgccacgtaggacgaaaccgctctagattcagtcgatgggggtaattcgtccgatataagaagttcagggtgagtgatacctggttttcgggttaggggggtaattcggacgactgcaatagttcagggggtaattcgtacttttttcttttttttgtaagagtggtgataaatatgtggtagttttaaagtattagtaaaatataggatgttggtatatgaaggatgtaatatggatgatccgttggagtaaaaagtaatatggagtaggaatcttttgggatgactatctaaatgggagtgtggatgatgaaatttagatgagctgctgggatgctctaattgcacagtttatatataaaatcgtgagacgaatctttcgagcctaattaggccatgattagccataagtgctacaataacccatatgtgctcaaaagattcgtcctgcggtttccagacgagttatgaaattagttttttcattcgtatccgaaaacacctttcgacaaccggtcaaacgtcactaccttaaaaattttcattttaccaaaaagtaaacaggaccttgaggtgtactttttccacgaaaacggccgattcgaccttcgctccacagcctggctcgccgctcgaggcgtgcagcgagccgcgagtgcaggcagccaggcagcgagagaagtcaccgcgcggcctcgactacttctccgcctcctcatttcctcccaccgaaagaaaagcttagggttcggccgctgctgctcatcgccgcctcatcctccgccgccgggcgtcggcgccggctcccctccatcgccggctccctccgtcgccccccctcagatccgtcggctgcccgccttctcttccactgtgaagtcctcgttctctccgttgagcccatcttcttcgtcggttttcttcctcacgccctctcctcttcggttctctccgtcgagctctccggtaagtgcaaggatggtatgccgccgcccattgtagggttgggaatcctctcccctttcctacccccttcaattttgtgtccactctttctttgatttctgtttttctttgtggatgagagcacatgtccccttcataaacaaacctagatctactaaaatgtgatggattttaggttgatttgggtgcaacaaagtgctgcataggcttggattttgctatatatttttgccatgttatgcactgttggtctattttctagatgttgctaagcatgactaaaaatatatttcttggtcgatctacttatctttcagttttgtacacatgaatatttgttaaatcgattgcctcgtagctcagatctgcactggttgtttgtgatgtgctcattcaagttagatctgtgaccctgttagttgtgcatattactgtgccccttttgttatgtctgagcaaatttccttggatgtggcagccgtggcatgggtgcataaatattggatttgcaatagttaatatgccaccaggttttggattaatgcccacgaatttgcatgaatgtttgtcgcaagcttagagttaatgcactaggtattctgttcatcatgaaacttataaatcattatatggcggaataatcatctaagaagaactttatgttggcactgactaagcatttctagttcataacacggctaaatggatatgtttgtgtagtatatttagntgtgttatnaantagaaatgnttagtcaatggngacataaagntcttcttagatgattattctgccattgtgctgctttagctgtcactgagtttggcatttccactcttgcagataactctacccaggctgagttgtggctggtattggcgatataagcttgttagctgttttctcttgtgtctttggtcttcatctttgattacgcgtcattgaaaagactgtacatgagaaaactcttttgttgaaacatttctcttgtaatatgaatgtattgagtttgtgactatccttctcctgtgctagaatcatatatttcagcttcaaagctcttatggtacttttcaagtttcctgttgaaccgaatacctagtgcattaactctaagcttgtgacaaacattcatgcaaattcgtggatattaatccagaacctggtggcatattaacattggatacttggtcaactggaaaattggagctccttattcatgtcatcaatggagagcctagcacagttagagctgttgtgtgaaaagctttacaattctagagactctgctgagcgagcacacgctgaaagcatcctcaagtgcttctcggagaacagtgactacatttcacagtgccaatatatattggacaatgcctcaacaccatatgccctgatgctggccagttcaagcttgttgaaccaagtcaacgaccgcagtctttcattgcaattgcgccttgatatccgtaatgttcctttccaaaaatctatcatgaaatcagttattcagctatttttgcttttctattgcatctgcatggcatgttttcatttacgtctctaccaatttaatcagttatgattagttctgcgttgcaagttactacagaaagcagtaagcactcgtttgtagtgccatctagtataagtggccatattttaatctttgttgttccttccttaacttatttctgttgcctttgatgtcttatgcttattgaatatggctcgagttgaatggacaaatattttacattctattcctgacttcatttatgcctttgcagcagattagaatggccaaatatttatttccatttattcattgttgttttatgcattgttaatgtagctaaattgcaaaaatacatgtgtataaacaatgcttaaatctattttgtgtacttttgtgcccttgtctactgctaattttaaatcaatatattgtgatctgtttgaagggaattatgtcataaactatcttgctacgaggggacctaaactgcagacgtttgtgattaaatccctaattcagcttgtctgtcgaattacaaaatttggatggttcgatgatgataaatgcagagatattgtcaaggaggcagccgatttcttatctcttgtaagtttgttgtctgttttgttggcatttagctgagaactttttaactgttgatgacatatttaaggactatgcacctttgatttgagtggagctatataccttggtacataaatccttggcaatttctatgaccaatgcccattctttagaactaagtaatatgaaaaaggataaccagcctaccagatctattaaagaatccatatgaggaacatttataggttttattccatgctctattgcaagttaattgatgcatactaaagttgctgcttatgcttttcatttcaggcatcccaggatcattattttataggattgaagatactatatcatcttgtaggagaaatgaaccaggtgccacctagaaacttcttttttattataattttcaataactggtttgatcctaatcaatatgataatgcaatttggcaatatgtagattaatttaaaagttgaaaaatattttaacagtattaatttttttttatgtttagaactgcacaatgtgcttgttggcacttataaatcgcacatgcacatacattcataaaacatcggatgagacacagaaggtcaagcgtacatgaaacactacatatatgcactaacctgtgcacacacaattcataccaaaaggaaaagttattctttattttcctttccgatgcttaacaaagagttataaacatgcagatagacatatataggcatagtattgtcaatcaaaatattaatggttaatccaaccaatgttaacaagccaaagttaaacattgacactgatggttactatattaatttccatttattttaaagagtattggcggcaatatgatatgtggcactttactaaattgtgttggggtagtgttggtagcaatcttttttaccttcttggaactgtgatgcacatttcagcctttttactgtactgtcccacctttctgttagcatgtcacttctttttattgccttctttgacctcttaattttttctggtatagtttcttgaatatgattgcatgtcactgtatttcttgtaatgttgagtttcattttatttaacatgaaataacacagattgcttgcttagtacaagaaaagaaagggttctagttctacaaatatcttctgtgaactgtgtctcttttttccgtaaacaattctttcaatgaatagttggattgaccattaagctttctcagtatgtacttggcttcttcttactttttgcatgctgtcttctgcttatgaattatagtgttggtcaatatcttcacttctgattgggttatgtacttgtgttgttgcttatatattttcaatatagtttatattgttttgcccatttttatccactcttgttcaatttcctttgtcaggtggactgtaatgtatttagctgactttttgtgtctgtgtatgcatgcaggcaaacgcgatgcctttgacacttcacagaaaaattgcttgttcgttcaaggaccagtttcttctacagatcttccaaatttctttaacctcattacaccaactgaagaggaaggtaaagttcaaggaccagtctcatccattttgttaaaagtagtgtgtattggaatgtccacactttctcacttccatcttctgatacgatctgtaattaaactgcagtacctgatgactttaggcgtgatcctctcttgcttgcattaaggtgcttgtcatatgactttgttggttgtcctgtggatgaaagctctgaggaatttggtacagtgcaggtatgttagtttgcacaattgttatcttctctgtaaaacatttgacctatcccagttggtctatttcttataatttatgtattttttttattgatgcagcttcctgcatcttggaggcctctccttcaagatccttctactgttcagatcttcttcgattactataaagtcaatgatacatgtgtttcaaaagaggtatactttgattgggtgatttgaataatatcgacaatataatctctgattattttaccaagtgctttgtccattactccattaacacaaaagagatatattttgcttctagttcctcatgtttagaatgtacactttgattgcatgatttttcattaatacatttttcaaacttatttctagttagctaccactacagttttacaaaatttacttccattcagcagcaatattttcccaatgttttcttttaaaagtatgacttcctcacctctgtgaagcagcaatattttcctaatgtatggatctctaagaggcatgctttattcctttcaagaatctctaagaagcaatattttccttgtgaatttatcttacaaacagctgttactcttttctttctttgtaagtaatgtgccatgttcagtggattagctcttttcttgactcttccccgcgcccctctcctatgcacttctttatgtgtcctagcccttcatttctgcaggctttggaatgtcttgtgagacttgcttctgtcaggcgcagtattttcgttgaggacccttcaaggacccagtttctttctcatctgatgtcaggcacaaaggagatactccaaactggccaaggttatcgctttgtccttttgttgccaagttctgttctattttagtcctgttacaaatttcagtaattaggaccagcgatttcaattgcaatcctcttacatagagtgaaaagcctcttttatgtaaggttaagaggcatttactctaaacacgagttgattgactcatgcctggtcacgctatgtggtgcactgtagaaaccagacttgctttttataagtaaaagcacacctttgtttattagtaatctttaaaattagatacttgtctcaaattcgctccatgcaggaacaaaaataaatgctccatatctttacgtaatttattcttctgatgtgtgatctgctcatctacaggtcttgctgatcatggaaattaccatgagttctgccgccttcttggacgtttcaaagtgaatttccaggttggaatcctgttacttaaaatgaaggatgaagctaacttgtttgttttgtgtcaaggatttgctctttgttctttccctttgcattcttttacagaattaatgacttgctagtttttgctacgtaacaaccgatgaattagttggcaacagtaatgatgcattaattatgaagtgcgcattgagttcttttaggccttggttgggtggcccaattctggttggtatcctggctgaaatgaactgggatggcggggattttgtgggattccaaacatgccttactgatgttattttaccctgatttgtggttttgtactattgctttgaaggaacagtaataagtaattccatttgtttgtaggttctagtcttttggctttactgggagcactaactagtcatactgatatgcaagtcaaggttctaaatagtggattgcatttttagagtgcattggttttgatgtagagcatatcgtagtgatgcagtgcatgttgtagtgaacagttgatggaatagttaatttgtattatatttataattctacgtaatgaactgttgtgtatacgatgtttatatgtatttttggtattgtttgcaacttgcaagtgctatttttgttgactttttttttgccttacagacatttggtaccaatttattagctttcaaagtttcaataaacaatggagttgttctctgtttagaaagcatttaatacctgtgtcatagtgttgtcaagtgaagatggccattgttccaaagtttcttttaccaattttctatatgcattcattgtcccaattgcctattactaacttactgtttgttaagttgtatctatcgtatatgttctggaacaaaaagcatggttcaatattttcttaccacattcataatttgccatgaatgaccattccttcttatctagaactttgatagtaatgtagttatgtaaattagtctatgttgatcatgaaaacaaaattgaactgtattatgtttgtttgctgttggcatatcttcattgtgtcattcggaatactcccggcattgactaccaaatgatttggttggttgattgttatcagtgttactagataatgttggctgcactggtttttgatcctttatcaagttctctgttattgtcatagtaatatccagctatgaatggacctctttgtgattaagtgtgggctcttgcattgttgtacttcgcagttgtcagagcttctgagtattgagttttatggtgaatggattggtttagtagcagaattcacaactaaatccctgttgtcatggcaggtctgtttccctttttttttttgactcattctcttagcactggattattcaataatcaatttccaatagttttaactatcgaatatttgcagtgggccagcaatagtgtctactatcttttgagtctttggtcaaggctggtgacatctgttccttacttgaaaggcgacacaccaagtatgcttgatgagaccgttccgaaaatcacggagggttttatcacctctagaattaattctgttcaggtactgatttctaatgagatgatggaactgctttctatctcagttgaagcggtaacgtttgttatatcctgttgtttctatccatctcaggccagctttgcaaacgactcatctgatgatactttggataatgtggatgttcttcaggagcagttggagtctcttccttacctttgtagattccaggtcgctatttcctgtcaagttctggtttccaatttaagagacaattttctgttaaacttttgattggatccatctttgtaatcatgtccacctgtagataagatacatcgcgtaatcaattgaatgttttcttttatggagattaaccctgttccagcttttcacataacaggattcatagttttatgtaattgatctttttattgaacatatgcattggttctatctacttgcagtttactgcatgcacttagtaatttcttgtatatggtaccagaatttctttctttaaatattgaagaactaatagaatcattacacaacaacaatagatgcatcaaatttaagtagcattatgctattcatttttatcgtatttaattatatgattttaaaacaagaataaccagagtaaatttttggccaacttaagtgctttcatattgtggacgggtgcagaaaatatagtaaataagataaaaaaaatacgacaaatttcagatgaagatctcttattatcgtttctgctgttttcagctaatttatatgccacttcattatatatatctgttactttttgtctggatggaattcttattcttatataattattttgagtcactactaacctccttgcccgttaccaatagtatgaagaatctagatgaaatgcccttattgttcttagtctcttttttttttttgagagagaattgcattttatgacatgcccatatgatgattttcttttgctgatttgcagtaccaaaacagtagcatttacatcataaatattatggagcctcttctacaagcttatatggtatgttagtgttatttcacaggcctctttttggggcataaagaatgccttttcaaagtcaaatacttttacaggaaaggtcaagattaccagctcctggagatgcgaatgagctctctgtcattgaaggacagctcacatggctagtccacataattgcagccattctcaagattaggcagaccattggttgtaggtgagaaattaacattccttgcttccttccttatattctgtttgatttccttttcttttcacttacaatgttcattttgttatgcagccaagaatcacaggagttaattgacgcagaacttgcagcccgtgtgttacagttgataaacgttactgacacaggggtgcacgcacaggttagatgaaaatgatttggtcatctaacatgaaagctgagtgctgagctagtgtacttgtagcaacaacaattttcctttctagtattgtctgcaaattatagaatataattgcatatgtaggtaggactggttttgttttttcacaagcatttaattttttgtaagtagttacatgggcacgggtcaactgttctttaaaatgtgcagcatcaaataactaaggagcaacttagatattttcttaattttatcgccaatactgtaacatagacaaccaattacttgtttctccattcgtcatgaagcttggagtcacaacaacacatgtggttgttgatggtgttttggtgtttcttacagttatcatgagaaatgaaagctgtgaatttgcacttaaaaataggctgaaattgaatttatttaatgaaaatatctaaacaatgttcccatatgaacttaatctttggccaaaatcagctcactttaagagccatttttcatattgtattatgtacagtatgtaaaccacatattgtccccataaaccaaatctgtttctgtattgcgacactacggattacggaatgctctccaatttgtcctttactttcattaacctgttttagctgctcttataaccattcacagcttcacaagtttgtgaatgatgacttgcggtgcattctttgcagagatatcaagtattaagtaagcaaagacttgatcgtgctattcttatctttgtgcaaaatttcagaaggtcatatgtaggagatcaagccatgcattcttcaaaggttagaagaaaccgaataatagaacataacaattataattttcttttttttcttgatgtacctttttttgtaaatccccatcaagttttacttctttgctgcagcagttgtatgcaagattatctgagcttcttggactgaatgaccatttagttttactcaatgtcattgttgggaaaatagcaactaatctgaagtgctatgctgaggtacctattgtttcgacgtttactgattttaggcatactttgatctatatgctgtggctgatcctttgtgtggttacagtgcgaggatgttattgatcatactctgtcccttttccttgaacttgcatctgggtaaagttgtagctatatgtattcactttacatttctcatgcttattatgataacaattcttcatatgtattttcgtagcagctatatgactggaaaactgcttctcaagctggagagtacaaaatttataattgcaaatcattctgtacagtcttctcactagcttctgtttcatattatccctgtgtcattcctggtcttagaattgattatattttcattattgatattttcagagggagacttttccatttcttgaagaatacagatgtgcccgcagtagaacaaccttctactacatccttggctgcttgattttcatggaagacaccccagtaaaattcaggagtttcatggagccactcctacaggtgcattgctacttgtattcatactccctctatatctggccctgtccagatcgtaggtagaaatagctatattttggggcgtagagagtagtagttaagttttttctctattcttatatggttttcttctttgtattctctataggttgcagttaatttggaggcaactgctgatgctgctttccggactgatgttgtgaagtacgcatttattggtttgatgagagacttacgaggcattgctatggccacaaacaggtgcacaatttgattatatatagtatatgtgtacatcaactcttcttttggaaactaactacttttgttggtctgatccagccgcaggacctatggcctcctatttgactggctgtatccatctcgcatgccacttttattgaaagccatctcactctacgctgatgagccagaggtaactatgaaatcgcaatgctttccttgcatagctgttcttgctgaaaaagtttgaactgttttttaaaaattatctagagccttatgttttttttgttcagctactataaaatcacaactttgtgttcatacaggtcaccacacccctgctcaagtttatgtgcgagtttgttttgaacaaagctcagagattgacatttgattcgtcatcaccaaatgggatccttttattccgggaggttagcaagctgattgtggcttatggatcacgtattctgttacttccaaacggcactgatatttatggaagtaaatacaaaggcatatggatatcacttgctgttctttcaagaggtgagttcagaaaatatgttttgaaaacacatgtatgctctgcaattttattacagtttcagcaagtctacctgctgttattcactgttatctaatgcttgatctttttagtgaatttcatcctttacaattttatgtgttactctcattgcactttttttttgtttgaaaaaagtgtgctttaggttacacttgctgtgaaatgttatttgcattccaacatgtctacgaaatttcatgaccaaaaccttgtttttgtaccccattgagatcattgttttccaacagacaatattagcttatccccatgggccatataatgacctggactgtgaaagcttgttcatttttgttaatcatttaactccttactgatttgtgatatttgagttgaattgttgcctcgtagggcttggcagatgataaatatttaaattgcataagatttgcagtagttgagaatggatttatgatgatttaggctaaactgaaatttagctgcaactatggttaaattctgttgcaaatatggagacgttctatacttttttggtttcatgtgtgctacgatctatggatttcctttttcaagaggatactgatgtacttgaatttggtataagatgttacttggagttttctgttagggtgacagcttagttccaccctctgattcaaactttttgttgtgcttttaatgttaaagaataaaattggttgagttccactcaacttgagcccaactatttgttcttaaactgtatcttctgggaacctcatctccaattgcagactaaagatttgtatttttttttcttgtactgttattctgactagaaccattgcagctttatgtggaaactatgtcaactttggtgtatttgagctgtatggtgacagagcacttgctgatgctcttgatatatctttaaagatgagcctctcagttccattgtcagacatattggcattcaaaaaggtattcctggcaactttagtgatttactattgttttgctgtgtagtgctattgcttttattgatatggttagtaagatctcgaaaatattcatgctaagttttatagcattgaagatgtatagttcttattatatcacaatgaaagtgaattgaatgttatgtatatcaattaagcagaggttacttgtgcatcaggaactggactgagtgattttagtgccaatcttgtaatctaactgagaaccctgcatttacacccttggtatgttgatacgtttagttgcatgaattgatcagatcctagtatcctaacctgtctagaaagatttgtatactctgtcataacagcgctgtcatttttttatttgaaaacatacacattaaaattaccaggagaaaacatgaaatgagtactgccaacagtgtgctccagagtcctatcgggaagctttttctttggaacatgggatgctgcagttattttttatttttatgccagacattttcaaacattttttcaagagcatactcccaactcctagaactgtagttgacaacaaataggcagcagcacagtgtgtttggactttacttgtattttttttcaacattttgtttgtagtcttcttggcattttaccagcaggtaccctgcatgcaagcttagtatatttatttaggtgatcttgcaattgcccactggtaacatgcgtacaggtttagtgctatgttttccaacctatgtgctttttactggcttgatcacagacaaataaacagcctagacaccattccaggtcttgcgttgtcccacattgatttatgtttaaccagatgattgagatattcttgtttcattcgtggaagcattcatactaggttctttctttatttcagctgtcgaaagcattctatggatatattgaagttctgttcagcaatcatatcacttttgttctcaatttagatacaaacaccttcgtgcatattgtcagcactcttgaatctggcttaaaaggtctagatacagggatatcaacacaggtatgtggcatgatgctttttactgcttgaaaaatgttcctcgcttcttgttacaacagcatcggtggatcagtgcttaaactgtgtcctatcggcgaagaccgttccaatctgtggttgctggcagataataattgatgccatcataatactctattctcttttttgtgttttccctattagtttcttctcttggatctggatgtcgtgtgcaacctggttagggcccacatagaagcagtagtcaacctctctatttaaatcatttccatgtgagcagtaatgggaacaacatctgcctatggttactgttaaatcattttcatgttctttgatatggcatatatagtaaaggattgggttgtatctctatttattaaggaagtaatacacacaagcttttagtccttccgttttatctcctgcctccatggtgctgttgcactgcttggttccatggacattgattaagcctaagggcccttaactatgctcatcacattggaatccatcattgttctgtagtgctttctgtttggactaatctgtaaattattgcttccttttggcagtgtgcctctgccattgatagcttggcagccttttatttcaacaatttcacagctgctga

SEQ ID NO: 42083 - DNA, 13246 bp, Oryza sativa
ttttcttctctgcttgaagctttctactgtcaagttatcaacaatgtttccagtcatgagcgtgtaggccatttatttaatttgctaggagacaagtttcttttcagtaaaaatattaaattctactagtacatcctttgattagaactgtattttgtgttcatcactggtacgctgtatgtccaacttgtgatgtacttgtctattaagatctgtgcttaaatgaaatggatgttttttgaacggaaatgaaatgaatattacattggaacatatacatggttttgagttcttgtatggaatggtgtgggcagatcccctgagatggtgctgcagtaaaacacaagtgcttgatatatcccagacgtacaggatttcaagctttatttgttttaggcgactagtttatactatttcagagtcatgctggatactttaattacattatgtggatatcatcaaatctttcaacaatattgggcttgatatggtgcattatacagtgttgacttgttctgtcattttcaatttaagtgtgctgatgctttggtctcatatgtacctaagttttgtgaacttatgtctaccaataacagcattagtaatcattattgaagaactaatgtacgtcttgcttgcagcctgtagaccagcaacaacgcctttcgcaatgcttcgacaagctgatgactgatgttgctacgaatttggaaccaaagaacagagataaattcactcaaaatcttacaacattcaggcatgatttccgtgtgaagaacattcaggcatgacagctgttcaggaccagctgctttaaggtggtgcactcatgtgctgtaaatacttagcttagcttcgttttaggaaccaccattcccgtggggggaaagttatggtttaactcagtttggtttggattggctgaaagatgaaagggttctcctgctgcatgtggcggcaaaatgcagttgttgatctcttaccttgtcgtgtactagaatggctgagtgcaggggattgacttttttcttcttctctttttataccttagtgttaattccttctctttttgcttgtacagcaatattcatgtgaaagcctgtgatcgctgtttccccgagttgttagggggaaagcagccatcgctcaaaatataattcattcgttaacaggttagaagaagggaaaaaaagttgtaaatggttgtgcttcctattgcagtcaatgctcaaattgaaagtgaggagatggtaaatttgctccttgagcttcaatacaggtttttattcagctaacatcattttttgcagctctccatatttcggttcattatagcaccgggctactgttgtgcacagcatttttcttttggtggtgctgtgcagagttttggagttcgacggcgccttttgcctatggaccaatggaaggtagttcttcagtcttgtccgcggtatttgttggttaatcttgttcttcactcttcttgagagtttagattgtctgattgagtattttgggtgtaggttaatgtagctttgttcggtttctgttcaggtttccttggtttgacactactcagtttactaatcttgattggtttcatacttcccatatttcctgtaaaattcggtagcttgttttgtcagtgctagaagtgtaggatcagctaccttatattgtctcgctgcacggccgatgacagaaggtatgaaaggacgaattattcatataaaatacgtcttaatatttaattaaaataaaagcacagaatttttccagcactcaaaaaatgtcatttaagaaaataccttgtcaatactgcacttgtacaggaagaaccagtaaaatctaaaaacaagtaaacgtctgaacaatggataaattggggattcatttcacatctttgtgactgtcactgtcctctatggagggagcatgtctatcagctgtattggcacatcactcccccagtttaagctcactatggacgtgagcacagtactgtcgttatgcaatgggcatcggtggaagccagtcaagccactactaggctgccggtagacgtggatgaacgacacgagacctgtgacaggaaaatttaaataaagagcataacatatagtagcacaagatataaacatgtactccattgttgtcatgttacatccaaattcttatggggaagaaaatatatgcaaacagtaataaaaaaaagaaaactgcattgcaacacttaaacccgatgcaggggtcgaaggatagaaatggcacaaaatacgatctgccaagtctgatggaggcaaccaaacacgctaaatctgatctcaggaggtagaaaaaagagcgtaaaagtagacaaaatgtgcaatatccccattagtgtttgagagtagctaccattggtcactagttaggacgcaacgacaaacaacaatgcacttgaacatttaacaagcagatgttcatctgacaacgaggacaacatatcgataataggcatataataggcagtttggatatggaaggatgctgcatcatgtttccttcatttcctgttgctttttccatagagttaagtggatccaataagtccgataagaaagccgagtgccaacatcgcctcagctatgccaacctgcttgctcgttgtcgctgcagtattttccagtctatccaatctccctgcaaaaagacctctcttgcacatataaatagttacaaattcaagcgataaccaccgtaagtccgtaactgggtgagtatcgtcgattcgccgctaggggagcggtggtggtggtttggggtgtggagtgggtgtttcaaatactgggtccccgatttatgctgcattcatacgtgcaatttgcttgagcttttcgctggaacgtaaaacaaggacgagatattaagatatgattaattagtataaattattagaaacttgaaaaatagatttatttgatttttttaaaagaaattttgatatataaagtttttgaaaaacatactacgtaccattttacccgttcgaaaaatatgctaatgaaaaacgagaatttattgtttggagttgttcagaagagggagtaccattattttgagttagccctcgctagggatgaaatcggagcggatagtttccgtccgctctggataaaaacgaatacgtacctctcggatcggataattctcggatagttcggatacggatacgaatacggatatttttctctcggatacgaatacgaatatggtatcagggtttccgtcggatacggataataattcagatatccggtgaacagtgctattcggatatccgcagaagccacaagacataccccatttctttataactctatgaccttcaatatacctttttagattttaatagtagttcatctcttaacactagtccacattattaatattatttaaaattttaaaaatatttataaattatactatattttatataaaatgatctaattatatatgttgatatttgtttctattagaagttgaattggttttcgtgttccgagaaaaatttgttcccgtattcgtgtccgatcatattcgattcttattcgtattcgagatagtccgtatttgtttccgtattcgagctatccgtattcgtttccgtatccggcaaaaaatataaaaacgaatatggtatgagcattatccgtccgtatccgctccgttttcatccctagccctcgctcagaccgcttggttgtatagtacatggataatatggcgcttgtgtcatcttcttcctctggcttgccatctgatttttgtggatcgctgaccatagcagctcgaaagaaagctgaggggtcggtagtcaacctcgtgatggactgatggcagtctctggagtgcgtgatggactgatgacagtctgttctgctctactccctccgtcctaaaaaaaagacaaaccctaatttccgtgtccaacgtttaaccgtccgtcttatttaaaaaaattatgaaaaaaattaaaaagataagtcacgcataaagtattaatcatgttttatcatctaacaacaataaaaatactaattataaaaaaattttatataagacggacagtcaaacattggcacggaaacccacggtttgtctttttttgggacggagggagtagtgttatgcatgcagcaggcgcgtcaatatatgatcgattttttgtagacgtggctatggttcgtctaaaatctaacgagggttcatcttaaaaaaaatcgtttatgtagcagttgcatggccacgtatatttcaggggttcatctttaaaaaatcgtttatgtagcagtggcatggccatgtacatttcaggccaggttcgactcagccacgcttactcccctcgtgctaaaatacaatatttattaactttgtccatataaggcttattccattgttcatcttctcaacttctaccttatttttcgtgtgcatgtttttcgaacagctaaaaaaagttactttaaaattataataatctattttttaattttttagctaatacttaattaatcccgcgctaatgagttagcttatttttcgtgtgaaggaagtgagttttgaagaaccttgacgttcgaatgcacccttgcccttggcatggctattatggctgtattatagctgagtccggtagtgtgttgagctttttcaactcacaatgttcaaattactaaacaatgcattttttttcaaatttatttttatatagaagtttctttaaaatgtcaaatagacgtatttttaaattttgtaataatttgtactcaaataattataaactaattgcttatctcattttacgtaatatgaaaactctcactccaatcgtccaaccgaactcatcctaaggagaggaatagaaaaacttatttgtcttctcgagatagatgtggtataagctttggactataataaagataagagatagtaggggtagtatggatagtttattggtaaaagttatacttacaggtactatgttatatttgaaataatttttgaactctaaaagttgctatattttagaatgaaagaagtagtaagtagtaatattgtacaaatcatatataaaatacaagctcagactataacaaagataaaagacagcagggtagtatggatagtttattgataaaggttttgtttacaagtacttgattattatatttagaaaaaaaatccgatctatatcttagagctaaaggagtactccgtgataactagtactacaattgctcgtctattactccgtactgttgttttgaataaagaacctctgtatccttattagttccctatttggctagcggttctctgctgatagaaaacacagtggcatgagagattttcttaactctagtacatgtccacggcttgcgttgagtgctaagagcgtgccaactggtttgatcttgtaatcagcaagaaaaaacaataaacaaagttaaatgattgatagacgatcgcccgatgagccgatgacgtatcgatagagatcttagccgatatagttaggccatatcggcagtggattgaataagtaaagcaaaaccctaaatatgtcctatcggtcgcactaccgccttcttagtttttataaatctccttttagacaatgttataaaaatagccgataatctagtatttagagtaaatatagctaaagtactagctattactctagtacaaacttatatagataaatcaatatatctatagaaatatatcaaataacacattcattcaccagatttaatgattatgccgagattgattaaagcttcatatacttataaaaagtgatctatctagataagtggcaaatatacacaaaatatatcatgaaacatgcactaccatgtatattaggtaagatcggctaaaaccctagtactatccttagttatgattgattccaggttagtttttagggttctagaaaggactagggttgatgcaacacaaagtgtgtaaagaaacctaaaatctaaacaatcaaataattaaccacttttcaggatggtagataccttagctaatctaatttggcaaggtgatttagccgataccaacttaaaccctaaagtgagaatcaaccgatacgactaaatcaaggtgctaaactagattaactaacatatatgataacaatgaccataatgacaagactaatacatctaaaataacataatagcccccgatagtgcaagccatcgaaataagttacctcttgttgagagatcgcaaccaatgtcccaatttgaagcaagaactcgtcgaaaagtaaaaggaaaaaggtgacgatgcaccaaaagttgtattgattagattgtcctctcttattaaaatgatccagggtttatatttatacccggagtacaaaatttagtccataatggacacgacttaaactttcctaaagataaaaacaaacaaatccacatgacggactcttaccaaatctctaattcaaaccagcattaaatatcctaatcaatagatataattgacttaaatgagctcaatttctaaaccgcaatgacggttatctcaatcgaggcccaaaccgagcccaggttgagttgtatatgctacttccatatcggctttaaacgtttacaattctgtttcagccgatacgctctccagccgatgcacaatctgtttccaaactgactcaatctcgcaccaaatccgcttcgatttgtttcttcttctctgagtctgatgcgaaattctgctgtaaacattctctaaatctggctttctaattacatccatctacatacaaacctttttaaaaatccaaataactacccatttctacatgctattttttttcacatacacaaatcacctatatatacatatcaagtacaaagaaaactcatcacatctgtttgttgaaatgatttatgtcctcatgtgtacaaatcaactctgctcaagtccctaaatcccacctgcccctcctaatgcatgcatcctcctactcaactctttctattaaaatgtgtgtacaaagttttagaaactttataacaaaaagtttttcggacattaagattattttagatttagttaaaattttatgttgatattcataaatatttcttattggaaacttccaactttgtataaaaagttcaatttcaaacttaccatatttgcatgcaaagaaaaaacttgcgctaagaggaaataatatgttacaatctgcatagaagataagctagcacacaagggtgaaaaaagcactgctagacatatacatgtctcccgcaagcccaacacgtatgtactagaaacatctaataaaagtccaattaaaaaagagcactatagcagtggaaatcgaagtcgacaacagagggctccctaaattggagattcaccgagataaacaacgacttttaaagggaaaggagatatactgtgcctttctttcattcattttctgttttcttgtccctcatagcctaatattgattttagtttctcaaccgaaaaatcaggtacaacacctccctcaactattcaatttgcctcccttagcagttctaacggtggtttcattctacgtggcattagtatcaacaaaagaaataaaagaaaaaaaactgcaagatccaaatgtcattctcatctctctcttcttcctctcttctcggtgactccacacctgcaacgtcaaagcattcaagcagcatctttcccttccaactttcgtctccccgctgcgaccctccaagtaggcgccatatattaattgaaaccactatctaaactactaagagaattcatttgaactaactttcatagttgagagggacgatatacccggtttttgcctacaagtgagggaggccgagatggactttttcctttactagcaatagtgcccgtgcgttgcaacgggaaaaacaccgtttgatagtgtgacaccttgaaaacctcaaataggtaaaaatcaagtctaatttgatatattaacaaataggtagaaccgagtctaatttgatgaattagcgtataatttatgatttagttttagatttatttttcgagcctacttaggagcttatctgatggactttgattttaaaaatctgagccacattgtttgatcaaatttgctttcggcccaggtcttactagccggcccaaacttgggctggcccatctgcggcgacctaagtcaaatcgacagcccgcaagccgggcagctgagcgtggcccacatatgtggggacggtctgatgcacttccgcggcccattgggcgcagcgtaatcaatggcggcggcggttttttaagtagtatttttttttcgattcggatctatagtttttctcaccacttaggagaaaaagacttttgttgttgttgttttcctttattttattttttgtgcggcttttctttttctttttatgcacctttctgcctttgatctctctcttttattatttttttaacaaaaacgacctcaagtaccttattgcaagattatagggactcaaatataaatataaaaattacaaggactcaaatgcaaaagtacaaacccaaaaactaaattcatataaaaatggaatgctctcgacccgtaggttccgtttttgcaaacaatcttcaattcggcacatcaatttttttcaccaatgtagagtcggacttttttttcttttctgaaagggaagtcggagtttttttcttttctgaaagggaatcggatataggtgtcggacttttttattttattttttttcgctattatttttgttttgacggacgaaggaagcatctctcgttttgacttttgttgttgttgtttttctttattttattttttgtgcggcttttccttttctttttatgcacctttctgcctttgttctctcttttattatttttgtaacaaaaacgacctcaagaacctattgcaagattatagggactcaaatgtaaatataaaaattacatggactcaaatgcaaaagtacaaacccaaaaattaaaatcatataaaaatggaatgctctcaacccgtaggttctgtttttgcaaacagatcttcaattcggcacatcaatttttttcaccaatgtagagtcggacttttttttcttttctgaaagggaagtcggactttttttttcttttctaaaagggaatcggatataggtatcagacttttttattttatttttttcagtattatttttgttttgacggacgaaggaaacatctcttatttttttaagtagtagagagtaaagacagagatagagatagagaagtagagattaggaaggcagtgcaggtccctcgtgggtggtggttgtgggcttgtggaaataaatccacatccgagcccatatctcccaacaagagaagcccacccaagcccaaagcccaacccgtctctctcttcttcgattcgacgtctcctccttccccccaaatcgcgctcttcatttcgaaacctcacctcgccctcaccgccgcaatgccgcccgcgcgccgccgccgccgcaccgccgccgaggtggacggcgaggccgtcccctcctccgccgccgacctcctcgccctcgccgccaccctcttccccgccgccgcagacgcgccgctcagggaccctccccacctcaagcacctcgtccactccctccccgactcccaccccgtcctcctctccctcccgggcgccctggcgccgcccctctccgacggcggcgcccccgggtaccccccgcgcgccgccgcggtgctcctccacctcctcctcacccacccgtcccacccgccgcgctggggcgacctcctcccgccgctcgcccgcctccacgaccgcctcgcgcagctcgccaccgacgacccgcccctggccgcgctcgccgtcgcgtgcttcgagctcgcctggagggccgccgcgccggggcgggaggcggtcgttgcacagaccctgccgtacctcttcgccgaggcgctctcgtgcggctccgccaccgcgaggccggtgctccgccgcctcctcgcgctccgagacgcgctggcgctgctcgactacgacgacgacgacagcatctccgacttcaagatgctcctgctgcgctgcttcgtgtcgccgctcttcctcaaggccgaggaaggcaggaagctcctgtccctcgtgctcggcgtcagcgagggcctcgccagggaaggcctggagctcatcagagcgcaggtggggatgccgggggtgaagcgggcggcgctggtggcctacggggaggtggtgttcagggcgtggaaggacgggggttgggtcaggggggaggtcggggaggcgttcctgcaggggatgctggagggggccgtgcacgccaggagcaaggagcttgccaaagcggctaggaagcttctgtctgcgttcgtcgagcagagaatggtggctggagttgaaaaattaatctttcagcttgccgagcccgtgctgttccggtctttgcaggtatgaaactgtctagtatctttttctgctcctgtgctaatgtattactctctccattccaaattgatctacatattttataggtacaccaagaccaagaaaagctaataactctctcatactatatttactctagcaacaaactcaatgcatgtatcattcccactatttcctagccaatagcaaatcaaaatattgcatgtgggttataaatacttgtgtgcatggatgcatgcatcaatgtccatttactccgatgcacaaataacgaatagacttaatgaatgaacacaaatatgtagatcatttaggaataacctcaaaaaaactatatgtagataaatttggaatggagggagtaactagtatgatgtgcttacgatattcattatggatgggtcgaaggtgagcatcacagaataaaattgttatgcactacttgtgtacatgaagttacagccaaattaaaattagtagttatgatgaatggtagaagagcgaagagtggagtattggtcttctagcattacatagacatatcaatcatggtgctgcttgactaggattattctttgttacattggtcaaacagtacgacaagctcaataacacattaacatgatctggtaataggtagactatttaaatggttcagcaaatacctccctctgtttcaaaagtaaggcatatacctcctggcttcctgcaagcctttttttctttttgaaatatactagcaaaaatgcccgtgcgttgcaacgggtgaaaaaattctaatgataatatatgtttttcatgcataattatgtcaatgacaatgtttgtattttaatgagcgacttgttttttataaacaatgttttttttcttgcgcgattttttcaaaccatttttcagaaaggtgcatttctttctaacagtttttcctagcatgttctttttgctttttttacttacaacgaaaaccgtatttttctcccttttttcttttcttttctcgtgtgttttttgcatgtttttttttctaacaattattttctcacgctttttttgcttgtttttttcgaatgttcttttttgtttttttccaatacaggagaatatatgacgaaataaaaaccgtgtagtagatgacaaaaaatcgatggatcctatccggctcaagcgtccatcaatttagtgttttttctgacagatttttcagagtgatttgttttttagtagacgatatttttatcttgcgcggttttttcaaaccattttttagaaatggcgcgttttttctaacattttttttcctcgcatgttttttttaaaatttttttaccgacgatggaaataatttttctcgcgtgtttttttattttttatggaagatgcaaaacctttttagtgtgttttttttgcgcttttttctgacttttctcacatgtttatttgaaccgtttttattttgtcgtgcattttctctttttaaatagttagattagattagacatagcgaagagatatatactgattagaaatcggaattagttttgccctttccattttttctcgcgcgcattttttattttttacgaaccattttttcttcttatagaatcggacgaactttttttagatgttttttcggattttttttcgcctttacaggaatcagacttttttttttcagtttttaaaggaatcagatctagcattttttcaccacttttattttgccttctataggaatcggatctacggttttttttcgccacttaggataaacagacttttgttgttgttgttgttgtttttctttgttttttctttattttattttattgtgtggtttttctttttttatttttatgcacctttctgcctttgttctttcccttttattatttttcaatcaaaaacgatctcaagtatcttatttcaagattgtagggactcaaatgtaaatataaaaattacatggactcaaatgcaaaagtacagacccaaaaattaaaatcatataaaaatggaatgctctcaatcggtaggttccgtttttggaaacagattttcaatccggtacatcaattttattttttgtttttaagggtgaatctagagtcaggatttttttccccttcctgagaaagaatcggtaggagtcggacttttttttatctttttcgctttttttttgacggacgatttccttttctgagagggaatcggtaggagtcggactttttttatattttttttgctattttttttgttttgacggacgaaggaaacatctcttattttttaagtagtagagatagagatagagataaagcatgcatgtaacatttatcgctgattctctttctttcctgtctttctttcctgtctttctttcctgtctcttcaacattcagtactaaaacactaactactcccccttattctctagacatcaacgctgtggactatgatttacttgcgctagtttattgtttccaacttttctttccctatttggtctttgtgtttgacaaatttatggcttacaaaaagaagtagattgtccaattatcaacatgagtgctaaacaacatatgatattattgttttatcactttcttttggttgaacttccacgtggtcacaactcatagtagagtcagttattaagtgtctgtacaaatgaaattgctcagtattgtg

SEQ ID NO: 42084 - DNA, 3682 bp, Oryza sativa
  unsure (1)..(3682): unsure at all n locations
aaaactatgatttatgtgttgctttgatttgaatgctcttccttagaaaagcatgctcaatagtttgttttactttttggtttcacaacctgaagttatgacatgtatgcatcaacaaataagaaatatatagaacagtttatgctttaaacgtttccgtttttatctgaagtcattactgtttggcaggttgcaaactccaatgtacgccataattctttgcaccttctattagatttgttcccccttgaagacccggatgtgacaaaggatgtcaatgatcctctactagagaagcaatacttcttgctagacaaacttctcatggacgattgtccagaaatacgaacggttgcgattgaaggactctgtcgtattcttaaccagttttgggaagttattccttccctaactatttcaaaatttttaagtaaaattgttgatgacatatccaaagattcttgcactgaggttcgggtgtcaaccataaatggtctgatatacttacttgacaatccgcaaagtcatgaaatactgaaagttctacttccaagattaagtgacatggtctctgatcctgctttatcggtcagatcttctgcagttgatcttcttttggctatacgtgatcttcgatctttccagtttaataaggtacattacgtacttcttcattacatatgcatgtgataattgattctgtaacttaagtaacctttggatctttattttcttcagtttgagactttgaacaaacaaactagatgtatgccttttgtttcaggttgttggattgggtactttgctgtcttcactctcaaatgaccacccccgtgtcgcacagaaaatcacaaagcttctcatcccttcatattttccaacaaaattgccactgaaagaagcgtgtgctcgctgcattgcacttataaagaggtcacccacagctggagcaaggttttgtgaatttgctttatctgaagggtctcccccaagatcccttgttgaactgatcaaagtctctattactctggcactggcaccaacaggaatgaactctgaacagactgatggtcttgttattgcttcagccaatctaattaaaagcttatctgaggagcgctctagtttagcttccttaagagaattctttgcaaatgcaaagttgaagctactctttaaaacagaaatttctgtgggagcccggtctgctctactcagtatggctccagttgtatcacctgatgatctatctgctttgcacgatgaatgcatgaatgtagtcatgaacgctgcaggggtttccacgcaacaaggttgccaagaagcagtgctagcagcacataagttggttttttcaagtggctggtctgacgaaatgtttgaagcactgacaaatattctgcaatctaaagtgtcttgttttgctgagatttatgatatagaacctcctatctgtcccgttgctacttcaaagaggaagaaaggaaaatcacttaagaaaacaccagcaaagtctggtcatgatattggaaacgggtcatccagtgaagactttgatattgttgcaggtgcatcatggcagattaatgacatactgaaagatgaagaaaagagagttgcctttctacaatcttcttattcagacgtcgcattttcatctctgaaggtcatttgtcaagtgtacattgagcagtgcctgcagtttgactctttaaatgccacacctcttttggcttatttgagtttggctacacacagcgctcttcaggatattgaccaaactgatatcagcacctctgaggtgagttaacccccacgattccaccatgcccactttctttgataattggcacaaaaatgttgataaaacagtcagttccacctcactgtatagttgtcacagaaatgttgatgaactcaaacactagccatctggtcaaacattgatggtaactggaaccgatatttgttggttgcacttaagctatttttgctacggttatgtagattattgtgaatgtgttcaacatttttttttcatttaacaattaacatgttgccattctcataagtttgatctcttgtttcagtcaacaaccatcaatcactcactggaccatctgctgaattgttttgacaaactcctaaatgaatctgttactggttccacaaactcattgaagttgaagcagaataagaaatctgcacggcagaaacaccatcatggagttcctgaaggtatacctgcacagatatttacaacttttgatgcagaaaacctctttgatctgaaactttatttattaacggaatattgatatgattttcgaaagcatgctagagaaagtagttatgtaattaactttaaaactttcaacttgtagtcaccaaaatcagtatgttatctatctggcattatcacatgatataccttgtaaatgagtgggttatgtatcttgtgcagggaatgcattgagagggacagttaatgtatacatgcttggcacttcaattctcaagtttatcgttgacacaataaccatcaagttgatcagtgataataaagtaggatgtctcaattttgcattgtccttcacaaaatatgcatcatcagccataaaaatgcatcaggagcagagctcatctttcaaagggaatgatctgaaagacatattgatgcttatacggagttccttcacatatgcagccaagctgcttcatttggtcctagcaaactcaattgagtcacagagtcccccagaggaagccttctttcttgccaataatcttcttgatcttgtaccctctgttgagtctgctgcaggctccaaatttgctctcagtttagtttctgtcgtaaagcagtggctaccagttgtcataatgggtcttggatgccgctggttgattgggccacaggctgagggtaacatgtgtgactttggtgggtcttgcttgccactatgggtggttgcattggccaagaatgagctgcttgatgatgaaaaacctagagatgatgatcaaagcgagcaggccagtgaggactcacagtcatccagaaaactagcagaaatgatggtaattcttctgaagaaagggagcccgaaaattcttgattctgtggctggcgtcttcctgtccaccctcaagttggcgctgcagagagcggagtacggtgttgtcttgggcttgacacgctttgtctgtgtcaggttgcttgggagtgactcctcggcatcggagaagctgcatcttgctcatgattcacttcgtgagaacttctttgagattgacaagcatgtcatggacgatctagttgacagcgaggaatcgaggcagcaactggagnnngccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42085 - DNA, 1866 bp, Oryza sativa
  unsure (1)..(1866): unsure at all n locations
cctacccgcatttattgcgggttgaacgagcgcgtcacgccgcatgtaatgcagcgcagcgcgctcgcttatccggtccgtgaccgggcgcagcgtgtgaccggtcatagaccggtcagatcgcgggttaggtggtggcaggtggcctgttacacgcctcgccccgtcccgtcggattgatgagagcctccaggcacttgtccctagccggaggcggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcataggcagacaaccgcgctcccgttttgcacctccttccagcggagtggaggtaggtatgacccatcccatcggagggtcattcggacagcagccattgcaaatctctgcccatttatgaagggatgacaaggtgatctccgggagcagacgagtgaggacgcctggccacactgaagaacaagctgtgttttagcttccaagagaaggtgagccaagttttggtgaagatagggtgggtccccacccaaaagaaaagtaggtagaagtggagcatgtgggatccccttgagttataaaaggatgaccttgcccaccgaaaagaggaggaaggagaagaaagggaaaaagaaaaggaaggagaagagaaggaaaaagaggggttctagagcctgagctctctagctcttctactctctgtaattccttcacactcagatccaccagaacacaggagtagggtattacgcttctcagcggcccgaacctgtctacatcgcccgtgtcttgcgtgtttgctctctcgtgtacattccacagatcaagggcttagagcctcactcagcgcccccggccgaaccggcaaaggggggcctgtgcggtctcctggtgaggagccccacgctccgtcagcatcctataggcttatacccatatggatgctcaacgacttcccaagtaccattagacataattgagtccatctcactgcgtaccgcttccttacaatagtcactgttaggagatgaatatgcctcttcaatggttcttggagtgacatccacaaggtatacaatgtagtcatctccaaaggattttgcaaccctttgtctcttactcttacgagtatctacaatgttatcctcctcaggattttcctctggcgtttgatcattgtgttcttgttgacggtcattatcgatcagtcttgaccgtcaatattaccaaaatagaggagaactagtgatgctttcaatgcatatatatatatatatatatatatatatatatataatattccactagtattaggtttgctaacctttttgcagagaatgacaataaagtggaggagaatcgacatcaacatagatgataaatcaatcggacgatatcaagaatcagacttatgtatgaatgggccaagaactcagaattgacacgatgaattgggccaaaattcacaagtctacgaagagaagcaacagaggaggccgccagccaaaattgggttggattgggccggccctaggttcggtgaaccagggggttcagccgaaccctccttagtgccgttggatccaggttttggctggacggcgtggatcactccacaatgacggttggagggcaattccgaccattccaactaccacaaccgtcattggcagcctatttaaggagttcctctcctcacttcactcacacacctcaannnnnnnnnnnnnnnnnnnnnnnnnnnnnnnnnnnnnnnnnnnn

SEQ ID NO: 42086 - DNA, 1813 bp, Oryza sativa
caattttagataatctaaattcctagctataaataattgcattttaagatagaatgagtaattataaatttataaccagaaatagatatatttttggacggaggagtaagagaagatattaacttattaaggcctgcagtgataaggaaagttatgctttttatttcattccattgcattctgtagttattgttaatcacagctaggcagctagctaattatatagttatgagaatgaaagacaagggtgatcaacaggtgaagtttagtctggtgcagtacatggaacaccaatgcaaaaataagatcttttgcttgaacaaagaggaaaggctgacttgatcccagttaagaacgggtatcatggatcctgtccaaaagtacaagatttcctgcgagatttaacaaacactaaataggagtttttttaaaagagttgtcaatactaagcatgaggttgttaatttacaaagcctgcagaggctacaacttcccctctaaaaaaagagagagagaatttgtaatttctctccattgttgggtactgtatgttctttctttgtcatattgttatatgttggttaggaaccagactttgagaaaaacccggtggttgacttcaggtaagctgatctgttctgattacaatctttggtgacattgacactggacaagcactaatattgaatattccccttcacgccaatgattttacttatcataagggttggtaccctaccatccagtgtaaacggtatttatccttccattttgcaagagatttcccctacagcatgttcatgacacaaggacattagcatcccttcaagctaagtcaagggataaatgttcttgctcttggtgaacagaacttgataattttggacatatcaattaccaatatgacgttttgaatttgaactaaaatgctactccatctgttttatattataagtcgtttgattttttcctagtcaaacttttttaaatttgaccaaatttatagaaaaatatagtagtattttcatcacaaaacaaacatattatcaaaatatatgcaatgttagatttaatgaaactaatttgatatttcagatgttgctaaatttttatataaacttagtcaaacttactccctccgtttcataatgtaagtcattctaacatttctcacattcatatggatgtatatgtctagattcactaacatccatacgaatgtggaaaatgttagaatgacttacattataaaacggagggagtaacatagtttaacttaaaaaaaagtcaaacgacttataatatgaaacagaaagagcattttatttcattctttatataaatatatttttaaaaaatattattacaggagaaaacggattgattaaatcctacctctacatctaccaggaatatacatagccaagagttacacacttacacaagagctacataagattacttaaaaaaggttttgacgaacaaacaactagattacgaaaccgttcaaacaacatagaaaattacgtaccttgttccagtcactctgaaagtccgaatttcaatcacgaattttcctgcgtgagtacttgtccgtttgcactttggcttcttgcacggtaacacattaataacattgcagtttggtaatccactcgtggagcacaacgactctgacctcaccagatcacgcggttgcaagagaaaacaacagctacggctcatgtcccccactttgacttcgcagtactctcgctttctacatgcatgggccggcatatagaggtgattacacgacagctccagcctgaaa

SEQ ID NO: 42087 - DNA, 7296 bp, Oryza sativa
aaaacatgggccacaagcagctcgacggctactctttgccatctgcactttgcgtagccttaaaaataaggtacattagggagaaacccaatgtaaattttatcaaggagggtgaatgcattgtggagagtcaacagataacttacataaaagaaaaaaaagagaaatatcgtgagagagtatggccatctccaatgtggatgcttaagtatgtgcttataaagaaataactgttttgtcttgccacttagtataagagaggtgttaatcctgaagcatcgatgcttagcagagcagatgctcaactgtgtgagggcatctacaaataaatatagagtcaggtatgagctttattccatatagagactaacttcttacaacaaccgagattatatggtctttaaccattaatgcacctaaatatttttttcttactagtactcttttttcctttcttttatccttatgcaacaaaattttcttataaatgctaaaagttgtatctaagccgatgtcatacatagtaatcatgtttctccttcctcccctctttttcttctatgccattaaatttacttacatggcaataaaaaaaatccgctaataaagttgaccgttgtacatgccctatataaagcttacctcaagtcctcaactacttgatttataagcacatagaaggagatgtttgcattcaagagagttcttagacagatagtactacttaattacgtaactaaattaattaagcactcaatattgacgctttacattgaagacgctctaatacacaaatttaatttaatagtctatgggagtaatgagccgaaaaaatgtctcggatattagaccagtcccaacccaagatactagacatagtttctataaacttcacatcatcaagaaactagtaccaaacactactcttacaatgcaaatatcaattttacatacttaaattaaatgctacttatctcacatgatgtcttgaatgttatgtagaaaccatgtctcatgcaatacctggtttccttctctttcatcatttattcacttgccacatcatctttaattctaggtgacagtttatttaatgctatggcaatactggattggaaatggccttagtgtgcatgggtgcaacaaaactgaaagagccggttgcacttctatcaccatcttgcactaaatggccgtttcgttggatgccagaacttgtagaatttaattcgatatagttacactacgagtagtatttaggctgtgttctttcctgggtgattgtaagtcagtttgtttcgtttttcatgcatacgcttcccaaactactaaacggtgtgttttttgcaaaaaaaaatctatataaaagttgctttaaaaaatcatattaatctatttttgaagtttgaaatagttaatagtcaattaatcatgtactaatggctcatctcgttttacgtatctttccaatctcctctacgtcctcttctcaaacacagccttagttttctgttactcgttgcctgatgtgccacatttttcttcttacaagtttacatgccatgaaaaaaaaaattcaacgcaaaaatggtggcttgaaatttgcaatagtatcgacaaagaactgccaaagggtactccagtactcagggctcctttagaactgatgaattttgcataaatcttactactagtaaaagaaaataaattactcccgccatcttagtcgcttcgttcgttcccgggtgagaaaatatctcattttctgcacgcacgcttcccaaactactaaacggtgcgtttattgtaaaaaaattctatagaaaagttgctttaaaaatcatattaatccatttttaaaatttaaaatagttaatactcaactaatcatacgctaatggctcacctcgttttgcgtatcttcccaatcttctcaatcccctcctcctcaaacacaccctaaaactctatttctagccattgattaacaaattagtggcagggataaaagatcaaagtacctcttattataagaaataggaaaagatatgaattacacccctaaactatcatggtcgatcgaattatccccctaaactcgaataccggatattttacactctcaactatacaaaccagataaataacccccctagctcaatccaaagtggttttaatcctacgtggcagtctagtcagcaattttttttataaaaaatagtgtgggccccacctataagactctccctatctatctttctcctctcacatctcaatttctctctagtctctactctctcttcctcgatcccgatccacacacacacactctctctctctctctcctccctccttgcagcgagcggcagcggctggcagagtcggagctcgcacttgcgtgaaggtggcgacggcggtggtggagccgaagctcgcatgagtggctggggcggcggggcgtggctgggtgggtgctactgtcggcggtgtgcgcagtggggaaaggggaactagtcagcggtggacgcggctgggtggtgtcacaccccgaagttctttcccaagcctaaattgaagttataaatggtctcaagaaaataccagtgtaaagcaagagtagaccttaataaattaatgcaaataataatcggaattggcatgtggaattttttttgagttctacatgtcgaaattcgctaacaagatttttagtggaattttcagagctctcgaaataattttaaccaattaaaattgagcacatgcaattttaaatcccagggaaaatcttttcctccttttctttttcttttccctccttttcctcttcttgggccgtcggcccaatccaccccgccgccgcgcgcgccctcctccttgtgggccggcccaagccgcccctccctctctccccgggacgccgacaggtgggccccacctgtcggggtcgtccccttcctccggccgcccgccccacgttgccaccaccgccgaaaccgccgccgcgcccacatccccgcctcctccgagccacgtcggccacgcccgcgcatgcgccgcgcctcccgcacccactcctcctctctcccgctcgcgcccgcgcccgagatggccgggattcgaattccgaatcccgcctctctctccacctccacctccccacgtcggctggcgaatcccgcccttaccggccacgtccgagttcctcctcccctatttaagctccaccgccaccccctctctctttttacccatctcgccgaactctcccgagctctccatcgctcccgcgccgtgcacccatccgccaccgccgctcccgctactccggccgctgctagccgacgctaggctcgccgccacaccacgtcgtcgccaccgtcgggttcgcgtggccaaggtccaccccgtccaccccttctccgtcgaggttcgccgccggagcgccattcccgccatgcgacggtgagagccgccatgtccgccgccttcggccggcgttcccgccttctatggcccctctctccctctctaatctttttcttttcgttctttaggtcgtcccggaccccgtccgccgcttgtcgacctccctccgtcgctcctcgtcaccggtcgtcgccgcccctccggtgaggactccctcccctttcctttccttccccgtttccccgtgcgccgccgtcacccgcgctcgccgtcgccttcggtcgtcaccgccgccggggcgccgtccgctgccgccgccctcgccgccgcttgccatcgccggtggtcgcgtgcgcgcgccgccgcccttgccatggccggccggccggctttgtgccgagccgagccgagccaggccgccgccgcaccgtccgatcggccccgggccgatctgggccgtcgatcccgtggactggcggtggaccatccgcgtggtcctggtccacggtagaccgaccacccgtgctccactgacatgcgggccccgcctgtcgacgccgacccccccccccgggatgacgttagccctggggcttattgcgcaataaatgatttaaggacttttgttatagtaataaacacattgaatcttctaaaattcataactaattcatctgtgctccgtttaagcccattcaagtctcagtaaatcaagaaaaatgtgtagaatccattaaaaatggttttgttctctgtttcaatagtcttatagcctgtttgtattgtttgctttgtatgtcgcttagattccggttcttccgacgctccggtgtacttccaaatagtcgccgaggttcctccagcagcagagcaaggcaagtcatgcttgtcacttgaacatgttgatcctatattgcaaatgctctattgtttttcttcaaatactgtattgttttataatgttactatgggatgtttacctactgtcatagccgtactattttgtaccatgttcctttgttagcttgggatataacatgactagagattagactagggattgcttagccatgcttagttcaactagcacacaatgagggagatcctattaatgtttagacggtaggttctaatggtaatgttggattagtgacaccgcttcggtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctgggcttgtagtgtagcttttctctagccgacgcatccaggcaagggtgggcgtgatggagtttggatgggccctgcgacggcctatgcggcttccggattcacctaggcaagagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagtcgtgcccgcggttatgggcagtcaaccagattcaccgtgattagtctcaccctagtttagtctaatgaaattggatagtataggtggatggttgggcctgtcgcaacgtggtatagcgttggacagtggatggataatattgattaattattacaactgtttaattctttcaacttctgtttataaatgctcgccttatgcaaatgaaccactctagctctcctttgataattccctgcatcatacccctattccggtatgacttgctgagtacagtgggtagtactcagtcttgctctattttccccaaccccagagtacaagtatgtgtcagatggtggtttctccgaggagtaggcttcgtccgtgccgtcgaggatgcctgtggagtggtgttcccgctgcagttcaagtcaaggcttagctccagttatctttcgtttttccgctgcatttatgtaagacttttatgatgtttgtaagacgtggatctgaatgtaaacattgtcgtttgtgtacctcggccggtcctggacggggattttaatgcacattctgcttggaattctattcaggaatttctgggcgtgacaggtgggtgctccggttggcggcaggcgccgcggcaaaaggggaaccagttggtggcgagcggcggtgggcgcggatgggagggtgctccagtcggcagcgcgtcgggtccaggcgtcctctccctcccctctaggaggcaccactatgaggcgagctactcggccaaggagccgaggtccgagtcgaggaaggcgttggtggcgtaaatgacacagtggtgcagcccgaaccgtgccaccccacccgacagcgcgtacagcaggtgggagggtgctccaggcggcggcgggagcgacgaggagggggcttcggtcggcagcgagcaacgataggccgaccggccgtcgccgcgctcttcagttctaggagggaagctagagagagatttggggaagagagagattgagagaggtgagaggagagagatagggagagtcttataggtggggcccacactattttttttttaaaaaaaattgctaactggactgccacgtaggattaaaaccactttgattgagctagggggttatttatccggtttgtatagttgaggggtgtaaaatatccggtattcgagtttaggggggtaatttgatcgaccgtgatagtttaagggtataattcgtactttttcataagaaataataatactgtgaagtgataggtcagagagaaaacatactgatttatggaccagaagtaaataaggtagaaatgatttttttaaaaaataaaatttaagtgcttaagagctccattgtttcatttatacttatgcttacaaacaaaattttgaattttaaacttaatgttatagttgattttgtgattttttttatcgtatgttatttacatcatttacttttgaatctccaagaacacatataaaagtgttactcataaattatttttaaattgctaataaacggttcgcataagcacaagcataagtgaaacaataaagccttaagtctttttgaacggagggaatacatttcatgtgaaaatcatacagtattttttttctgaaagaagaaaatcgtacagtagaaaactacagcgttcaaaggaaccatgagcatctttcagattttaactgtcagatttaggtttttttggttagtaggaggagtaactgcttacccagagcggcagcttacctcccgccgttaagcgcgccgcgtgctgccatagagagtgccatgccattgccactggaagcgtaggcgcatagcttcgcatgtggccgcagcgccggcagccacaggcacctcaacgcaccagcgcacggaaggccacatgctgcacgcatgcacgcatgacactgcacgcacaaacaccattatcttaaaaaaaatattacacaaacaaacatctcactcctgcagttctgttccccacatttctctctctacccccttctatttcttcagagtaaaaacgaagaatgcccacttcttatttcttcagaaaaagaattgaagaattaacgcaaatttcatccattgattattgaccattaagctgaagcaagaaagcgctccttcctatcaaaaatatttgatgtttaagataaaaatcagttaaacttttaaaattccgataatcaatagcttcttaaatgcttagtgtaaaaacaatagaatg

SEQ ID NO: 42088 - DNA, 2692 bp, Oryza sativa
atcgattgttagaattttaaaaaattagttaaatcttgttacaagcgttaaatatttgtatttatgaataaagttagccttactatctccatcctagaataagttcacttttcacccatcctacacatagcaataaaaaaaaaataaataaaaagaatatcctcaccttatcaaatcccaatacgattgtttttttatccactcacaacatacagtatttatttcatatttttacaaacttcgatacaatgattcctaaaactaaactattttaagacaaacaaaaaaactaaagacaaatttaaaattgggcatgaaaccggaggcaatattattgtactcctacaaatgcaaaatgcaaggtactccttccgtcccatgatattaaggaattttagagggatgtgacacattctaacatcatgaatttgaattgtttggattcatagtactaagatgtgtcatatatctttagaatctcttatacggagtattttggaagtgagtttactgtactcgtacaaatgcagatgcaaatgatgatgagaagaagaggaagaaacaaaaagcgataaatgcgtctgaatggaccggtgaatgaatcagagacgggcagcaagattgtgtagggctggtctgcccctcctctctctctctctctctctctatctatctctatctctgcaaagagaggcctcatcaaatccagttgggcgcgggggacaagggggcatgttccactcacctacccgacgacgacgaaccggcgcctcccattggcccagaatttactccccctccgcccgctccgccacctcccctcccccctccgccgccgccgcaccaccgcctcgccatgtgcggccctgcacgcgctctcagatgcgccaaactgcaaaccctgcaagaaaaaccaaaagcgagaacttatcaactgctgcagactactctgcatgggaaggacggaaggacgagcatcagtggcatcattgggaggcggtcgccgtcgtcgccggccgggtgtacgtacgtcgtcgccgtcaacaccaacggtgggggcggcgatggatggatggatggctcaccggccgggccggcagcggcgatagggttgcacgtggtgacggacgatggaaacaggtgtggatgcgacgcctatgatggtttgtggatgccgtcatcggcatgcagcaacaggagagaggggggggtgcattgctggctgctgctacggcgacgttcgtgccgacggctcgacgcagaatccggctggctgtttgctccctcttctgacattgctagcttcacgatcatttgacatggactcgggttcaccctagagtacctacagtaatactccctccgtcccaaaatataacaacttatgactagatgagacacatcctagtccaatgaatctagacaaagcgctgtccagaatcgttgaacaaggttatatcccatctaggactatgttgctatattttaggacggagggagtagaagatggatcatttaccgctgacaagatgtcaatcaccttgagtagtacccctccatcctatagaaaatcaatccatgttagtttgtttttttataggatggagaaagtacactatatgagatggtatcacaaagttataaaaaacaatactactacctccgtctttaaatatttgaagccgttaattttttaaaaacatgtttgaccgttcgtcttattaaaaaaaagtaattattaattcttttcctatcatttgattcattgttaaatatacttttatatatacatatagttttacatatttttaaaaagttattgaataagacaaacggttaaatatgtttaaaaaatcaacggcgttaaatatttagggacggagagagtataatgctattgatttttaaaatactacatccgtctagaaaaactcaacctaagtgggggatgtgactcatccaaatacaacgaatctaggatgggtcacattcccccctagattgagtttttttttttgacggagggagtatgtttaaaaaaattatgtaattgatttatcattaaaggatcttttaagcaagccattttttttatgtttacataaaaattttaaataagaagaatgatcaaatgtatgtccttgaacaatacgatgatgttttacagtttacgtatgtccttaaataacataatgtatgaaaaaacgtagggaggtattttgcggtttacgtaaacatattgtgttgttttattaatttccttaagcaaaaaaggctagtggaataggaggtaaggggctaagggcactgctgaattgcaaaagtaaggggggggggggggaggaaacagggaatgaggtgccatgtctaaccgaaattcataggaattacaaaacatagagaaattactcaaacgtgttggatgttttgcaagcaaaagacatgatattgggatttgggagagacataagcgttcctttgtaacaacacatgactgttagtaaaacacatgaatggaacatcatgatcactatttaaatttcgccatgatttaaaaatatacaaaactctaaaaattattgtttgaatgacacataaaacccgtagaagttcaagaggacaaggaggagaaaacataaatgtgatactctgtacttattttcctccaaaactctcatagggctgcaggaat

SEQ ID NO: 42089 - DNA, 5876 bp, Oryza sativa
aagaatttcaaagaacttgattatcctttgtttcaatcctttttgtgagggtcaatcctttgttccaaacaactttgtatgaactttttccatagaattcaaatgtttaatagcaatccctaccttttcttctttgtttcagagcagacctacctaaacagcaatttctaggttcaaccccatgttagatttcttacagattttttttttgaaaggatcctaattaatcctacaacatccctcaaattttttttttacagcgcgctccgagtactttgtttccatgtactagcactgaagtttttcaaaatgtgagctgcagcaaaggtgtacaatatcttcctactacggtgtctgtatctactgtctgtgcgacactgtttgtgatgcactgaacagcagctcgctgcgtcggcctctctataatctgtactgtacaggttttcagtgtcacgtcgctgcctgggctggccatggcctcgtgggtgtgtcatgtgtgcatgcatgacatgcaaagtaagcttgtgtatagaacattcaggaccggatgaacagaataatgtgctttcagaggatttaccgctgccaatcaaacctgttcgtagattggacattggagtacttcagttcaatttcactcatttcagtcaaccgatccctcgccacagttaaaatttggagatgatatggcatgtgaagatccatcctgcatccgagaaaagaatacattaagcttacaaaaagaagagaagatagaatacaggggcacattcaacataaactacagttagcattgacacaatgcggaggaacaatgtggcacatgaaacaattcagttaagaactaaccctacaacagcaccaccattgcatgattgcatctgcatcactgcatgccaacgacttccacaagcttggctaggttggttcaaactaactgaacacatgttctctctctctctctctctctctctctctctctctctctctctctgtgaagtctgaagatcatgcatactccagcatgagtaggggatggcattaaaacaggttggtcaggtggtgaccggagacgctattcgagttattactactacccggtgcctgcctcattctaacaaacaaaccccatagatagccatcttcttgcgccccaacatggcagattttggcagaccaggcccccccaaccacgaggccacatgggcaacacaaggtgaccactgtggctacgcattggaaacaggtattccttcacatatcttcacatcaacctcctctcctcctggcttggtgacaagacagagaacaaaatggttggcaaagttattagagacagttggaaggataacctgtccttcccatttaaggacactgccacccttttgcaagccacaggggaaaagaaaacacacacacacaacaaagatcctggcatctctccagtaatcctcctcctgctgcctcagctcctcttctgtaatcccctcctttcctatgcttatctatgagaaggaagatggctgggtgtcagaggcttcttcaatgttctcctcctcaggttgagggtattcaaggagggagcacaaacaagaagagagcaagagcaatgtcttctttaatgttgcattgatgaggggtccagaagagaagcataaataaagaaggaagctagccatatattcttcccagccagtgttcctagtatccattctctctcaaactcaaagctccctcctccaactatctcaccttccttctattctattctattccctctggcttagcttgtttttatcagttcttacctttcttgattctcctctcctctcctctgccatggagtcatcccatatcactggggatgatggcgagggctgcaacagcagcgagtccgggtggacaatgtaccttgcctctcccatgcacggcgacgatgacggcggcggcaaaaggagcggcagcgaaggaagcaatgttgatgatggctatggctacatcagcggtcggggaagccgcaaggagtatgaagacgacggcgatggcgacgacgacgattccctcgcctccgatgcttcaaccggtccggccaaagtgaaggtgccttccgcaccggacggcgatgacgccggcggccgtcggaagcacgacggcgacgaagacggcggcggcaagggggaggaggaggaggaagaagatcatggcttgcacaccaaattctcgatgagctccggcaagaaagccggcaagacggagaaaggaggagaagggaagtcctccaagaaaggccagaacaagagaggaagctcatcaagaacaagattcttttggtaatggctttctaaaatgcattagaatcgctgtactaggaatctctcttttcagtttcttggtaagattgaatccttgctaggagtatgcatgcatggagaaaggaaggctttttttggatccttgtttttgccttccatagagcttctcccatggttgaccacccagtagtaggttaactgttgccgccatgtaaatctactgtaaccttcggttattcttcaatgccctgcctttaatgtcgcttgcagagcttgcaatcttctcctatgtttctactaagatattaatgaacactgctcctactctgaaagtttctgtccaggtagatttcctctcacacggtttgaagcattgaagcatttgcaataacagtaaagagagaagaagatgctaggtcaattaatttaattctcctctgcttcccagtgtctagaaagtcagaagcgttcatgcatattttattacaactttattagaaatatatggtacatacggcacacatgtttatctttctgctaagaaaatcgcacgcatcatatttcgacaaagaaaaatcaccccacttttatctttctgcccaatgccacaatgattcatgactagtacctaaacccaatccaatgataaaagaaatggtaacatgtaccagaggcagacattgaggatactactagttttctgaaacttttgcttgccaactcacattctttagcattgcgctaagcagatgctgagagcaggtgacttggcttgaactaatttgttcgatgcccatcatgtggtaagtatataacaatgcaccagaagaattatgtgacctaaacactccagaagaggggaatatttgtctaaccacaccactcatgcagcattaaggcagcaattgctgcacatgttctagacagggtggaaacaatgatttgtccatctcacagagcggtctaattaatagccataaacagaacaacaatgatgtaagctggcttatgtactaaaaccagctctccctcattttctctcctccccctagctataaaccaaaccagaaaattaggatcacgttctggaagaatatatgaaaatgggcaacatgagtacagctaatgcaccacttttgcaccaaaccatagcaatgagctgctatactttagcacaagaattaaacaatggcaggacgctgcatcttctatatgtggtggcaataacatgctgcatttaagccccaggccaatgatttgccaccggaaatcttcatcatcgaaacgtataagtataatcatgtaggtgtgcgtgaaacaataaacaaagcacagcagaagatgtaaacaagtgagtccagctatcacctgctaatagcatgtatcattccttcgaatccagcagccgtctaaaagcagctttggcactgtttggatcattcctgttgggaaacgatacagagaaagtaccaatctccctttcctgggaaagaaagaacaattatacatgaagggcctgttcacttcgatgccaaaaaaaaccttaccaaaattttggcaggatttcttatataattatcaaattttggtagcaaactaaatgtagccacttttttttgcaactttaccaaaatttgataaggttaaaaatagcatcaaagtgaacagacccgaactttttgacaagacgctgtaaagaatattaactgaaatgttcagtcttcagatagaaatggaacagtattaaaaaaaacagaaccggtcgaagttgatcaagacactgtaaagaatattaactgaaatgttcagttttcagatagaaatggaacagtataaaaaataaacagatccggttgaagttcatcagtagtttaggacttcttccgtttaacaatgcaagactttctgcaattgccctgtactaattttgatctaagaaaattacgcgatatgggtgatggcgccctgttccttatcctaacctagcacatttgagtaaactaatctcggaggcttagcgtctaacaccaaaacacacggattctgtcgcgagatactcaactcgcgcacatggctctacccccttgtcggcgcgcacgacgaaccagacgggctgcgggattgctgttgccgtcgttgttagcttacccgagagcggggatggaggcggcggagcagggtgagatcgcggcggagagagcggcgcgagcccacgggaggcgcaccggagggagcagcggcggcgggagcggcggtggcgatcgatcacatgggggggaagagacgggcgacgctaacctaccaagcgacggccacgtcgcggatggtggaaagggaggcaggggttgggccttgggcgcgtcgtgtgggctgcgggcagtaaaggcccatggggctgaactaccggatgggctgctagtcgtgggctcgaagcaatttttgtaggaataagttcatctgaggtcccttaacttgtcaacgagtccgattttcgtacttcaaccataaaaccagatacaacagatccctcaactgtcaaaaccggtgcaatataggtctcatggcggtttggacggcggttttagctgacgtggcgcctacgtggcaaagttgacccggtcttcatctgacgtggcattgatgtggcattgacatggcaatttaatttgtaaaataataaaaactgtgaccccacatgtcatgttcactaaaagaatgaattaaaaatggtggggcccacgtgggccccacatgtcattctcaccccctcctctctctctcccctctcctctctccagcctccaggcgccacgggaggtcaaggggaggtccggcgggggcggccggtaacgcgacggcgggaacgctgggggaggggctccgcgcgcggggcgcctcccgccccgagaagctgctcctcatcttcgcccgcagcgtcggtgcagaccccacgcgttgactcgaggaagagttcgaggccatggcgccgcccgtctccgacgagatggagctcgcgccctgtacttgtcaaagtcgacggcggcgatgaagaggaggaggtggagtagtggtggtgatggcggcggggagtagcagctgcagcagcggcgccgattcttctccacgtcgttgtgctccatcttgctactgctgctgctggtgtggcagctgcctgctgcttttgtgcttgtgcttttcttcctgctcttcatctcaccaattgcttcttcctttgagtcatttaaattctcaactttcaaggacgcaggcaaaagtacgtttcttgatctcagcttctcttaatcgtgaataagtgagcgaattaaagagaagggatggatggacctagaataaaatggagcgagtagcagttgggttacggctacacgagaaaggggagggatgaagagctggggatggatggagacgaggagcagcttctcgaggcgggcgcgccccgcgcgcggagcccctccccccagcgctcccgtcgccgcgtgatggcggggttgtcgcaggcgttcccggctatcgggctgaacgagctgtgctacaaggagtcgc

SEQ ID NO: 42090 - DNA, 9894 bp, Oryza sativa
ccgcctttttgcctctccgtgcgcgctcgccggcgaggaaggatggccgggagggagaaagaaggaggcgccggtcgttcctctctcgtcgtccgtcgatagagatgatgggtcccactatttgtttttctttcgtccgactgacatgtgggccccacattttgtttttatttcaattttttttattttgctcctagtgccacgtcaccgccacataggatgaggaccaagtcaaaccagccacgtagacgccacatctgccaaaaccaccatcaaaaccgctgagagacctactttgcaccggttttgatagttgagggagccgttgtatctggttttctggttgaaggatgaaaatcggattcgttgacaagttaagggatctcaagtgaacttattccatttttgtacaacactatactactacttcctccgtcccataaaaagacaattctgacacatcctatttctatgaatatggacatatctctgtttagattctttgtaataggatgtgtcgcattcagctttagattcattttttggggacaaaaggagtagatgataactttttaacacaatatatacacatgctcgtataaaacgcgtgcacactcacccacacagataccatatctttataagcacctttaatgactaataaagcggcatattttgagattcacgaactttgcccccgtgagcacctatcgtagattaagccgacatattttgaaattcactcagtcatcacacactcagtcatcacaagtatatctcactactcatgagtaggtcacttatcactaaaagaataattagttgtaaatgtgagcttatatgctaaatttaaaacttaaatctgggtgaacatattccaccacaagaacacatgctgaaaacttaatgaatagaaattaagtctcattttatttatagttcaaaagtaattcaaatgtttcctcataggatccctatttattttttctttacatcattatattgtctatatagttattttgaagtaatttcgtctatatctaatccaaaaggaaatttgcacagtataacatcagggcatgtttgcgcgcctaaatttagttatgaagcatcttaaacccaactcaatggctctagcttattttgtaatatcacttcagtctgcttcattcccttttaaacgaagttaaaactatttggttaaacttaagctatactaaataggccctgagcgtaaaaaaaaaaacttagctgtgctcatctagagctctatttgttttttgagaaaaacaataatgttttaagaaaggctgtgtttagttcaagccaaaaatgtaagtttggttgaaattagaacgatgtgatataaaagttgaaaatttgtgtgtgtagaaaagttttgatgtgatggaaaagttggaagtttgaaaaaaaaagtttgaaacttttgcttttagtggttaaaaaaagcaattatttaaccaaccgccggatctgagatgaacaactcagatcgaactcccaaaacctcttctgcggcggccgctttcgttagtcatcgccggccttccaaatgccgtcctccccgtggatccccaccgccggcgctccgccgccgcgggcagcgccggccgtggtctactcctggctgtcggagcgccaccctgtcaaggtatcgtgccttcccctctcggaccagcggtaatctcccttcgtctcgccgccccagctcgctgaacctaacacctagggtttctcgtctcacccgcgcaggaggcaggagcaggagcaggcgcttccaacgcgcaggagtccaggccccgcgtttctccggcggagaactcgtaaaatgcctcttgcatgcccctctccccacctttttcttggccgtttctgattttctgcaatgcgtgctttgtgtttgttatatttttttgaggtaattgtgtttgttatattgtcgccacgaatgattatctctgcaatttagatatttcagtaagcgaatgtgagcgcaagaaccagccattgtattagcttcgagccttcgagtcgatagtgctggtcttttgcttaattgctcgtctgtgacacggatgaagtgggcagtagttggttcatggttgatgtggtcgacttattgcttggaacatattggcaataagcaagatgaagtacaacagttttacctgcataattcgttatcttgtgcaagcacctgggtgtggtacttgaaatcttgaacaatgctgtgaacaagaaggaatggttaataatgatgcttttcatctggttagagaaaatagaaatgtgttgagttcaaaataaaataggggttacataaaaaaaatgggggcgacctactttttttctgaacagaaatcacctcccttccaaatcagtttggtctatctggtcctctactgataactgccttctaaattcccatttccacctctcctctgaccacatcccattgacagtcctccccttcttcctgcttatgctatataacttgggaaacaacactttcagaggcactgctccacaccacacatcatcccagaattgggcatgattcccattcccaacctctctcacaactaacttacttacccactgattgcaaaccccacaagcagagcccctggccttgattttttgtattttgttttcaatagtaaccaactttatttgatctgctaaaatgaaaatgcatgtttccaattccaacaattgtgttgaattgttttgtatatcttcttcttggtcaaatgatttggagttgtgaacctgtatattcttaatttgtagttaagttcctgattagtgacctgggcaaataatggattcatatagtaaacattattgtattactttgcatagtgaagtggaaacccgagagcatgaagagaaggtcaacaaatatcaggctgtccttgcagctcgtttgaaggccaaatacttttctggcaaggcttttggtaaaggtaccagtgcactccaatcttatgacaatagtatggcatggcatattatggtttacagaagatttgcttgtttgttcaggcagtcagatatctgcctggttagattatcttttttttttttaaaaaaaactttgatatctaatagatcatttcctgcatgttagcttagaagaaagctcaactgtatggttcaacaattgacatggaatcttcaaatggtctgagtcatgatccactaaatcaacaaacacaattagtctgtgtcatgttttggccttgagatgcaacctgtcattactaaaagatatttatattattgaatccaagatatgctaagttgactatcctaacaatcatctcgaagaaatgcattaatatgccttccttactttgtaaggatagccagtgaccagatgtggtagtagagtttgcctttttgttttcttactaatgaattaacttcaagtgatagtttttttccccgtattgacaatgattttttttttaacgtttcaccatttggtggacagaaaatgtgtttgaagaaatgactatccagtctgagaccattctgttaagcaggtgagttgtcttcgctatttgtgtgtttttccaatattgttctaaaatttcatcataagaaccattttccttttgtttcctaggtgcccgttttcaagtttatttgcagatccagcaaaattttgccgggagaagagctgtactaaagaggacatttatccatctttgacaaatgcctcctttgccaagcataaccatttatctctagttcgtgaagactcgtcgaagtaattagcggacagtttgtctgcagaaaactcttaacacctgccaagtggcacctgtctatcaataccacctaatggatgagggttgggtagttacattattaactacatatgttatccttaaactaaatgaactgaaacatgtaaaatatcaacaggcctaatttaacttgagagtttagtttcttcttgtaggcctgttgagcatatagatagctatgaacttaactctatgcaaaacaatgctcatattgagattattcctctagggggatgtctccaacattttacctgtcaccatagtactcacatgcatgatctttgcatatttttttattgttccttttctacagagtgctgttattttgtagggtactagtatcttgaactttctatattccgtttgtagtaccaacattccagggcctccattgccgattattccggtgcatctgtcaacatacatggcaagcttcatctgcaagtgcccctggaatcatggtggacagatgtatgaccaaacacacctgaactgcatctgcagccattcttatcttcgtgcaactgtacctgctaacctgcaccaggtaaaatagctcctatgagcgacggtttgttgaggtgctcttgtactttccagttgtttcctcatatttgcaaaagagatctccattgccaccaccgtgagacattgcatggtgcactggtgcttcttccaccgtgcgccgcacaagggcaggggccatgcccttttaaccactgtttgcttgggtcctgcgatgtgagcgtccaactatggtggggcctttctccctcaggttcacacgtagtaccctggactggacatcctttggctgataccgcacttgcaatggcaaatgcatcaccggtctctagatttgttttttttagttctgatctggtgcacagctgccgttcctatcttcagcaacacaatttgcaatagaaatgtacctccttttcttttcctttactgtggaaaatgagttaatatatgtacgacatcctatgttaatatttgatattgggattctgtgagatcctgcacatctttgagaccgaaatgtttgtgtgaaattcatgtctgcataaacctcaaaaaatgtaagtcgacatcatgttcaattatatatatatatatatatatatatatatatatatatgctatgtttttgaatttgctcgtttgttttgatgaacactcacgtttatgtattgacaaaagcctagatttgtttcgtggcacatgttgccgggcttgtccttaagattctttggaatcctattcgataagcatctcaatgaataggaatatgtggttcagatcttgatgggaacattcatataggagtaccaaaattgtttgatacacatccagaaccttgtttgatacaactaggtaaaatagctaatgaactacagaacagagcagcagcagttgggttattatgggtaacttaacatcaagaaagtatgccatccattagcaatcccaaagcataatccattacaagttagttgaaccccgtgacatcattacatgaaaggcactattttttttaacttcatagttgcacaacgttttgacaagtagtctactacttttagagttgtacatgcctcttctaccccatcattttgtcttactagtgttctattaactgcagttttgcaacttgtaaatagaaataatatatatgatccattgatccatgttaatttaaccgcaggtataagtatataattagttgtaaaaatacacagcaaaaacctcctcgaaacagaaaaatcgatctcatggcgcatgcatgcatgcatgcctccatccccagtaattatccttgtttagttatacacgttttcttattgataaacatattattgttaatattattatcctctcaagtgaaaatttggtggataataataataataatgaataatataattcattcagcagcggtagtcgtagtgctgttcttgcatggctccgaggagcagctactctggtcgtcggcggcgttcttctccggcgccggctgccgcgggagcagcagctggagcttgccggcgagctcggccttctcgtcccggaggcgggagttctcgcggcggacgtcggcgcagcccctcaatgcgcggttgagctcgtcgaggaggcggcggttggcgccgcggaggtgctcgacctgcgcccacagctcgctgagctgccgctgcttgcgcatccgcgaccgccgcgccgactcccggttcgacaccatccgccgccgccgccgctcctcctccgccgccggagccacgccctgcaggccgtagcagcacccgtcggagcccgagctcggtgagccattgccgccgccgccgcccgcggcggccgcttcttccaggatgcgctccagctcaaacaccgccaacgcggcggtggcgtcgtcgccggcggcgagcgcagcagtggcttcttggaacggcggcggcggcgcggcggggacgaagtaggcctgaggcggcagcgccatgttgatgaggccgtggtggtggtggtggtggtgcgcggcggcgccgaagaagggagggtttggaggcgagaggaggtggaggctcgccacctcgccatggccgccatggtggtggtggtacatgatcgatcttgctctttgtctcttcttggctaattaaagctaattaaggttagcttatgatcactagctttgtagtagctaggtgtggtttggtcgagtgattgtgttttttttggctatggtgtgtgtgtgatcggatgaggagaaactgggttggtgatggcccttttatagtgtgccacagtgtagcttagctttggatgattcctttccatccctctccttgagtgagagagagagagaagactttagttcggtccaccgtattgaatttttattgatttgggccgagtttagttccaaactttttcttcaagattttaactttttcatcacattaaaactttcctacacacgtaaactttcaatttttccatcgcatcgtttcaatttcaacaaaacttctaattttgacgtgaactaaacacacccttggatcttgttgagctacattttcttctgaaaagactgttttgttagagttttgctttaccgtttctcgatctctctactagacgacaggggtggaacctggaaattctcaagtaaagggttgagttataacatgaccttaaatatttttcacgaattacatggtgttttcataagattttaatgggattatgaagctaggcctaggccgggcttaagcctaattaagtgccgtaggctggcctgtctctgcccctgctagatgtaaatttatataatcatgattaataagtaggcttaataatgtaaaaacatgcaacggacacgtacaaatacgattaagtaggcttaatgtaataaaacatgaacggacacgtataaatatgagttttgtctatttagttttttttcaaaacatattctacaaaataatggagttcccctaaatttaatttgttcagacatcatgatataagctcagtaagtcagaagtatcatgcacgaaggtgcatagattattgaaaacaccagaatgtacgtatatggctaatatattagtccatgcgagtagggcgatgaattaatcaagctaacttgacaaaaatgcaagggtggcatgtggtgaaatgatatagatcacctccacatttgtgtactttgtgtagggtttgggcattttgtatagccaaaggagatactaatggagaaatgatctttgctgtgtcatgcaaaaatcacattactcctggtttgagtagtgcgggactaaagaatatctttagtcctggttcaaaagccaggggtactttttgatctttagtctcaattggtaacaccaaccgagactaaagattatttttagtcccgattaaaaatgttattaggcatgtgtcgggcctcaaccatctttagttccggttgttaaataaccagacttgaaaaatagaaaatagcgcacgggagagagagagagcgcgcgccacacgttcgcgcccttaccctttttctctccctctctccttaagatctcctgcgctcccctctccagcccctgttttcctctcccactgtccttatctctggatcccctcttctcctctcctcctgatcccctctctccttggcaagccggtgatgaggaagggcggcagctgcgtccccaacaagaagcggtagccgccggccaacaccgtcattgttgtcgtcccggtaatcgtggcggtggcagacttggaggaggccaatgggcggcgggcgtgaggtgacccacggtaggcggtgggcggcggcccatggggggcagcgggcgggatgcggcgggcggccctctcctctgctggagggcctcggcaggcggcaacgccagaatttgtgattcattggatttgtgatgtaccttttttttttagaatttgtgatgttgttactttgatttggggatgtagggagcaactcgatttgtaatcaaaatgcaagcaacaaaaatacaatgaaaaaaataaaagaaaaaagtcctagttagtaacaccaaccgggccacatagcgctactatatatctttagtcccaattatattttgaccgggactaagatgaacatgggattcgggactaaagatgaacttcatctttagtcccggattcggggtcccggtttgcaacccgggaccggggttgcgaaccgagagtaaagatggggtttccagctgtgagaggggtatagctaggtttgccatttgtccatatttgttgcaagatttactatcaacaccaatatgtgtgatatttgcagttgagataaaatatttctaaggatgtaggtcggatttttagcttttttgcccctagacatgtataccatttgccaaattccgattcacgacgaattagttccacgcgaaaactagatatgcatatcatctttagccggcgttaacgtgccgatgtattgtcttatcatggtattggtatatatacttggtgcaagcatcagggcatgtgacacacatctcatccctttcacatatgtctgccaaagtgccaagtcatcttaacatatgtttaatcagctaaagtacgttgctcatgagttcaatatcgatcagctagctccttcatgcaactattagggtctggtagttactatatctatcccaaaaataagttaattttctatccatttagttactctcgattttcacaattcacgaagttttatcccttcaacacccttcactatccacccactggtacaatgactttcctattaataagggatgtattgggtccccccctcctctctctatatatatagtaatttgtatctcacttgccaagaatgatcttatttagggactaagggaaataagttttagtattgatcaaattctcaaacgtttaatgaattatagcaataggaaaagtttaatgcatgtaggtcatcttaaaaaaaaatcataatagataatgcacgtggctcatatatatagatcccttctccaagttatagctgatacctggatggttttattttatgattagcgtgacttgactcaagtcagtctctcatcgcgaaatgaattcaagtatatatccatgccaaactctagcttttacacattctcctactcagataccttgctttcggttgccaactcttaattgaacattgttcatggatcgagcataaatctttctgctagccagtaaattcacaggcttgcggataggcaccatgagattaattaaacaaagcaagaataggagcaaccagagagcaaaacggcgtcggattgtgccttttcacgcaccaacatcatatccatgctgcccactgcattttggctgagtgcacttggtgtagaagccggatgctttcatgtacttaatgaaatgccctttatccgaaaaagaagtgtacattaaggcctattttggaatattagctcaattcttgtaaaattccatttaaattcctccatatgaagtggagttccaaaaa

SEQ ID NO: 42091 - DNA, 1527 bp, Oryza sativa
ttcaattggaccagcgaaaataataaaatatggattatgtgtcctctagtaaattactttttgaatgcgccttccaactatgatacattttttatgatgttcacaagcaaattacaaaaacttcgagtgcgctatagcaaaatttatctttttgttcatggagttcccctgcagtatcaattggagcaaagcacctgataatcaattacctttttctagtcaagagaacatatcatctacaaaattcagttcaatatctatttttttatcaatgtattttataacatgacgaaatattatgtacggaagtacgttttcttcgagacaaatatatgagcaagatctttcaatgttcagtttaattaaatataaaaataaattgatgcaaagttgaaagtttgacctcatccaaaacatatttttgtgaccagagaaagcaccgttacttggatcttgtgtacgtagcttattagacagagtcgtaccagaactaccattgtccacaaatttaaaactccactaatgccgcattatttttttgttgagacttattgttgcattatttgtggtagcggttgccaattggatttggatggaaatgtgacgccatccaaatgggtcacttcgtgcaaaggcagcagggggtccatgaagctttacgatgattgaggtgattgtccactgcaatgtttgcacccagcatggtgtagaactcactacaagtggataattatgaacggaacagtgatagttatgcgaccaacactgttcgaggttaggtctggttgttttgagctatggttacaagacgtagacaatttaaaattttagaacatagtttagttgttttagaacattgtttgatcgagctgcgacttataagacgcagtcaatttccaatcaatttaggtagttctttgtcgttttcgtcactgaaccctgaacttgattttggacaaagaactaggagggtaaaagatcttagtttaaaattatttctcgttgtatcggtcatatgtcttcgtccccgtttaggattctaaaaatctgtgggtagtaactagcttatgagaatttggagaaattggatttttccggtttccggcttttagtttattttctgattctacaactacggattctcagaatctggataggagttagaaattctgtgagaagccgcaactactaaaagctttcccttagacttatacgcaagttaaaagtgccttttgtattgtgcttttccttctaacgtagttgattatttaccggcgatagttagctattctttagtgttgagtgggaagaatggctaaatagctgaacgatttgtgataattatttgttgtacaaacgaataaattgaatgtcattaagttaaaaagttagattaaaaatagtattataaggaaattccttatataatgttttttttaagaaagtttagcatcgtttacgagcttggtaaacgtgtatgttaagtgcactcggaatttctgtgatgcgttattcatggcaataaga

SEQ ID NO: 42092 - DNA, 2644 bp, Oryza sativa
acgatgtgaagtgttgcaatatgactttttgtcacatccattccgtggcaacatctaaatttattaccacaaaataaaaatcgttacaataacctattaccacgctatttattaccacggctagcaatgattttataattgtggcaacatgtatctattgccacaattttagtattgatgccacgatttttttttggcaacaaatgattttttctagtagtgtatatgaactatagataatggcttcaacaagaatacgaaccaccattgtcatgtacaaccagctaagactagaccttaagatataaaccccaagtcaaattattagcaacaagcaccatctcaaagaagcctctcttagtatgcccccgtcattccgagacagtgtcgtcatatataccttctgaacttagcacaatcacaatcaaccacaaacattacttcatacaaccttctgtagacacgatccctacgaagataatactgcgaaaagccaaaaggcacctggccaaaatccatacatctgtcctatataaagagaaaaaaaaaagaacttgagcatgcaaggacaggctgcacaggccaaagccagcccagataaacttgtgtctgtcaaagggaggagcctaagctgtcgatctgccatacgttttcagcgttatccagtattgcagcagtcagttgaaacgagtttggacgagacatgcaatcatgcaggtcttgggatccatgattaattggcatacgcaaaagcgggatcacctgctaaatctcgttgcacacgattcgccaattcggtcgaagacaaatcgcaccacacacacctttggtccacgctagtttgcgtccaaaatatttgtgatttttgggtggtcaaattagaccgctgtctaatgtcccgggcgtgtagtgtgtgcagaattgtggctggatttgtcagattgcacgtcaaatgttcagcactaatcaagtagtaaacgtcacagcgcaggctgaaatatctatctgacaggagaaaattaacctcataaatcatatcaatttgatccaaatcaacggcgaaacatacaatgttttccacgaggctgatttaggaccgtagtgcatgcaacagcggcagccgccagacaactatgtatattttgtctactaaattattacatctctccatcctaaaatataattatctagggctagataagacatttactagcactacgaatctagatagaatgtttgtttagatttgtggtactaaaaaatacctcattcggtcattggttcttatattttaggacaaagggagtacatatgaacgagtagataaaacgtccacttcgtagtagaaagcgggggaaaaaaatatgctgtatgttatactgcattacagttttcagaaactaaacaataacaaaaattgagacctttcttgacaatggttttcagagcacctttgcaaaagaaatggatgtgtcaagaacatggccaaaatcattgatctctcgatggaaaaagtttatctcttgcatgtagttatctgtcttttgcatggtgaatggtacagggaggatgcagagtttggtctgatcaggtaattcaggggcagggaaaaagagctgggagacctgccgtgagaaaactgcatgccactcactcttaccttttcttttccttctttctttttattttttttgtgtgcgtgcagagaataccataataatccagattcagtggtgcttgtagccaaaaagaaatacaaaaggaaaaaaaaagctgcatcgtccctatctgaacgcactactctgccctcctcaacggtcgtgctgcattttagaacgacgtcaacttgaacagtttcagatgctacgtgtcagccttaatccgatcttgagattaaatctcaatccaattgcaggtttcaggatgacaacaaacccttggttctgtcagagagtaaaaattcagagcaagaaaacctgaaaaacacaaaggtttcatctgaagttctgaaccattgcacatttggccaatttgaatttcaagaaagtttacacacacaaaaaaaaactgtaaacgcattttaagtagggctttatgcacacaagcttttgacagacagatgggggcccctaaatagttggagtacagatttgtcaattccatgagcacttaagcagagagaggatgcaagtgggatgcagtggactgaccatccatgtctgaagctgcagtctatataagcatggaaactactaatgctactacatgaacttatatgtgcatcttagcaaatgagacttcagaaccgagcagatggaaactactatagatgtggcgacatgacgcatctcattcggaatctggactcccccggcatatcaactcccactgatggggagtcttcttctttctccccatcactcatggcatcttgcaacaactttgttttcagaggggggagagagagattgacgtgcatggtgccactcaaagtgccacgaatgtttatttgtggagcgggttattcctgggtatgaaggtgctaaatttggtataatcacgtcatggttagaccgcgaacgagatattaggatgtgtttggttggtgacctcgaaaggttttgatccgcccttgatgctgtct

SEQ ID NO: 42093 - DNA, 11804 bp, Oryza sativa
aaccccaagatttcacgtgagactcttcctcgacgtcgtacaccgatttttcacagggaatcctcctcctgtacagtactccatccgaacaacaacaggaatggtatcgtaaattaaagtagtcgtcttgtaggtaggagtagtggtatacactgtacaatggacaggtacgtacggcgagatcgattaattaatggatcgccatcgaaaaaaaaaaacggtgaatcgatcgatcttgcgcgtatggggagccaagcgatttgctttccgatcgccggatgcgtccaaacgcgctcgtcacctgatcgacctgacctgatgacccttttcacgcactcgatggcgcaccgggatccatacctttttttctcttcttctttttctcgctcacacaccggcgtaaagccgtcggctttgctgattatgccgcttaaattattgccagtttcgccgcggccgattggctcgtttgcgtcgtcgtggttgctgcctcccggaggactcgacgccgattggcccctctccggataagatcatagtaggaggagtatccttctgtctctctctcagataccgtctacactctacatacgcatatgtaacatcccaggagacagacacgaattggctgtgtttgagaagagagaaatagagaagatacgcgacgagataaattattagttataattaattaattaataatcattttaaacttgaaaagggtttaatatgatttttaaagaaacttttctatagattttttttaaaaatatacatcgtttagcagttcggaaaatgtacgtgtgaaaatcgatgttcttttcttatctttgttcaactctcagatgcagccttagatgatcgcgttagaaaaaagaaaaccaatttataaccattcattccttctaaaatataatgatttctgtttagcaaaaataaggtcatggcaaaattcacttttagtcattttaattgtcagtttcttactcttaaattgctcaggccaggttctctttccaaacatctgattggatttgaaattattaaaatgacaaagaatcatgaaaatcagtacataatatttatatcgtggtacaattttttttaaaaaaaatactaataatgtttatgttttagattggaaggaattaatgggtatgttcagctggcaggtacagcagcggcctgctgctagacgctgtttttttttaatgcttgcttcactattccaacatgctgcagcccttgcagccaaacagacccaataccactttgcggcaggtctgccctaggacactgccagtgcatgtcatttcatagtatatatcagcgggtttatgataaccatgaatgattgtatagcaggctaaattagacttgcttgctaattatgtgcaccccaaatgggtccaaaaaggcactgcatatcacacataactaattgaccgtatcggagaaaagtagtctgatgattatgatttatgattaagcttaaaaaagctagtgcaaagaaattaaacagaggcagctaggtgatcatcgtgcatatgcacaccatggtcgatcaccactgaagaacggtgggtgacgcaaaccaactttggcgacgtacgcaatgcacgtcgcattactaaagctgttaattagctagctgctcacgtatgtacgccccggtttgctttagctaattaattctccacaaggtcacggtcgatgtagtgtggatatgtgataccttctctgttttataatataaaactttcttatattgttcatattcaatacattatgaaacggagagagtactgtatcctccgcaagctaattaattctccacgaggagcactgaaatagatacgttgataataacgatgagtaaattgatgatatttttttaacaaatactagttgattgaagtttattcaggctcagaaatttttctaactctgtcactgcctggccttgtgctaatcaaggggccaccgggatcaagctcataattgggggattagtaagtataggttattaatatcgcccggcaccaccgtcaaatcatgggtggactgctggtgtttgcattgcattgcctcccctcccgtcggtttgttaatcctgcgtgtccatcgccgtcgccgtcgcgctcgcgcgctgccgcgtgacgccaccgcgcggcggacgcggtcgggtgctctcatgtgtgtccccgtgtcgaccggaggtggtctccagtttttttttttttcctcttcacactttctgaatttcacaggaaccggactactgggtgcggctggttgcagcctcgcagggacaagggtgtgttttttttgggtgtgtgttcgttcacgacgtcacgtagaaactggattataccctccggtatttgatcgaatacgagttttaaaagaaaatataccagtcacgtataagttgcattacagtataattatactatagttatatctaaaaagttcttaaacataaaaactgtcaaatgttatataactactccctattaagcccatcatcttttggcctcatcttttcgcttgtgcttgtgcttatgcttatcggttaaaatttaattttttaccttaaatttgtagctaattttaaggtttttttcatcgaaatttattttccagtctttgcttttaggtcgctaagaacatgtatataaaaaatttattcacaaattattttttgtttgcaaatatatcatttggcttattccaaaaataagcaaaacaatagggctgttcaacgctcacgatcatagactgacgaacacttccttaaaaaagaaaaacctaagaattaacccagacaaacattttatccagatttaactttagaattggattttttttaagtgacatatcctatcgtccatgcccactactacccaccgaggtcgaggacaattcttccagatcccatcatcgacaacgccctaccgcgcggacgtgtaaattggagaagttctctgcctacctccaactagggtgaaaacatgcagatacagtcagtattctcatttcctaacctatattttcctttaaatttagagtcaggtacggatagtgccggataatatatcactcatcccgtatcttatcccatattatttcatcatgtttgtaggtagatttattatagtttttcatacatattttataatgtgggacatacgggcggatacatgatttcccgtatcctaatccgtattttctaatgaattcggattaaaaatcagatagtatgtgtatcttttttttttccatattcctcccggcgagtgttggatcgggcgggcgggtacacccctacctccaaccattaacgccatcaggccacccgtacactcgccgtccacactctgccgcggcccgaggaggagggacgaaacggccggaactgctgtgtacgggagggcccaaactaattcggcccgaaaggcatactctaagtgcggaagttagttgggccggaaggtagtgcgatttgcgcaggggcctgaattagttggactggaacaggattgcagcgtactggggcccaaactagttgggtcggaacgggattgcaagttacgtgcaggcccaaactaatttggttcgcatctgcgtcgaagctggaattttttttatttttagattttttttaaaatttttacagaaacaatctatcggcaaaaaaaaatttacaaaaataaaccttgccgtcccagtggtaggcggcaagctgacgtggcagacagcgggtcaaccgcgccgtctgccgccgccggtcaaaattgcatttggccccagagggcggcaaggggctaaatgcaattttggcagcctataaagagcttggagctcgtactttttgcatttaggccccttgctgccccactagaggacggcaagggaaccagatgcaaaaagtaccgccaaatgatatttttatgttatgttaataataattaaacaagtatttattggtaaaaacttgttaatattgttataaaaatgtattgaagttggttgtttcgcaatttcatatgttaagtaaggtattattttgtaacttattcgacgtattagtacttggagaattgatataggcctatcgcagtctcggtcgtagaaacattatatggatttaaacaaggagaattatgtaacatgaagaaatagtagtacaatttgaacatgatacaactatttccattgcggttacatagatgatattagatttgaactaggagggaggtagtgcaatagttgaacacaacgacgatgtagtaatgggacaaggaagcatgacagtagaaatttcaatatgccaagttgtccgataatagctaacccctatatgaggatccatctcctctctcaaactgcgctttagtaaccctgtattgctctgatagttcaagctgcacaacacggctaggtggagttagaacccttctggtgtctatccattctctgtattgacatctccttggtggttcctggaaggaaagaatagatgtgaagcgagcaaagttagtaaatgttgtgagaaaataaggattcatgtaatcaaaatattcttaccatgaaatcgtcgtcaagaatatttggacaaacaaagaaccttcgacccaatattgtaggctttatggaacgaagaacctgacaacgatcaccacacctgcatcttggacgggcttcccatggagggagtgccgtagttagcacccgccagtcgcactgttgttcacgacattgtcgttcgaaagccgcttttctctgcaagtattgctcagtactcggatgcgaaataccagcgaccttcttgtaaacaagtggttagggtcgagaacgggattttctgtatcgacccactcgatgtatgcggaagccgtagtgcaggtctaccgaatagagtagtgttacgaagaataaaacgattgcccatacggaatgaataagcatatgcagataataaaatacctcacagtcatagttaggtcacctaaaaaagcgccttcctcgaatatcaggattcctcgaagccattagttggcatcgatcaccgcataggcagagaggacgctggcaccaaggtggtagtaggtatacacaaggatcgctacgccagttcggatcctcaacgcccaggcgtctagccattgacgaaagccggtaggatttgtaatgaagaaagtagggaagagagtactgaatgcgactgagttctgaaagattgtgaggcctcgctcgttaaggcgacttatataggcacaaaaaatcgagtgatatccctgacatgtgaacgtggcggggcatggtgggtacgcctgattggcgccgaaagttacattggtcgtatgcggcaaatggcgggcaaatactcgtatcgcacgcgaataaaggaggttgcatcggtgcggcagaaagtagtcgtgcatacgccgaaaggtatcgtgcacatataacaacaatgtattcattacacaagcatacaatactagcatgtgaagcaaataaacaaagagaagtctgctctactggccctgccccgtgccgcgaccacgcttggtcctccgggcctatgctcgcacgtggtcctgggagtaggtgaaacgatccggtggcacagcacgggtagcacgagtgtctggtggcggagtggcctgcgcctggtcctgcgtctgcaccggcggtgcacctcccagctgtgaggggccgatgacgtcctctgtcgagcctgaagcgaagtcgaagtcagtgatgtcgaagagcaaggcggaagccaccaagtggtctgacgaggtcccagcatggtccagtggtggaccctgactcgacgtgccggctgcttgtgacgaagtcccggtatactgccagaactgcgctgagtgcgaggtcgacacagttgcctgagacgctgactctgcagcctgggagaagtgggcggcctgcgtcgtagcgaactgggcaaaacctacacatcaacaacgggacccttgtaagctaagacataaaatgcatctaaattgattgtcgaagtactgttgttttgtaagtacctgtggggggcacaacaaaaggcctagccgagaaaggcggggtgctgaacggtgcacgaaaccctgaagcaatcagatgaatcggctcacatagatgtgcgaggcatgtacaaaaaatccttaaaaatacttacctccatgcggagggggagtcagcctaggaacgtgcgcagctggacggggaccagtcggtacgggtggccgctgtggtgctgcatctgcccgagcaacgtcgtctgcacgacaggtgagcactcggagaatcgagcgcatcgactccaccatccacgtgtacgtcgtcaggtgctcctctacggatactggaatccccgcgcctaaacgttggatcgtcgttgaactgtcaacgacgaccctgttgatgtcgacgacctgcatggttaatttgttcgtaaatattcgtaaaatttgatgaagagaaaggaataaaacataaaggaatggtgcgatgcagggtactcacagcacgagcgaagtcctggtcgcggtgcctggcgtagaggtctttagtgctcgcaacgtgggcctgctgctccaagggagcgaaggtgaccctagtatgggtgcgtggctggtactagcgtaggtaggcctggtacacctcctcggtgtgtggctctccctcgtgctccacgacctcctcggttgcgagcaaccagtcctcaacaaaagtccccaacttggtgggccagttgccagctgactgctgacccttgcgcgagtacctgcaaattaatgtatcatattagtgtgaatcgacagatgttgcaaattattgtggagaggtagattttaatgcaacaaatcaaagcgtagtgaaagatcttaccggtgaacatcagctgggacggtcgtcgaaaacagtactggaaaaggctgacggaagccgaattgccgcatcacgcggaaaggggcatgaggctcaacgcagatgtcgaagaccatcggaatcatagtcatccaatacgcctggtcccttgtgcagagtgtggacagacccaacggcgcacgagcctgggtagccgcggcactgtagggctcccacacgacgtcagtcggcagaaggcggtcgaactccataacgaactcaggatacgaccgcctaacctggacgtgagcccatcggcgctgcaatatgagacgatcgatgtgatgtacaatgaacttagcaatgaacttaacaataagagaagatcgatgcaacgtacctgacgacggcaccacagagtacccatcgtagggtagtcgacctccggtcgctccgcgtatagtgactcctcgtacgtgtgctggtccacctcagggcggccgattgcaatcctctcagctgcccagatagaaagaaagagagggcacccaccaaaggtcgcgctgggatccgacttcgtgcaagcctcgaaaggccacggtactgagccgccaacaacgcggaaccccacgtccactgaggcacctcgccaagagtacaagctatttaaatacaacaaatgttactaagggtacataacgatgacgtgcaatttaacatatatgtagagttcgataatattacataacataacataacattacatgccgaagtccgacattacgtcagcatacctaaagacattacgtgcctaagtctgacgttacatcacgagatctaaagacatgacatgccgaagtctgacattacacgacgaaacataaacacatcgataagttcgaaacaaattacaagcaaagccacatgccaacatagaacacaagaactacaccacgtagccagacgtggcacgacgccgcctaggacgtggtcgagttgaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctggcagcctccgactcgtccatatcgttgcggatgcgacgagtcttcctccttgcagccttgcctcggagcttcgatgggtcaggaatattgagtacttcatcgttagtctctgtgaactccctagctatgccgaacccataaatctcgccaccccatgtatgatatactgcttgcttactgaagtactgtgacacatatactgcatctggtatgccacactccgttgcggcagcaatgacatgggtgcatggcctgtggagcagcttcggctttgcacaagagcaatgacatgtgccgtcggctttgagaacacattcttgtttcactctcttgcggtagatacccctgcttgccttatcttgacatagtatctcaaacctgtgctgttgggtaccttgcactagagctcgatgtttcatggcctttttacacaactcctctagctttttctgcatgaaagttccgaataaaatgctgttgttcggtatagagggaagaactgcctagaaccgatccctaaaatacctgcatgtcccatgtaaaatgaactccactatgccaactagtgggagtccacggacactgcgcatcacccagttgtaaacttctgccaaatttgttgtcattattccatatctagcaccacatgtgtcatacgccttggcccatttctcttttggttcatgcagaatccactgagaaaatttccgaatctccactccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgcatagcctcttgaacatgttcatgagctccttgttcttgaaatgtttgaagaaattagctctcatatgacgcatgcaccacctactatgtacatcttcccactcaccagggtatcctcgttccatactcccaaattgcaactcttctatcgctcgcagaatgccagcgtgcctgtcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatttgatcccgatactttccagtcaagaatgtcccatcaatgcagagaacaggtcgacagttcatgaatgccatcttgcatgcatgtagagctaagaacgccccctttgcagcacactcttgccaggatgttcaattgaggggaatttcttcactgcgtaagagctcccagggtttctttcttcgataataccaagcaggcgtggcaaattgtcatacgaggcttcgtaagttccaaatctcatctctattattttctgtttggccctccacgccttggcatagctaatagtatacttgtatgtttcttcgatgtgttggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccattttcccttataagcgtgcacaatccagggacaaccatctttttccttaacacaccgaacttcatattccgaccagttggacttggcaacccaaaactctctatgaagtgacactgcaaaatattttaccgcctccttcatatcttctgctctagtataaatcgctccagaataacctcattttctttgtactcccatctcacactatcctcttcagagacgaccagactagaaaaatcctcactagcccattctgctggattaatatccgtctcatcatctgacgaatcaccttcctctacatgctcgttgtcagaatcctccctctccatttcatccacaatggcaccgacagtctccccctcataggccactccacctggttgaatgcccactggagctactacgcccctatcctctcgtgcattgacctcttccacagaagtctcatttacttcagcacttggtccctcgccatcatccatgttcatctgcacacctggatccttcgggtgaacaaacggaaccatagctagaggccacccgcgttgcaatgcatattccacataccatctccacactcgagagttttgaactggcattagttcccaataaaaaccctcaattgcccgacttactataacattgattgttatgtcacttgtctgtggatcaactctcaagcccctcattaactatccttttatagaaggtacactcctctcagccggtctgtcaattcccctttctgatacaataaattctgacagatctaccccagttggcccgtaacggacatttcctgggccatggtaaacttggaatatttgtttgttcgacatatctgtcaacaaaataactagtatcatattattctttcatgcaataaacacctacaacgtaatatcttcttgtgtatgccaattcaacggtaaaatactgattccaaactagcagatctacgtagttatcggtatctacaatacgcacttctagattagtacaactaaaaccctaaaaatataatgcatttattcaaacaaagttttaaaaaatacacagtatttaactcaatagtcacatataggatctatgaatattacctgaaatcggcgtgtgaatccggcagggcttcgccccttcttctcttctcctcccctttcttcttttttttactggatttgtggggggaggaatgagggccgggggctaggcggcaggccttttataggcagtgaggcctgccgcccgaccagagggcgacaaggggccgcctgcaaaatggccggccccggctggcttttttgcattggggccccttgccgccttttcctgcaaaaaaccctccctccgtcaccgctcgtccctcccccgtttgccacgtcagcttgctgcccaagtggtgggcggcagggtctatttttgtttttttggccgatagattatttctgtaaatatttttaaaaaaatctaaaaatgaaaaaaattcttgaagctgagactaaaattcggcccactatgcaacgaaacgacgatagaaattcagaaaaagtacacgcaaggtccctcaacttgttagccagatagaaaatcgtcccccaaccgtaaaaccgaacatctggtgtcccccaacttacaaaaccggtcacaataggtccctcggcggttttgactccggttttgtgccacgtggcggctgactcagagtgggacccacgtgggccccacatgtcaggatgccacgtcatccctcccttcctcctctctctccctctctctatctcttctctcctcttgggcaggtcatgccgtgacgcgcgtcgagtgccgcggccaccaccactacgactgcgacctgcggcagcgaggggggagggcgaaacggagcgggacggtgaggttgtcgccggcaacaaagccgatggctggtgctgctgctcgtcgccatctcctccgtcgacaacttaccggagcacgccgggttcgacggggtgcccgcgagcaccattgccgcgagctcaaccgcaaggtgctcgagcttgccctgtgcaccgtcggcatcttcaccgaccgcccgttctggaggggcggcgccagct
